United States Patent 6,812,339 (POLYMORPHISMS IN KNOWN GENES ASSOCIATED WITH HUMAN DISEASE, METHODS OF DETECTION AND USES THEREOF) - sequence listing, part 47

SEQ ID NO: 14588 - DNA, 302604 bp, Human
  misc_feature (1)...(302604): n = A,T,C or G
cattttgaagatgagagaactggggttcagattaacaaagttgttcaaggtcacacactgcctgtatgtgatgggacttagactcgaacctggacgtgtatgcctcctaagcccatgttcccgaataatgctatgtccctgtctacatttggcaggggatgaccaaccttacctctgctacccgctttgccctaatgcttcttccactgaaaagatgagtctcctcagactctcatgtttctccttcactcctgtccatgaaatatcaaaatggagacaaaagatttctatgagtggtgggtgggaggaaattatgcattatcagaatgaatagaaatttgggaagagcctaggacaatttttctggtttgaagccattttgttccattgttccaggctccagactacgtctcgccaaatccaaagttctgtagcaactgatatactagctgggctccagggtccttctatcccctgtatattcccaattttatccccgatgtatatcagttcgctttacactggcaggagagttcatgttccacttagaccaggaggagaggatatgaaaaggaaaatagcaggtgtggggaggataaaacccatgccttctacagtaactgtaaagtaaaagtgaaaaacgtgagagataaagaggattctttttcctcattgcgggagaaaggggctagggagaggagtctatagcccaggaggttcatccgcagcatgctatggagaaggccaccgtcactgaaatccggtctgtactgtaggacttcataggttctttgctcgccttagagcagaggggaagaagagtcagaaagaattgataacctctgaggtcatcagtcaggggcctaggctgctaagtccagaggcaacaccaagggatcaatgcagctaggtacagttttctccagcctcaactttcaatccccacccccagaccagctcattcccacacctccctcctccttggtcagtgagcctgagcgtccttttcattaaccttttagttactacctctacgcacatactttttcctatgccctccaaagaagtcagccccatactgcccatcactgctcagcaccgcccaccccatgcccccgcaagccggcctcagcactagtttaaggggagggacacgcctcccaaagctgcggggatgggggtgggggttgctcactcgccctcggatctctgctgtaaaagcggagcggcagagaccgggcatgcgcagcatcttcgggcgcattgtgatgggaactgcttctctgagtctctacaaagactccggagtaaccactaatggccctcctaaggccccccttctttaagacagacacacaaacacagaggcaatgcagctatttttttttaaagggtgggaggacgttgcagcttgaaaggttgatccacgttaggagtggtgtatttctattgatcccatctccggtgttgacaaacgccagcgcctaggctttgcagtccggggctgcagtttgcagtagagctaagcggtgtgcggctttaattccacgtcagatcaactttgatcaatatccccctactggcccaattggaagagcccaattcaccggcactgagccttttcgctctttcctttttttccccccctctttagacctaccatcttttgcgggggggggggggcgcggagagagtctcagattgtcttgataatttattctttcgttctctttcttttgcttctctatttttgtttttcagtgttttgcttgttttgttctgttttaggattttattctctctctctctctctctctctctctctctctctctctctatcatagggacagaaatcgctttggcaaacccagcttgcagccaatgaacccgccttccagattggtgtgaagacagaagtgaggtggggggaagggagggggtgtgagagatcctgggagcgagagggagagagagggagcaagaaaggaagagagagcgagcgagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtagcatggccaggcagaagaaaatggggcaaagcgtgctccgggcggtcttctttttagtcctggggcttttgggtcattctcacggaggattccccaacaccatcagcataggtaagcgcaagcgagccagccgtcggtccaggctctccctcacccgagaccactgccccggcaaggctttccctgcggtgggtccctgtcctgcgtggcctgggaactgggactggggccgggaccgggcagagatggtgcggggcggggggcggggcggggggaatctgagcctcaacgaggtggctggtctgaagagcctctgggacaagagaggggtctcctggggctagtgggggtgaactgctaggttttccgagccgagaggagcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtatttacaagtctagaagttagaatttttgccattactgaaccaaccccctgtattgtcacgggggagggtggctatggggaacgggttggggtagcagggggaacaatattgtttttcttcccaacctttcccttcacacaatgaaaagatgaccagctgtgcggatgggcggggggcggagggggggggcgactaaaaaaaaagaaggctgccgactaagaaagaaccaagtctcactcttggttccatcgtcctaacccaaaacggctccctcgtctcttctcccttctctctagcctcttcttttcagtctagaaaagccaggtttctcttggccaaaatctgagttcacaagtcttgaaagacacacaggttgaatatcaatcctcaatcccacaccccagtatcattgagaggtatccggtatctatattgttccccaattcctaactggccctagtgtgggggaacacaagccaaatctccgttccctttgcttataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtaagtagatctgcttttcctccctttgggacgttggggacctcatttgcatctttcttgtggcacttagggtctgtgtatgtgctgggagatgattgcttcagtagatattttaggggctctaatccatccggtttcatgttgcataaatcaactccaaatgatactgctgaggggcttaagacagtgggaaaaactcaagacagtgggcaaaagtctgctccaaatagtgtttgatgcaaaagtttcattttcctccatgctaacctagtgtgttccttctccaacactctctctcttttttttttaactggggaaaaaaaaagaaagaaagaaaaaaatagcacggttgttcagagaaatttcttcagatgagatttaaaaaagcagcagcagcttcttgattgagtcaattcaggatgtacatcacttgactgttaaagctagtgcctggctctaggaacgagctgaatttgacaattgcctaatgtgtaggaagcaaatatgagaaattctgcaaacaagtgaccttgaggggcagaacaggctgggttccctggcctctttctgtcctcaaatattaccttacttactgagagagctctgataggaactcataagactacaaactgattgcaagtgatgaatgcctagcaaactgaggggaggggagaaaatggtgatcaggtgatgatttagaaagctagttctgcctcccctagtgttgttcacccccatgatcattaaagacaacacagttcttaatttagagcaaagagggggcaggaggagaggaggcttggagcaggaaaactgaatatggaaagagaagaaattcatcaggcccaaagccggttctgaaatccttagttgtaccgggtgattattcctctgaaaaggggacattttgtaaaatacaaccaaaggaacctaaatggctaatagcctgttggacatatggttttacttgaatggaatgtttcgtgagaaagactgagaatacttcatgtaagcttatttcactaaaagttttcacaacaatgaggctgaatatggtataaaatatgctttgcttttatggctgatgtagtttggaatttggggtttttcttcctttctcttccaagggagaaatgatatttatgtttggatgggtgaaactttgtatatgactttctttaaatccttctgcctcaaaggatgcatggtttccagaaaccactgaaagggtctctccaagggcacaggtttcttggctttgaagacttgggccaaggggatgggggtaacatactctgcaagaaatatgacagttgtcagctttaagaaaattttagctgaagatacagatccttatatgaacgtgttctgagatactccatatttgactttctttggctttctgacattgacaaaaataggaatttattaattccagctagtgtgaaagttacgaaatgtctgtctatactttgcatcttattttggtaatcccagcctgtctccacagcatttacaacacgcatctgactcttaatcctgcagcactgtgatcttgtcaagaggctgaatctcaaatgcagcttcctaaatatcaattagaacagatttaaaactaaatacattaaactaccagggtttattaccattagtaacaaataatatttatttcaactcccttcagtgtcttttcactgatgagaactgggataagagaaccatttggtttctcagaaatgattgatttccaaggtttttggtcctgttcttatggtcaaaccagattgacacccaccagccctggactgtcagaaccccactcaagaagcaatcagaaatgattcttgccatgtgaaaatctcaggtttaggaaaaggcaataagtcatccatattggtattgagttgccttattgccttacctctcagggcaataagagaacaaccaggggaaaggaaaagaaattgatcaaaatccctcaccgtaaattcatagcatttccacttacaaggctgggttgtggctaggggcttgagagttcgggagaaggagtgtggctcactgggcaacaagaaaaagaaaatgaaaacgtgaccttgcccttagttatgtcaaatacacatgtatgcatgcacagacatacgcaggaaaaatagctagaaaccagtgttgtgtatccagctgcctgttgctttctctgaagacagaggaggaaagctgtcatcttctctggtccctgaaacagtcatctctgaatgtcacaatcattgaatgggggccagatctcaaagctgtctctaggcagctgctgcttggtagcttagtatgagaaagatgactcgtctaaccatagtcttggaatgcagaaaccaagtatttcaagggaccaaagaagccctggaggtgtttctcatttctacccctggctttaattgttctttttcttgtggaagcggagatcaaatatttccaactgggttgaaattctagttcagtgctggagcctgacaggtgacccccaggttccactcctccaaatgattgccctgattgtgcaaagagaaacctctgtatcctccggcctgtccttctctggagacctagggagaattccagaaaacaacagatgagtctcaatctggccaaccacctctcctatctggttcaatatggaatgggctggcaaaaattaaagaaactttcccttattcctatgcaaaattcctagtttcaacttcccttagcactagaattgatctcttctcatgatctttcctgcaccctcaatcctgaggcaggcacacactttctagggtgtaggtgtgcaggtaaacgaatacacaaagaataaacaaagggtaattctttcatatatgtgtccctgttctctgttctccctccacatcacccacccctacaacctctgacaatgtgtttgaaaggtttccttgcgatgaatcccaggcatcagttatttaaagactcttcttcatcagaaaccaatttttttgcacaacccccaagaggtttgcttaagacagactccaactttattccatgtcctacgaggccaataagagccacactggctttgaaaggtgtttaatttgggatctcaactcagagatggattgaagtttatctaagagacttacctgatttgaagcacatgttcccatttcatgaggattaatagagtttgctgccttacttttcaacttagctagataaccccagaaccaagagtggtgtgaattctttggcttcaggatatatacattcatagacacacaatcaatatatatgaagagagatgtatacacatgtaagttacatgtgtgttttttaaaaaacagattcaatagtcctaaggctttcagggcaggggtgtggaaacaccaagggactgatgtgtcccatcgtgtggctttgctgtcctggttcctcaggaaacatcgccgattcccttgaagtcccctcctgtgtctttctgctgtgcacttgtagtgcactccacactacaccgccccagcctctgcagtgtcagctcattagcacacagatctcatattccctctccgcactgtcattgcaaaaattgctgttgtacacctttacagccaacaaatgtgcttgtggattacgcactgtttgcaagaagcagggaaaaggcaaatgtaaccttaaaggttattcaccacggaattgtactctaaacgcattggcttaaataaaaatctgttgatggaggcacaatggtgatggtgggattgagaataggacttaggagtgcaggctttaatggagccccaggtaaaatcccttttgctggctaaacgtaacccatcagatgcaaaattttattccattaatttttttcaagccatttgaaatataactgctgagaacacactccctttacaactaagcgcatttcactaccaaatatacttagctgagacaggtttctgtctcttgcctacagagtcacaatctaattatctaattattataattgccaaaatcaatttaactatttatgtccatttgggaaggaaatgtctcctttgatcccattctttgcaatttggtgggttttgttttgtcttggtttggctttggtgtctgtcctttccatgtaagatttggaaaccaggtgaagactcctgggatcaagatcaagcctccttcccttaacagattttgccatactacccaacattgactgctctggttccactccctccctcactccccctcttccctgcctttgtgcctttgctgctctccctctctcctctgtctgctggccagccttcagtaagcacgccggcttagctcacttctcggcccctctggcttagtcccctgaagcatgaagaggttgccttagtggtgccagtcaaaaaattaagtcacgttttcacaaggtttattacggtttttaaaatttatttttcatagggcgggggagggaagaagctgatgctgttcatttgggccataaaaatagatggcaatcagcaggctgtaaaggtgagcttcctgcaaagtgtattacctcccctagaaggcagcttcctattgatctactaaatcaggggggacagcagcaagaagggtttgaaggaaaggaataaagggaattattttgttctccatctacatttactgcaaaatgggccatggtttttctccctctctgcaattttaactttttttccctaaaatgaaactagttttccacattttcctacttctgcccctacagaggtaatttccttaattctgcatttccctccctagtccctaagactgagtgataatagtggaggatcgatgagctttttgttatgtttttggctcctgatgtatttttaaatttcattgttatgggtagtcagaggtgattggctggtttcattttaacagattgaaaaataaatgaagctcctgaggcatcgttatttgtcttcctttttacagttaaagagatttgtcatttttatacagttggtttaaggattaaatgatggcatagattttaagacagggccagaattttagacgatagaattccataactttgggggagactaataaacatgcttatccagatgatttccctgtcaacttcttagattgagactgcaaaataaatttgaaggacctttcataaaaccatctatcttcactgaaggtcaagcaaataatctgtatactttacctgctccattaaaaaatcaagttttgactttattcctttggctttgttactttgggtcttattagataaaatatccacaggagggtgcaattaaaaccccaggtgggggtgataggtattcttcagcagcactgtgggagttgtgcagacacaaaaggaattccctccatcttgggagctgctcagaaactgtctgggctccagatacagagctatagatagcctcagcccgtgtgtgggatgagccttgagctaaggcagcagcccccaaaaagggtcagtccttgacaaaggttaacatggatagaaattgtcttcctcatatttctacctcttctattgccattattttcttctcttgctctatccgtccagctcgtctaactcccttttgctggtctctgcctactcactgaccagcccctgattctagcatcccatccacactaaacttacctagggactattttctaccccggacttttccagacctaattcccagaacttctccttctccaccagaatacctttactcttggtccatgctccaaggatgtagagtgcagtacggcctgcactctactttgggggtgacagctttatatctaatataggtatatatttcatatatatgaaaatgtcagataaatggtaaagggttaatatatgtaacggggagtatctgcttcaaaactagggactatgggaaacatactgcctcaatttcaaggaaagatacttaaataggagtgtttctggatattactctcagagtggctgttcactctacccaaactaaaggtcagctggctttggtcatagaagacttttacaggccaaagtacaagtctaactgcccatagtaggttgggtgtaagtacacccgaggcataggcaggttcaacttcatgttgaatctaaaagcctttgcgggtaatttgggaagctgcaggttcaacttcttcatattgaatctaaatgcctttgggggtgatttgagaagctgctaaagttcataggtatttattttattaaagaggctggtgtggagactgaacctgcctatgtgggcactgtcaggagatgtactggcacaaaaggaaggttataggagaggataagggtgggagagaagctatctctccagctgtaagtttcctttccctgggatggtatgtggaatgccacgtttaagaggtaacatccctctcaccgtcactaaatagtatctctggaggtatttggaagcgtagttaagcagtatctcctcctccctccatccttcccttaccttgtctcaaacatacactctggcctccctcccagtggaaataaccagcatattctcttctggatttccaattgctcattggtcacagaagtgtttacatcccatgctctatctggacctccctgttcctcaattcccaaccgtcactggcttcttaagcaattatcctcaacacaaccatcatttgtccttatttggagggtgcaggggagcaaggataagaataaggagaggaaacacagctgataatgatccctcaaccctatgaggcgcaattcagggtagaacagcacttgttaatttttcatgtgcacaccaatcacctaggaatcttgttaaaacaaagattctgattcactaggtctgtgatggtgcccaagaatttgcatttttagcaagctgccaggtgatgccaatgcttctggtcctggaaccacactttgagtaagaagagcccagagcaaggagactgtgatcattaaaggaaaaggctctcgcagaccagctcttatccatctttgtatcttcttgccctccaaagaaggttctgtaagagacacatttggctcgttcttactcaagtatgtatctgtcacattcccaacaagtccgtgtccatttcagccaggtctgtaggtggcattactagatatctgatgatagcatttagagttgttttattgtagggatgtggagtggggactgaaaggcaggttcagcgaggaagtagctcatgagcccgggtgacactgtcttggcttcttgccataccccaaagtgccccttttagaaacaacctgcccaagagagcgaaggttggcatgcagttccaactgcctttccactttgcttctctgggtcaaggcatgccagaaggaggcatgtaacatctgctcctcagctgtctgacttcccttaaacagggttagaaacaagaagtacaacacaacctgaattctatctggttccctaagagactgaaaaattgactccattttcaaggcctgtgccaggcactcactgatgggagggatgggagggaagggaagtaatgtcactttctagcagacctgagccgagaactgctccagggaagccattaaaagcttacccagtgtcatttgaggatcgcaaaatagcaaaattccccagaaaaattgccccccaacagtgtgccattagtctgaaattccacaaatttgtttatttgtattactgcactgaaagcctgtgccaaaatgcaagcgtgctatctggaagggaataaattaaatccttatcagtcattaatatttcaaccagaattctctgttcagattaccacctgttaccttgcaggatcctcagagggggctttccaagacaggtaaatgacccagaacaagatacctgcccaaggaagtgaggcaccaaatggattgcgggcattcagaggggcgctggtagactcttgaggataaggaagattccctcaaatacacttcacctatttttcaacatttgaccttctccatggataaattctggtactttattcactaagattttagttatctttaactattttagctgcctttgaccgaagtcatacccttctgatggtagtgggcctgctgcctgttctgtgtgtggtgtttgctgcaataggtgatttcagcttcaggattttccacagttactgtggaaaattttcagaggtaaaatcagtttgtgatgaggtatggtgagaatttaagcttttaaaaattgttgtgatcaaaaataattccctctcaattatccatgattggctaatctaccttgccaattactcattgcaaccagggccttcatctttgtagctccccagaaaggggtcaagccacaggcaataaatgagatgggaagggatcaggatgcagctcacagaggggtaagtgtatgggtgtgggtacaggtctttgtgtaggtgaacacctttgcacaattaagattagtaaagccattaatgtccaaagtcagtcagaacctgttaaacattctcaaatatcctagtacctcactgcagtttccaaagctccttgttcattaaacagtgtttcttgaattgggccacttgctttagaatcaccagagatgcttgttaaatattaattcctgggtcataccctagatgtattgaatcagaaactatcaagataagcattttaccaaggtctatgggcgatactaacgcatactcagtttaggaatcacaggtttaaaaagccccagtactacagagatatacagattcagattgaatatttattgaatacccactgagcaccaggtattatgccaggcactttcacatatgttacttctctatgtaactgaggtgctattggcctatgcaagcattagagagtttggctttcaggctggaaatctaagacttggaagaactaagagactagcctcaagtcacagtctctgagggaaataaaacagaatgctctttgagatggtaagtagagacaaaggaattattttcattttgacaatgcttcttcctttctttgcttattagctaatgattcgtcctcagacatgctctgaactagacgtcatggcaaatgccaactcacttattaaaaataaatgtattgcaatcagttcatatagcaatcactgtgccttcctccccatccttgctatcaacaaatttaaaaccagagctaaaataataacagctaccatttattaaagccgtaccacatggaaggcactgtgctaagcattttacatgccttatctcatggaatcatcacaatattgccacaagcgaggaactctcatccccattttctaaaagaggaatgataggtggttcaaaatgcataagcaactagctcaaggtcccacaactagctaagtagtggagccaggattcgacctgagatcttcctgtctctagaggctgaatcaatttcaacttgggttgaaatttcaaatgcatataggggctacgcagaccacataaaagtggtaggtaattggaccaggtgtgttataatagggagtggtggggcctatgacaatccagagagtccatgcttctgcctgaagacattcaaattcaattttcttaaaccactatgggacaaacaaaatgcctgcaacaggacctagaaggactgggagtggaaagtacacatttctgacctctgcactatactatatacctccttttagcagctaggttactggttgagggaagctctattaactggtagttataactactgagaacagcagagagaaaagctcttctcagtaaaaactctattttgactttcttcttatagtgtgccatcaaagtatctcaatatggtagaattttttctcctttgtggaaatacttgtggtgccatgtacatacactctatatctagtagcttttcatgactgagtgccagcttgactctaactaaccttcccccaggcaatgcggaggccctcagcaaggtcagaatgctggcacaaggtcattaataagcgcccagcagatcagaagaggtacatcaccattggtggggggaggctgtgctctgggacaacttcttaggttctagaacatgcaaaccccaggcccacaactgggaggccactgggtcaagtaaggctatgtcaacagccacccagggtaggaacttcccatatactctgagaaagaggctcaccaactttagaccagggtctaaaatagagatgtaatagttgtctggagttgtaaactaacctaacccaatctggtcattgacaatcattacgtactttttgttggatattaatagcctgccatagttaaagtgaggctatagatcttctccccattaacatcactaccagctataacagcaagactcagacaatattctacttcccattaaaataatagcaaatagacataaaataatttgatatccaattctgtagacccagacaaattcagctccctttgcttctaggtgctacaacaacaccttgcatgaaggtttacttgaggcacacaagacaacattctagtagcaggattcagctaaccaaaaatccccatcagtggctgtccacaggacaatttacaaattgaacctacagtaccattttttctaagggataatattatagagcttactagatgcttatgttttctttatgctaatttgggaactcctctaccatatttctagccaatccacatatgttgtacactattaatttcaccaatgagaagtttaatgttaattaacaaagcctctggtgctcattggagataaactcctgaggtgattgttacaatcacttcttgattagaattctttaaatgctaaattactattcctggtctatgtatttccaaatgagggtaactgaccacctctacagtatagattaagactaactgacccatatatacaccacacaatttatgttgaagtcttatgaaataaactataagtaacagaacatttgagatatcatgtttcttatggccttggaaaacagtaaaagttgtaagagcaataggagggtggtggaatgaacaatgggacagaaattaggagatctgggttccagtctcagctctgatatccactgcctggatgaccttggataaatcacacctatctctggctctagtttttatcatgtgtaaactagggaggttcttctggatgatgtttgtgacttctatctttgacattctatccactgggcatggcagctcaggcctgtaatcccagcactttgggagaccaaggccggagatcacctgaggtcaggagttcgagatcagcctggccaacatggtgaaaccccgtgtctactaaaaatacaaaaattagccaggtgtggtggtgtgtgcctgtagtcccagctactcaggagtctgaggcaggagaatcgcttgaacccaggagacggaggttgcagtgagctgagatcgtgtcactgcactccagactgggacagagtgagactccatctcaaaaaaacacaaacaaaaacagcaacaacaacaaagacattctgtcattaactcttgtccaattcttaccatctcatttcatttcttactgagaaaaggccatccaaaatgaagctcctcaaattctatatctagaaattcctcttcatattcatctactctctgcctttatgagagcctgtgataaaaatattgaatccttgaaatcaatggttagtgtttcagccagttgtggcttatccttgcacatcccaactcttccacttactagctgtgagaccttgggcaagttacttaacttcattgtgccgcagattccccagttataaagtggtgatagtaatagttcttacctcataggattgttgagagttttaaataaaataattcacaaatgcatgtaaacacttagagcagtgccagggccatcagtgagctttcttcgtgggccctggagtcaagagcccgagagaggccctccatactgttcattctcctctggagcaggcactgccctggcacacaaatggcacatacctatttctttgttcttttctacttcctagtgaccacttagcagttgataatccttttagtcacttgccattcatatgatgaaagctcaacagagatgcacctctggaacatctctgagtctaggcaattcttccactaatatattacagtctcttacagcattcagtatactttgtgcaagagctactaaatgcattctaatcttggctctcttactagccatatgaccgtgagcaaattacagaacctctgtgagcctcagttccatcatctgttcaatgagaataaatataatagtaactatcttataaagttgttgtgaagattgggatcatccacgtaaaatattgaccataatgtctaacatatgtgttcaatatattaacacagagtagcgaagtggttggtaaggaatagaattagtcagaaccaaactgtggaagatattcttaactatccccaaagcccttcaaactaacctgtatgccctgtgaatttgtagctgaaaagaagctggatgagatcacctttgaatacccacaatgctgccttgggcataagaggtttgcttggggacaaaaaaaaagtggggaaagaaagaatttgcttgatacctcaaaaaagccagggcacacataccactaagcctaatcatgccaccattaagtggaattgtccagaaggacatgatcccttctgatattttttttctctaaactggacatgatttgggtaaagcagcatggatagtaatatgataaccttagcacttgctggctcaaaggaaagaataatctttcttcaaatgtgacctctattttaatgtgtttaaagtgggagcatggaagagtggatcccagatcctggatcctgatcctgcactcagactaggaaaaatgtagttccaactgggctctcccagccatgagttttctgagttttttaattaaggctgatgcgtgagtggaagttaagaacgtattcgtttgagtggatggatttttttcttttgatgttgcttgcctaagtcagattgaaaatagcaaaggaaggagatatggaaaagattaaaagagaaattttgctaatgtgattttccagcattttagtctctctctattctctccagaacaaaggttaactagctgattccataagcatagattcatgagaaaggatcctgctaaggaccaccagactttttagtcttttaaatttttttttttttttttttttgctcccctctcttcttctgtattctgtatctaacagcatggtgtatccagcaggccgaaacctgggttatgaccaaaggcaatttttagccacttcctatcccagtgtacccataatccatgagtatcatctcctcttctcatttcctattcaagcctattcctatattttcatgtggaatcactgatctttttttcagatgaagaaactgaagaggaggaacagagatgctcagtgactagcccaaggtcacacagctaattgataactgagctgaggttgtaatgcaggttttccaacttttggcacttctctaagatgtcttcccaacataatccttattctcttggctttcactgctgcacaatgacatacataaaaatgacaacactgtcagttttaagtaggtggcagagaggaagaataaatccacagcaagttaattagaaatacagtaaaacatgagtttcaggcgccacaattaatcgtatctaccatttagtgcctccaatgttaacctgtcatagtttaccaccctctgatctatagtcaaaaatgagcaaaacaaagtcttgaagtcctattacagatcatagaccgttggagctggatcaagtagttttaatctaattacctcattttgtggatgaggaaaataagaacaagaaaggaaaagagatttgccaaaggtgatgcagctccctagtagcagaagtaagttgagcatctagactaacagattatcagagcggggtcttttccaccatgttttgcagccttatcagcagaaaactgtactaaagtaacaccacagatttattactttactaccttctgttatctctttttctctaattgtctaataagagaatcgtctaattctcttattctctagtaagtcatattacccctacctgatttttttaatgtggaaaacacttgtattattatagaatttaaaatgtaaaattaatttctgctcattgtcaacaaacaaaaaacttcaaaaatatagagaagaaaaattacccaggtaaattaaaaatcacccaaaattaagttttaacatgtgttcagatttgtatcctgcctttttactttatattatattggaagcatttgtccagactctttaaatgttctttaaaattttgatttttaatatttgtgttactgtatcacagttattttatgacacatatgtacatataaaaccattaccttatgtacatatatttatatattttatatatatacatataagtcattatatatgagcccatatatatacatatacacacacacacatacatacacacacacacacacacacacacacacacacacgcaaccattatacaactttatgcattgaggtggattcccaattcactaaggcttactattatacctcaacttcctctaatgcctacattctatcacagatctgaacacacagtaaatatgtaataaatacttgctgacttttagtttttctggtcttttttgggatgatcattattcctccaccgggtagggcaaccaaattgagaacatgactttccatcctctttaaagcacatgttatataactcaacaggcagtatagcaatggtggttatgatcagaagccagactctctgagttcaaatcctggatctatctctttcttgttgtatagccttgggtgaggagcttaacccctctaaatctcagtttttctttctgacaaatgggggaaatattagtatccactgtggtaaaaattgaaagataaaatatgtggaaagtgaatactcaacaaagattagttgccattattattacatttgccaaagggaaatagagtacagatttggagtcaaaaaacttgagttcttgttccatctctgctattatctagccctatgtccttgcatgagttattttagtagtccatgtctcagtttcttcatctacaaaatggagatagcaatacttgagctgtatagcttatagggatgttatgaagattaaatgagagaataaatgtgaaagtcctttgaaaactatgaagttaagtataattgctaagtatataaaggtagatgtaacatgattgtcgtatggtaggactggagatgcagagggtgcaggagactaggctgaatacagtgagcctgggaagatatttttaaaataaaattccttgtattggaaatatagactgttatagacagaagggaccttagagatcatctagtccgtcatcttaatgttatatttaagaaaaaagattcaaagaggagagagctcaaagtcacaaagccagtcacagaaatgaaactagaattcatgtctcttgatttcccaaacacattcctaaagcaatcactgcagatccttgtttgttgaccttcatcaaaaaaaaaaaagtagtaaagaaaaaaatacagttatttgtggcatccatgttggtagtaactgattatttggggttttatcacaaggataagccacatataacatagctttattatatttttaccaactttattccaggtgagaaaagtaaaggcgcaggaaagtgatgggtcgggggaggattcagtcagggcgaatgacctcagacttggccagattcccaagggattgctgtcatccccggcaatgaccactgtagcacatggtctttctttgattgttaatatttactttgcagtcagtccttagttatgtgtttttggaaaactcggtatagtagatgaaattatcagttgcttaaaaatacaattgccaattgtttgattcatgtaaattgattacagtcagaggactattcattttatgctggcatgcatacagcccacgtcaggcaagggctgcatcactgatggcagctcagatatcgtcgcatttcctgaattatatcccgtcaggtactcagtaaatatatgtgttggatactttcatctttacatttttttagctgagatgagagcacataaacatttccatctgacaaccttttcaacttcaacagcacagaaggttattttcaaaagaaacaagaaaggagtttttcaatagcgagctccaaaggtgactaaaaatgccttccaacaaggcagaccattaagaaatgtagtgtgaagtgtgttaatacaataaactcaaatgtggtctcactagtcttagctcctcagaatgttggctgccttccccagctgccactgtggcctggacagtgtacatcaaggttcaccctctttcctcaatcttgaagtgccccctttccacccttccgctgaaggagacctatggccagaagcagcttcccctcaccttgtcacccccacaggtcctgctgaaagggactacctgccttggccaggaagcatcagggaaaacaattggacagctctgccgtgctgcaaagatcatgggctgctgcacctaaaatgttcaccaggtggggcccgccaaaactgggcctattgtatctggggtaagtgcccatagtttgaaatcagcaaggtggaaggaaaggggaaagaatcttgttcaccaattcctgttatgccgcaaagaagatctccccactctggaagcttgaaaggaacaaattccaggcaagtcaaagtcaagcctactttacacagtgggaagtaaacatatggaaccccttagcccagagttggtgccagctgaaaatataaatactgtcagataaggttcaatacatttatgactgttaaggcaatgataggttattaaaggaaacgaggctgtttggggacatgttaaatctctgagctcaaaattagtgaggacaagcggatcctctgacagcctcagtgaatgagtcctgaagatatacatggtctcagaactgtgattgtgttctccaattaagctaggaaaaaataaagatgtggtatttagggctgcttggctcaaactgagatgctaaaatctctggtttgctcagagttaaattcttcaatacatgtaagggaagcaatgcgttatggaagaaaaaaaccctagtatcctccctttgcactgctgctactaactagctatgagactgccccctctttaggcctcaccttttcccatttgtaaaataagggaattagagtaggtgatttccaaggtcctttctagcttcaactaggtttaattcaaatgatatcacgaggttcccttgaagggtttggagcgggggagatcctgcatctttccttgccctcccttgctcaggagctcagagtcttcaagatgtttgaaagatgcccctgattctaccaagacttgactccttcaagtctggcctccacagcagacgtccatgctctgaaatttatatctcatggcctattcccccactcatcaagctcccaattgcctggtaaagaggtagaactggttagatacaggggtttgttttgttcagtgcgatagcaaggttggagaaagtttgggctccaatattagagacagcattgtatgggctttaaagctagagctagcccgggttagaattctggttctgccatttctgtgctcatctatagaacttatctcatctatagaattacagtgataatactgtcatccctctagggtgattgtcaggattaaatgacagaattcatatcaaatccttagcataatgcctgccataaagtaaatgctgccactagtgggcgtcttttcctgttctccactaaatagacgttgagttaaaaattaaaaccaataaatcaataaatattgagctaataatcaaggctcaacttttaagttgtggcaaattatttggagtctcagggcccccatgttttgataactataatggcgtatttgcaatttatcaggggcattctggaaactgcacaagccaatgagagaactaattctggtgggtggcatttaattttgcagtaaccccgcagatcacactacttagatgagtgctactttgaccacctcatggaaccagtgcagcctgtgggcatcctgcagggaggctgacagaaagggaagttccaaaaggtgaccccatgatgtggctcatccattcatagtgctgaacaatattttacctttcctgttcaaggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaatcctgtgttcagttgtgtgggtgtatttttgggagttgaggggaaaatggaaatagatatgataaagaattaacttttcttaatgcacttccagttgattattattatgaatgtcagctttgacctggaaatcccatagctcatcttacacaggttgcctaaagataatttctcttcttaggcttttctgagtaagaagccctcagtctttggtggaaaaacctcagtaattaattggaaacatgcatgaacataaaatggcttaagagtttagtggatcaggtaaggaagtcaagagatggagatgatccctaaaggtgtgtaccaggtccagtgtaagggagggtgagagagatggtgacttgcagtggttggcggcactttactgggagcatcgggtagaaaatctaatacataataaggtaggtcaggctgatagcattactatatccactttacagtttaaagaaacaggctcgaaggagttaaagtgtttttcccagtaagtggctggggtgagactcaaaccttagtctaatcttatgctccttccatgcaatatgccgtctccattcaactagcattataagggaatgagtggttctaagctaattttccagatatttgaagcacatgtctttcagcagtgcaagtgctatttttattttaatcatttttgaagaaaaaactttctacaatgcatcaaacacctccacaccttattatgcagaagatacagattactgtgcttttaattttctgtctatttccatagccttctatctcttttcccactgtagctgacaatgttcagtacttcctaggctactgaagatagacagcatattagaaatgaagcactcctaaaagtagatatactaaaatgtgacagctgacaataagtgaacaccatgcagaatcaccaactacaaaagcacaacagtctgggattaattcaggtaggggcaaatagacctaagaggccaagtaaccgcatggacaacgaactcagtaccggagctggagttgccagtaaagaccctgaatcatccatagaaaattgaattctgttcattcttctgcactggtatactgtggggaaggggtgatatatgaggtccatcccagctgggaggagtattttttcactgatatttagaaatgcctgtgcatatgataataaaaaagcaagtagacagtttattactgtctttaaattctctacacactaccctcttattgtttgcaccccagacagaccactcctactgctcctgcgttggtatgccagtgctttactgtgtttaaaaagatggtcgtgggggagggtttccactttagaaagatatccactatctcaaatggctcaagatttggtatgtctaaaggggtaaatgtttactgatctggaaaacataactcatgtaagaagcatggcaaattattgtgtgtttagcctgtcacttctctttccttgttccacctgtaatttcaaaggaaaaaaaataacactacaagcaaatcctccatagaatgccatcctattggcctgctgcaagtacttggatcttttcaaattccaatcagaatgggccgtgctttgccttctccatctctgtctcctctgacccggcaaagtttcccatcttttatcctgtcacttagctaatggtgtgtgtccctcttgcatatattccatagtcaccggcttctttcgctagtagagtcgtcagcgagatgctcggcagatggctcactggctgccgttcttgtcccctcactgcagcaatctgctgttctaaatcaaaatgttaatgaaaaataaaagaacgcagtgccaatgtctgtctgatttaaattaatacagagtcatacctttggaggcaggttttactggcacgaggttctccatacaggctacccatattgtgtgtggcttttttttcctctctaattaaaattaagcactttcatttatctgagtctctcttggtacccccaacctgttctttttaataataacaaagacctaacaaacagtggattttagtgttccagggaatggcatctcacctggtggaacataattttgagagatattatatgtgatgtctaattataaacatactttgattggattctgttctcaatactgaaatgacacatttactaaatgcttcaagtgcagctctaagttaggcatgtagttattgaaatctctttcaatccatttgttttaaaactggtggcaaaatcactgctaatttgctactttatttacaagggcccttcactttctatgtactcagcacagtattcatttctgttgctgcaacaggactgctcccctctttggggaaaatgtatgtgtctgcaagattgactatgcaagacaaaattttaacttcaatttagagacgaagggaccacggtgatgttaacagacatggtggaggaaaatcacctcagtattataatttgcaaaaaaaaaaaaaaatctatgaaccaaaagaacagcagtttcaactgattgcagaagaccacacctttcattttttcttcctatgactcctttgtagatactgctaggaatagtattgagaataatgagttaacatagtgcttcttacataccaggcatccttctaagtgatttacatttatttattgttccagtcatcaaaattctgtgacttaggtctatttcacagataaggattctggggcacaaagaagttaagtcacttgcccagtcacataactggtaagtgacagagccagagaagaacacagcctggccccagagccttctcttttaaccactataccattctataatgtgctgaaagggccacgaaatccagcctacttgaaagtaagctactgtttcctttcagattcggcaaaggatattctctttgctgaaactgctgtgtaaaaatcaggtttctacttcagtggggcttggtccttgttaaatgcatgtactatttgcatgtgtcaccaccattaagattaaggtgagccaggtaaattaagctgaagcagcaggcaggcaagcaggagaaaagcctgggttttcaggtgggaactggggtgctagtcattaggtcagtcatctcagggccacctcacagttctgacaagagaaggccaaaagaggtaaggcctacaaagcccacatttgaaccagccaagtatatagggactccctcctggaacacaacaggtcaggtcacctggcttcaaactcagtacttattcctacctacaggcagggccaacacacaaaccaaacactattgaagatcagccttcctcctgctgctcagaagccagctcaactggaaaaacaaacaatagaagatgattatctctaattaaatatatgcatcccaggatacatttactggggtatcaagttattcaaaagaaaaagcctctagtcggaaggggctaagtagagaggcagtcatttcccttgctaaacctcattttggtggttgcatttttctggccttaccagggactaaatgaaaatatgagatttgaaaagaatattaccagacagcaggataggttacacagaaccctgggctgggagccagttgtcctgggttccagccccaactctgtttctaacaaaccatgccttctctgggtttcagttagatcttttgtaaaatgaaaagatcctgtgagggcctttctaacattaaataatttctgattttagccacctcccccaaccaccagtttttaatgaaagatgattctccctacagaaacaaggaaactcagaggataatttgaccaaatgaagcaaagatttgagctgttttggggtgtttccaaggaggcaactcaaaccattgaagtcagaaagtagatttctttttggcctgatctctcccagttgatatcactagataattgctcacccctctgagtcatcgaatcataggctgattgaatctctgggatataaaggaccttaaaggtcatcttttcccacctaccctcagagatggactccctttctccaaacacagctagtctaagtagtgggacatgtctgttttataaagcttgtgtatatacaggtgctgcttacctggatggatgtcacaggtcattggaccctttgactcctatttccaaatagctctcactcctgctcactgataccagagcatatttaacagagggactttcattctccactgaaaacatatgatataaattccctttgaagaggtggcactgtctaaattcataatgcaatgcatgcaactctatagcagatcctatcatgagagcagatttcaataggaaaggtgcccaaagacatggaattcttgaagagagtgaaacaggtttcagtgagaggtaaaaattatatagaatgggaagacagcaagggtggaggccctagagtgatagtctaatagaatgtgtaacaacctgaagtcagacttgggtttatagctcaactctgccacgtaactaaccatattagcttgtacaagtctcaacctccctgaatctaagtttcccaaactgtaacacagggataataatatctactacataaggctgttgataattaaatgagataattattcaaaggcataatgacagtatgcttgatttaagtacattttcagccccaaatctacaatgttgtcatagtctgatggcctttgatgtgtttgttcttggttatgcctctgcaacactcgtgaatatgaataatgttgatgaccatgtctgcagccaccagtacaaattttaactctcttactcttctatgcaactaactacacaactgattctagtaccagccaggatatcaattgtcaagcaactgaaatgcccacctaaactttgatcaagatttgcaagcacaaagagattagctccatgctcataatttcagaggagctcatattttcaaacctgtttcaatttagcccagttaataggacttcaaggtagtttccctaattaattagctccaaccaggagtaaatatgtatggtggctttttgaaaaatattcccaaggtatatttcaaccttattatgggagaaaaaggttaacaaatgggatggtaaggtttcagtacaaatttcaggttgtgtgggggaggtactgagtccatatgcctgtcaaaaataatgacagacagattacaggttgcctctgaacatactgttagatagccttgaagcccccgacttctacactattattagcttaaatgctgtcaagcttggagttgggttttaccgtgattttgtttgtttgtttgtttgttggttggttggtttttctctaggaggtgttgttggtttggagaggctcatcaactccatgatttattattttctatcagagaaacatgaaagtttggggtccagcattgtcttccttttcaaaaacatgctcaaagctccatattaaaaaaaaaaaaagtttcaacctgctcctttttttttttttttgccatcctccttttgcttcctaaatcccctaatctgagatttgtgtgagttgcctttatttcctatcccacattctgttcctaactcctacactctgtttctattctcactaatctaccaacatttctcttttgagttcaccagtgatcttcttgccaaatccaagagctgtttttcaattgtttatcttcctcaatctctttggtgtatttgacacactggttttatccactcaaagtatctcttgccttagcttctgctgacacttcactttcttgattctcctctgattttccatctaattccctttttgcctgtaacattaggcaaaaatgttctccttctcctttctgggcatgagtttcttcctcagtaaaataaagggtttagacagggtaatatccaatgtccctttcatataaaacattctatggctctgagggtcagtgagttatttgactttaacatgttatcatgtttttaatgttgaaggttttgtagctattccagtcgactttagtgttccagtaattgatataagtgtctgaacttcataaggctaggcctttgctgatttatacatgtttaatacatgcttgcttttcttctttatctaagactatgcatattcgaaatacctagatactacactgttcctttcttgaaaatagatgtaaggtacattctagaagaatatcctgttgcttattattaatactagtctttcaaaaatgtatttggatcagaaatccttcatcttgttccatttaatttggatatttagaaaatgaaacaacaatcttttcagccaagtgaaggcattatgaccaaccgtgagagccagaattcaccaatgtcatcaacaaagggtcaaaaataatatatttgacagcttaatactgaattcatatgttacacagaaataggtggtaatgctttagtgaacccttgtatatctctgagaaacataacatcacttaaagacactcaaaaaaatgtaaaacaacacaatttctattgatacttcttttccttcacccatattttaggtgctatacgtgatactgccaagagttgcctgagaccccagggcaaaagactggctataaataccttacaagtcatccccacaaatccaccaaataagaagtttcccttctcctaattaaaaggcagtaatgcaattactgatcccaagggtatacaataaatatatgtcagtaatgagaaggtcagaaaaagtaaattgttagtgtacaaaatagaaaatgcctgtccctgctaaggaagctagtcaagagtggggattagggtcctttagctgctcccaatgcaagacacataaaaaagtagctgaggttttgttttcttatttatcaccaaagaatatatgaatttgaaagaccttgcacacaggagctctcttgatccatggaacataaacatgtcagtgtcttaactagccatgatatactatcatcttcctctaacaacagaaattcagtgacttatgcaaagttgtaagagtcagtggctgagtcaacagtccccaaaaatctctgtcaaaaattcaaaacttgttaatttatacaaaatattacaatgactgccactctcgctctttcttcgtctccttctccctcttcctctgcatttctctctctctcatacacacacatactccaccctacctaagtgcttctcaaagtcaacatgatgggctaatttttattgtaccgtatagtatcgttattgagcatggactagagcattcaaattaatagacttggtattcaagttattagaaaccactaaatatgtcatataaggtttaccaatttttaagagttagaataaaataaaatttactcatgactaaaaatatattgtgtatgaagttatctttcattgatgattcagcactgctctggaaagacttcacacagttaagtaaaagacaccatctttggaatgacaggaccatgaaagtttgttctaggtaaagcaactgatcctaaggtctctgggaaaagaaacaacctagattatttctcaagtgagtaaacattgtcagaattgttatataaaatgctaaaaaaaaaatcttaccttgagattgcaaactcaaatattcttgacaccttgccttctattttcaaatcagaaatcccaactttctgcccttaaaagtaatattgtggtatctcattttgtagatcagaatgtttacttctctagaagtatcttcatcttttgggcttttaagatattaccctgagaggtcaaatttactatatggcattgtcacaacttcaggcttaaataggttcaacaaaatgccaatttatctatcgagagctctaggtgatattgtgtgaatgacaaagagtttgctgttgtgtgccaagagttatatttaggtttctggcacaaattaataattacttataacattttataaaaacaagaaatcatcttgacagcctttcatccaaagcaacatcagtcgttctattagtattggagtttttgcagtgacaaggagaaaatgatgggtaataatatcagaaataatagcaaatgctaggcatttgctaaatgcttttacatatattatgtcacttaaatcttcagcaaacctatgacataggtactattgttagctccaatttacaaacaaggtcgccaagacctagagaagtgagggtgtccacagcaggggtccccaacccctggtaccagttcatgacctgttaggaaccaggacacacagcaggtgagccatgagcttgcattactgcctgagctctgcctcctgtcagatcagtggtgccattagattcccataggaatgcaaaccctattgtgaactgtgcatgtgagggatctaggttgtgtgctccttatgagaatctaactaatgcctgatgatctgaggtggaatagttccatcctgaactcctccccaacccccgatggacagtccatggaaaaattatcttccatgaaaccggtctctggtgccaaaaaggttgagaactgctggtctacaggatcttttgctcagacaaaatgacctgggtgtagaattgcattggttgtttcatatgacagagcattaatgtttagtgagcatctaccatgtgccaggaactgggccaactgctttacataagttgccttatttaattctgccatcagccttatgaggttgttacttttaaacatattgtacagatgaagggaagaaggatacaaagaagttaagaaattttcccaaggtcatgctactagtgagggcggagctgggatgttaatctagataggtttgattctacagttcacactctttccactatgaagtaaaaatcaaaccagcaaaaggcaggaaataaatttagtttaagaataatttccatattgtttccttggagttaaaactttaatcatgaaagctaatcccagtgtcggtgccaagagtaacttcctgtacacagagcttttatcctatggaacacagggttacagcattccgatcacttttagcttttagagcagagaatgggaacaggttgaagcgattctccagaattcttttcaggccaaataaagggaaaaaatagacacaaaatgcaaaatcgtccaaacttatccatatgcagcagggcagctttctctaagacaatgagttaactcttccatcccattagatctccctctgagtacaagaagtcagtccctctagcctcagtggcctgaaagctttaatagcctacccaaacagaaacaccccatcagcatttctcattggaatcccttggaatcattgttaaaaattgcagttcccaagcccaagccttgaaagcaggacttaggaatctgcattttaataagtatcccagatcacttatatgcacagtaaagtgtgagaatcactacacaaagcaatgaaagtctcaagccttgtattctgaatttaggatgctcagacacagataagctgaatttattttcaaggaaggaaagtctcctttaatttaattaatattaacaacctacttaacataagcttttaaggttttcagaagcagtaaccggcaaacagatttaaggtctgttcacatcctttgtatctatccattatagcaggacataggatctgcaacacgaccatatgtagatctcagcaaccctctcttagcctttaaagttccctatataaagttcaatgttcatctaagaacattccataacccagactttaccctaaataagactgatcttacataaatttatccctaaataatgaaattgaactatatttcccttctcacagttgaaatcagtctaaagcagggaatagtagtctccataataaatagcaattagttgagtgtttactgtataccaggccctattacaaaacaaaatactccctggattaaaagggcccacaagatgattttgcctactgtaaactcctcttgaacattcataatgcacatgaacctattaaggactgcaagagggccttgaaggaaagaaatcaatttatttttcttaactcagttacaaaaacctatctgatagcataccccttttatgaagaaaacctgacatacactttgagaatgtgctgctacgcaacagtgtttctctaagtgtcagtggcatcaaaatgcaaagtcaggagccctacctcagacctaaagaaaccaactctgtgaggggcttcaggaatctgcattcttaggtacactgctctaaggtataccaggagaatcagcagttgccccaaagatgacagttgagggaaattgttatagctacactggcaaggctgactgaaaattaaacaaaaaattccaaaatggaaactaccaagtgactatatttcaacaattgatagttcgccaatctaaaaaacttgggctttttatagggggagattcttgcccatacataactgggatccaagaacaatgcacagaacaagtcccactaaattgtccagcaaattctgctgccgcctcaaggtataataggaaaacataggtgggtagatatgctctcccacttgctaagctgtaggactttagcaaaaccactttacctctctgacttagttttctcatctataaaatgagaacaattatctctacctcagggagccactgtgagaactaaatgaggcagcacacacaaatcttctattataaatatgaagttcacaaactgttcgttccttttccccttctctccttcccctcctcccctagtacagtacagcactatgatgtcagcatcattagcgtggagaagacaggaaatgttgctgtcagttttagtgtagttactctcttctgagggtagtttcctttaatgaacccctatgtcgcaatactgaagtagccattcaattctgctaagtaggagtcaacacccactggggtacacagagatgaaaaggcaagtcctgccctcaagttgctcatatcatagtagtgaaaatacctagtgtgtcagaaaatgggaactctttttctggggggcagagagatggacgcagctggtcacagaggcaagccaaactgatgcaaaatgcattatggctaagttaaatcagagaatccaaggacacccaatgtcatctttatctgtccagaaaagccaactgctgacctaacccagggctgcagttccagggctcggttccagcaaccagcacaaacccagtcacaggctgctttgtgctttgtgcccggtgctgtactacatatcagctaaagccagtaagctgagctgacctctgctctctaggaggaaaagcacagatgaaggcaaacctctaatgcacacgaaaataagtgaaaacttggtatcaaacaagcaaataaatacatttgctcatatcattctcttctcaggttcctgttgatttttctctaagatgaaaaagcttaggtgagactgaaataaatgaacctcaagtccccagcctcccctacctcagcaacttgtcaagagagttggagattttttccatcgttatttttcaaaaccaatttcctaactgttgcatgacaatcagcagtcaaactaattggaatgttactttaacatttcttcctccttttagcattttttgtgctgtgttgtggggaggaagggatgtgaggtttcagcgatgcttacatagaaccttacctttcctttcctttcttatcactgctcccaactgggtcttcagcttcttgggtcagtgggacaaactacaagcaactgctacagtgtccctttcaacttgcatctcttctcatatctagtggggttttggggattgacaaggttggcacttctcagagatggagggaagggagaggcagtggttgaggagcaggaccagaggatgaagtgcagacttggctagtaatttcttgtaccttccatttaaccctatgccaagcctccaccaccaccaccactgaggagaaggaatgtcataattaaagaaggctctacgaatagcacagatattgtttctaaacaggaaaaagagtggtaggggaaggaattctattaagcaaacattgttggtttttctccccctgattttcttcgagaaatgtgtgtagggagagactacaatgaagggtcataatctattaaatacacggactaaactaagtatgccatctcaaaggaaaacataagtagtgtttaaaggtctggtctagtctcagctggtcagcctagaatccactggacaactgcacttcattactaacatctaactcctcaaatagccttttagtactatgtgatgctgctaaagggcaaaaggtgctgacagggaccatggacatttctgcagtgcctgtccccccggtagtgttcagatcttgcaaagccaacaaaactgcagcataggtcagctgcaaactccccctcatcagagacctccctgagccagcaaagtcaaggctgtgagctcagggccttcagaaggtcactggagaggacagtgagtctgcaggatgagtcaggagaattgagaaagcccagccagtccccagagccaggcctctcgtaaggcagccaaggaaaaagctctgtaagaacctggaacaccctgataatggagaagagggtggaggaaagaagcaacagacagacaaactccctgtcctcagcatcagcaaaagaaggaagtagaccagctttatccttgacaagtccttatcccactttcaataccctctccaaattacctgagacacccacagaaatgccagccgaccaggcatttcctaccacccgcaggttacccctttccccaacaaactcacctttctcagagcttccccagtatttcatgtcttgtttcctcagcatttctctgccttgtcattttatcataactgatctgggccaatacaccaattcctgagttactgtggtccccagcagggtcacatattggcaagtaaacagttgcctcttagcaacagagtacttgtaccccaaagggtatgtgtggtgaaaggatttccaatgaaggggggacctcaggcagataaatcctgggggaccccacattcaatttcatgtgtactgttacctctctctctccttgttaaagtgtaagccagctcaacagatatctggccaaaagcctaaaaacaaattaggtcccagagtaccaagataccatcttttgtgggccccaagataaaagagcttcatctgaattatttccgacagattgcaaactgctcatttgtgatataatcgtttgggggaggggaagaaaaaacaggagttaagaaaactgtagaggaagaaaacttttaaagcaacacatagtatgacaaaaattgtgtgcttaaaagtttttgaaaccttacattgttccaaagatgctaaataagaaagtgtataacctgaaaggcctacccatggcatcagcttgtatgcctggcacctgggagaaagttgggaggtgggactttggtggaaggaagaaggtaatgattggcagttgaggctttttctgagatgactgaggataagacaagcagctggtattcaggttatccagcttattagaggctgtagacaccatttgacttgcgatgggtctgacttcctaacatactgttctgagttgcagctgtgttttcagaataaaaacatctagtcgagttttgagttctaaactatctaagaaagcatctaatgatgctgatttttttgttttgttttgttttttgttttttgtttttttgacacggagtctcgctctgtcgcccaggctggagtgcagtggcgcgatctcggctcactgcaagctccgcctcccaggttcacgccattctcctgcctcagcctcccgagtaaatgatgctgatttttaatggatattactgtctctttaatgagacttctctggagaaagaatactgtgacctcaaattacttgtgcaagtggacttagcaggcctggcaaatggaccaagcttgtctttgggttccttctccttcctacttcatagctctgtctctctacacccctatcattgggacccatttttttcctggtaatttagggctccccgtgactccatgctttctcccatcacaagaatctttcctatgagggctcagttgtctgctttccaaagtgacagctgggggctaatgagctaaagtggtagtggctgacagtgagttaaattcttgacccttcaaattagagcagtttgattggcaaggaatgcctttctaatgatagcattttaagcttgtactaggctggaggagatggcacttgtgtgtaacggggtgctgcttgacacacctccagtcacacagtggaaatggctgcctactttaccctgaacatagcacagaggaggtgccttggctgtttagaggatggaagcaaccagctaacaaaaaaaaattgcttaatttacaaataacctattagcattgtcaagaatccactcacaggcaggtgtccatccctaagaaggctgtgtattttacctatgattcttgctttgtcttttgcacttctacctttcttaactgagtctgaggcaaagtgaagttgccaaactgttagtgcatttttcctgggtcatctataaacttgccttccttactaatgttttagaatgagtctacctctaatccccactttcttttaaggttcaagaagtagacctcactttactcaacagctgcattactgaaaatatgtgtatatgggaagggcaataccaataaacacacctcattgaatcgatctataatgtaaagaattccattattcagtaaacaagcataaggctgacctttggccaaattgaccagtaatacacagctgtggtcaaaatattatatgctcccataccagttggtaaatagctactacaccttgtcctggatgccagactgtactctgagatccctagacctccacaagatccagcagctaatacagtaatgcctgacacagcaaagggcctccgggtccttgctccagggctacagctggaacctagactgatttgttgtttcctgtgctttcctatgtgaatattatccacaatttcaaagctactgagtagcaggcactaggtgtggccatgaatgtggaccataattactttgcttaaaactgtaatagtgacactgaggtttgtgtcagttcactctgccccatgcattcccatggagcagaacgtccacgaccttcaaaagatggacgacatgagccctgtttccaaaatagcacttggcaggcagcctagatttggatgtgaacagcagacacaggctatgggcatgatgggccagccccctgtcacatcacctcaggggatcctcagcctcatgggactcactagaaaatcctttacatctgaaaagcagaaattatctagtccacctgagtgccctgggagtgggtctgtattcttagcctcatgcttccagtgctgagtttagaacaaaagcctctattcaaggtcatatggtgagtcagctactgaacagggagtgaaaagaaagggggaacaaacaacccacaacaggattagcttgagctgcctcaacctatgagaaaggcctggtcaaaccatttatagtcttcatatatagatagcttgaagaattgcctctgaagggtgttaatgaacataggtaaggaagaatggtgatagttaatcagcagtcctggagacacaaatttgtggtcgccttgtgatacaggtaaattatacaatgagtttctgtttgctgtccttatgtgtatcttaagaaataactccttcattctacctcaggtaaaagctcactctttctcccaatgcaccttggctactgtcaaccttgcactaatataaatggattcctccttgtgctaaagggaagcagaaagagccccatgtctgaatttggaaggtctgaattctactcttgactctgctaactctcttggtaacattcagggagacacattctgttgtttcattttcctctttttatcaaatagggatgacactacttcctacttcatgggctggcataggaagaaaacagtattatacataagactattcgaacattccagtaccctccaaatacatgaggaaatatgactgtctcagagatgctcaatgagtacatggaaaccagcacttatagcacttatcaagcacctactatgtgcctggcacttacacactcatagttttgttgatcctgacaacaattctatggagtagatattagttgtggcatgttaaatgatatgggataaaaatgacaataaaatatgtcagtgcattcaaattttaactttatttttgaagtaagtaaatttgatcccccttaaataacaagcttgcacacacacactaaaatggaatccaaactacaaatgacacaacagatcagtttagcatcaacttgcatttctaagataaaattgaaagtaaacgtgtgaatcattccataatttatatcacagaagcaaaatatggtttgtgaaagcttggaaaacatgtagggtaaggattattaccctggaaggaatgcataggtgtttaaaaggtagacaataagtctaaacaactcctcacgttaaaatgacatagtacaaggaggtagaaatacagcttatattgggcttaaggtagcagcactgtggggcctcccagaggggcacacagaatgccttaagaaaggtactgggtggaaacccaggtggagatataaaatgaggcaacaaagaaaggaaggctgatttatataaattttcaaatgcaagcatgtgtgagactatccaggatattgcagacctgtagtttcctccctgaccaatgacaggctacagccgaagctgaactctgttccttacaaccttggccaaaggagggatgagatgcttgaggggaggggatagagagagggtggctgttaacacttttatcctcatcttacacaaagaaaatggggcccagaaagttgtttcttcaggcatgcagctcataacaagggacactgggagtcaaacaaaagtatatatgaccttcctatacatactttgtgtaaacaaagtatatatgacctttttatactataaaaatccatgttttttccaagaaaatgcaccacttccccaaatcacattctctttctcccaaaaatggtgccaaacccttgggtgatagtgaaacattgctccaagccctttctaacttaagcgcccctcacaatgaccacaccactagtcataaatgatgaacatctgtaagcattcctacaaatgctaaatatcaccatttcattggtcaataaggggagactatgtgaccaagaagcagagcagttctctattaacaaagctaacctaccttcccaggagatcaaactcatccatggctttatcttgtctctcttctttcctcagcctcccaggcacagagatccctgaaggccaagactctctctaaaacattccatccaaatagcccccatagcatccagcacagtacttaacacatagcagacactcaaaatattttatgaatcaatgaactctgtttctcccaccatgtgtataacagtatgtccttaatgtcttcatgttattagaatccttgtgaaatttaatcagagattataatgcaaaaaatataagaaattgagatgaaggtaatagttggcttctgagaaactctcctctttctcaatcactaacctagtaacattcgttctagtctcatatctaataccaccaaccagaggaactagaagaaaacatctcagcttcaccatttttaaaattaatcgtatttagctagagcagaagttctcctccctaagttttcatgagaattacctgggaaagctttaacaaaaactgatgctagattctgttcccagggtttctggtttagttgatactgggtgagacctgagcatcagtgttttttaaaaactccccagtgaatctgaaatgttgctagggttgaaaaccactgggctagatgatccttgaggtcccttcttactctgaaaatcaatatgctgactatagctgggtgtctgttgatgtcatgggttgttctgactgttctccactttcctctctaatactgcacaccacgagatctatatcaagttgctcaacagcctaacatcttgtttccctccatttacctattgacttaaaactttgtgtactcttggggctcctaagcacaactattgagatctacttttaatgctatgtgggtcattttgccaccaaagaagctcccctggcaccacgatgtgtccccaaagcactatctggcctgccctgcttccaggcgggaaagcccaacaagcaagcatgaacagctggagtgttcccactgatctggaaggaatccgtaaggacaatgcactactttctatttcactggactctttcatggcactgagcctgcctattccattcggccctttgtcaagaatgtccttgacacttaaggaattgatttcttcttcctttcctttaaataataagccaacagatacgcaggagttttataaggtatcaatttaacatacaaactgcattatggcctttgaatgctacagcaagaaccaatgcctcatcagccagaaagaccaatatagtgacaacctaacgttttcttaacctgtcaaaacattcctgtgctctgggcttactgagagcagacatgccaaggatttagaaatgtcaaattaaaatagtctgggctattttcaaaaagacatgagcctttttaaccactagcattctatcagcaatgctttttcagaatgtagggctgctagaaggccctctttctgaagaacggtgtgaacattacacagggaacagagagtttctcaaggtcatatgatggttttctagaagcacttcaacacaaatgtttgcctcatctgtggttagatgagaagggctggaaatgtggggcaggataagggtggaagggagcacagggcaggagtctaaatgaaaaattcccatactacaaagatcctaaaatacaaatttgaaaaaatagaatctggcatggccttttagtgatacacagctaaggtgctcttcaaggatgggaaagtgcagaggtgctttgttgtagacccttggtcaaattgccaaaagtacatgaggtcattattcttttcattgccaaatgtgtgggaagagtaatcatctcaccttgcccatttgttcttcagatttacctcccatattcaccactctgctgcaactgctctcattcagacaccagtgatctcctaacagccaagtcctgtggttagttttcagttctcattctgactggcacatctataactatttgatactgttgaccatcctttccttctctgacttctgtgatggggtctctctctagattctcctcctatttctgtacttttattttcagttgctttcttaagctagtcttcccatatccagctcttaaatgatggagatttttcttagcccttttctcacttttgcaaaagcttccatgctatgacttacatgattctaagtctttatctcttgtcccaaaatccttccaaactctaagctcatatagtcaacgctctttttggacatcttcaacccaacagacacttatccccattcccagtctgctccttctcttctattatttcagtcgctacaataactttctaactggtctcccaactggcattctttttctcatctctaacctattctcctcgtttttttccagagttttctcttgaaaacatagatatatatctgacatttccactctgtttaaaaacttttatcggggcttttttctacttataaaataaatctactcattatcccataacattcaaggtatctaacaagccagtcctgttttacctttctagttttacttctgatatctcccctgtcatccctactacttcccaacacctcaatcccacctatcttacatatttaaattatctaaattatttaaagcagttaaatatttaaattttaaatcatttaaatatttaaatgtaaatccttaaacatgccgggctagctcatggctcaatgctttctttcacactatttcttgtagctggaagaattcccccttcccatatccaaatcatagttttaaaatgtcaccttgaccaactaaaatgtcacctcctgtgtaaaatctccaggcagaattaatcgtggtttcctctgaactttctgcaaaccataactgtagcacttatgaacattgttttacaattaggtgcgtgaaacctctttaaagatggggattctgccacagacttcatgtttaatatgtctggttctggaatcagagacttggattttagtaccagctctggcacttactaggtatgtaatttggggcaagtcaaccggtgtctctaagcttcaatgttctcatctgcaaaacaataacaatagtgttgcaagtaaatgagataatgcatacaaaacacctatagtgcctgacacataataaacactcaacaaatgttagctatgactatttttctgtgcctggcatatggtcttgcacggagcgagtacccaataaatgattactgaataaattaatcatagcatggaagacctaagaacatttgctaaatggacagtttcttcctttattgaatcttggaattcctgtcagaggcataaaaaatgggttacataatgaatttatttctctgtagtcaagtaataattacagtagcaattgggataaccaaaagctttgtctgtgcagtttatcttttgaacctgaacctattacatctttagtcccaggaactacatgttttgaagtgtacatttcaaacttcctttccaagataaatccaaagactttttttctactctaacatttcacaaataggatgaatcaattaatgtgataattatttaatacaccaagcaataacttttaaggtgtaatggtaattgagcccagcatgcttgaaaataccattctctgagtcaggttcagcaacatgtcttgaagttgggaccttagaggcttaattcattctaaaccccctctaccaatataaaatttaaattaatggtatttctgactcttggtccctttcacctataattcttcttaatctcttgacctctatttcattcatgaaatcccaaaagattatctttcacagtgaacccacagtaatctgtttaatatcccttgataagaaatatccctttaaaaagccaaattctgccatgctttaaatagaaaccctatttgctgagacaagacaaacacttatagtctttttcctttacttggtcctagaaaaggcccaaaataaaacatacatgtcaagtccattgtaaatggatgtggaaaccagacatttgaagtgttatcatcaccatcattagcatcatcatcaccatcatcttcatcatcattatcataaaaaacaacataacaacagttcaagaagtttggaaaatgaggatatgggtttatctaaaactccactacccacataaaactagaattatttttgtatatttttccattctttctcattggcctacattttttcaaagcttgctcccaagtattcccaggtataccaaggagattttaagaacttcagaaaaactgtgattctaaatgtataactgcctagaaagtttcccattgcttcagtttttcagagaaagacactctgagagtacagatggtataatggcccaagtctacaaaaagtttcatttctgtgcatacataccacccattctacgataaggtgttggggatcagctgatgagctgaccaaacatgcccataataatcctggacaaaggctgagaccagcactttttacttcaatttggactctgaaagaaaaattatatgaggaaaggtgaggattccctaatgataataacctcaatcttcatgatattaaaacataataattaaaaggcagagagagactttaaaaaccccattgagatttcaaaagaacaatacaatatgcaaatagtcattcttgtatgcagttcatcattgattatccatgagaacagaaaggagctgaagctttggggcatgttcagtaatatttatctgcaacttctagcttcctgtccctctccctgaccccctccaatacacacacacacttagaataatatttattttagattatgttttgtatgttcacgaaaatctaatatgaccactaataaaagctgaggtttatggccttgttacctttgtctctcaaatttatattccttcattatcttctgcacctcttgaaaaccacacagattcctcctcctctttttcccttttcccacttatctaggctaaatgatttaatactgcattttataatattttatgttgttcttgaatcatttaatgtcacttaaggttacttccttaactggatcatgagttctttgacaatttatgcatggtacctttttttctatctgctgtgatccttgtgacatagactatgagttacttgaggccttattttcctttgtctcctcagcacttattacagtacctaacagtggagctattcaataaagcaaatatttaataaaggaataaatgaatggacgaatgaatggatggatggataaaaagacagcatccaagaaatgttacctagctgatgagtggacttcagagcacttgccagcaagaagggtggccagcaagtgttgataagtcagtcagcaattacttattgagcacctactatctgccagacacagatattctgtgggggaaggggaggggaacaagagaaagcaggcctagaattgaaaatcagatgtgtacaagtcacaaagtggaacacaattgcccaattgtctgactttttgtcattattttctgagtgtagcatgggtgaatatttttctctaccatgaggcaaactaatttgggaggcagagtattaccatcttttctactattctcttgtcttaggttgagttgaatagttcaagtattgagatgtgtagtttcttctgtagtatcttccctgctctgtcaccatccttttcagacaatagaacatgagttggagagacattctgagttctagtgaagtcactgaagccaacttgccaatgagtaagaggtaaagacctagggtgtgaggaaggacttgcattcaaggctgtctgaactttccctgttaagccttcgcttccattttggagactggagcctttcagctcctcctgtccttctggcaactcttaggaaaaaatgcttaaataacaataacagagcagcagaaaggaagaatggaaattatcgtaatagcatggacttgttgcgccaacattgttagcctctcagcagccaactccatggagctgccctatgcttgtcaatgaaaggataaaaaggatatgaaggagacattttatggggccatttcagctgttcactgtaaatacaccctccatcaaatatagtgagctgggacctagagatcacagacagctgggttgcttgaaaagagaaaagacattatagtaaattgtattattatacatttactgagttccagggtttctgggagggcctcaaagatccaagggagcatttccaaccagtggcttgaagcactgccaggctgggggtaagctcaaggccaactaatgggtccaatgacatgagactataactctggtggttgcgaatttggttaggggctagtatggacatttttttagggtagaagcacttagcaggtgagccaaaaatgaatattttttatagaaagattcaataacaccattgagtgtactgcctggcctcagtgatgccttctggtattaaggatccattcaaaagcagatgtctaaatctgaggttttatgacaatgcctcaccatatccaaaatcattcactctcatccctcacccctcagtaactaggcaaggacacataaaacatatccagtccaaaggcacaaatcaggcagttgtcctagtagggttggagaaggtgggggatcccttggattgccagagacctatgaaaatcagtatattgctgatggagtgaagttagggttgccataggagggcagttcaacacagaggtcagtaaatcagttgatttaattatataacacatattacaaaatggggccacgctttattgaagcctgattgccacaggcaacacacttgcttaattcaaaaggaggaatttctcgctggggttgaaatgctagaaactctgtgttcaacacaccagatcgtgcccatctccatgatgggtagcaggaattggcagtggaaaaaaatctgagagccggaagatttcttacagattagacattgacccctactcttgcagatagaaaaactgaggccagcagtgtactcaagggtgcattgcaggtctacaattcaggtcctgactccccagattgatgtgctttccattataccatattacttctcactgtatataacattcatcatgatgaccgtgaaactgtaaaagacttggaggtactttctgatttattagagaaaaaccatagtctgttccttctattgccagtctgtcatgaatttcatcacagttactttttttgcttttttgtatctataaaaattatttattaaacaaaactgtaaattaatctgaatagcctattccctaccagatagcacatcatgttaggaaatgcaatgtgctcgttccctcagcagccatctcctggattatttaggggatctgtgcctctgtccaagacctagggaaaagaaactgggagtaaaaacagaggccagctttcagagcaaggtgcttgtctgggattatattttctctttctttttcttccatagcacctaacacattgtggggcacacatttgtatccataactgctgattggttcatcacagaaatccccagtctgtgatgctctgctggagatagaagagagggtcattggcttagtgagataagtcattgtagcttaacagaaagataatagctcttgtacttatatggacctgaattgagataacatatgtagaggcctagcatggtatctgacaaatagtgagtgttcctcaaaaggtgttcattattatgattatcatgatgcaaaatatgtgtgccagaaggactaaagcttcccaggggatctggatcactaatcaaatgctgagggggaagtcagcatgctaaaacttaggagtctttgctaaatgcatgatttggggaggaggaagaaaaaaagaattcccagttcctctactgaaggaccacttttcagcactttcttctgaggtgtgcaaggtctgttgtcactgtggagtagttccagatggtttttagtacctcattggacttttggtgccatcacgaagtggaggaggccaatgctcccatgttgaacattagttacttgaggaaagcttattgcaatactccctaatcttctaaatagtaccccatgttctgcaattttcctaattcacccttaaagtcctaatggaaactaacccatcttgtgtcatatgcccccaggaccttggccttagttaatacaaaaactaatttattcagaagtgttaacgatcactaataccttgtttatctcaggtgatccacatatattttcactttcatgaaccctccatgtcaacctaaaatggtttggtagagatttctgacacctgagtaggctggtgggggagatatttatgggcatataggagcattttggtagtcctcaaaccatatcatgtgggcagctctgcttcagatcattctagaaaatcaactgggtataaattataaaaataacaaaaagagaaaattgcctactcaacctatgtgtagggcttcccagctgtcactttattcaattctgtagatattttgaacacctactctgaacctggcactgtgctgactgctgtggatacaaagatggctatgacacatcattggaactcctagttctatcatccagctggggccctaacaaaacttagagctacttatttggttgacaaaggaaataaaacagcagacaaagccaacagctgtttgcttataaccacttataatcagagacgtctctccctggtttaaatacttctctttatctcaaacacaaagaggatgaagatatccatgtgaaaaagcctactcttaaaggtaaaagctaaacaaagaacaagtgataagagaagtgaattctgcagtgagcaaattgctagtcttttcagaaacaaacctacacggtctggtaccaggaaatagcctttgatgaggaatccactaattaaacctgtttttactgtgactattcaaaacattagcaccctggagatctctggaaataaataaaaggcagaaaatcccaggcagtttaacagaaatattttctcccactggtgagaacgataaacccgacttcaaaggaatcataaaacattcaagccagaaagaaccttagagatcattggattctcatttttcaggtgaggaaattaaagctcaaagaggcccagggacacacctatggccgcacatctagaaaatgagctctgggactagaatccagagctcttgaatgctatttattcatgaatctggtcagtcggtcaactaaatttcttgagcaaccactatgtgccagtcattgtgctacgattggtccctatccctgtccttataaagctggaggaagcagatattaaacaaatggcaaattaattatttataaatgtaatccatgctgtaaagattaagtagaggatggaatgaaagtaatctagcctttttgagggagtaagggatggcatggcttaggctaagaaatgaaagataagggcaagttccctagccaggtaaaaattgaccatgtagttggaagtggaggtctgagggaagagaacattctagatggcatatggaaaggtgcttgcagtccaaaactatcccagctcccccatctgcccctctcaaaatccagacgtctcaccctttttataaaacagcgatctacagtatatagagatatattttcagaagtatgggtgtgtagtaggaaggaggcatcatagccatctggacctattaaaatacttattaaatcacttcactgattaaacagttatttttactaaccaatgccatacaccaaggcagataatcagtgttttatgcttctggaaaggtcacatcctcatccttttgcatggcacctggaaataaaataagcctatattcaaagcagtagatgttaaatgatgcttactgaaaataagtcctcactttcaagtagaaataagaagtaatggaattttcacatatgtatgcagaagatgacatagcagtaggtcagcaggcaacaaccagaccttaaccccttccagctctcactagaagtaccctgtccacaagggcaagcaactaaaactatgtagcagttgctaactccacaaggggtttggagtcctgcatcccaaatgaaaaggggtaattctgaggctctcagaggtcatttctgttatggcacctggaatgtgcctaccatctagtcccccactttcaactcaggttaaaattaactgttaaaaagaaagcagaatggtggttgccaggggataagggaagagggaaatggggagttattatttagtgggtacagagtttcagttttacaagatgaaaagagttacggagatggtggtgatggctgcacaactttatgaatgtatttaataccactgaactgtatacgtaaaattgttaagatggtaaattttatgttaaatatattttaccatgataagaaataaatttaaaaagttaactgctatgcctgcaccaaaacatctcacgtactttataaatatatatacctactatgtacccacaaaaattagaaattaaaaaaattaactgttaatattaaactatgatgagtcacaagcagcataataatgaaaactatcctgttatgggcactatttgttttatatgcattatattattttactttcatgacagtcctttggcatgggttctattcttggcattttgcaggtgagaaagctgagcctttgaaaaattaaacaatttgaccaaaaccacacagataataaatctacccccaaagtgagtgagcttattttcttgaaataatcaatgaaggcaaagatttgtgtcttcttactcactgtcatattcccaccaccgagaacaataattggcatagagcaagtgcttggtaaatatttggtggagttggagtccaatcaaagcagtcttcttctagagtctacttagccactggatgaaatgcctccaaggtctctatccctcagcctccatctatttaggttcttatctcttatctgggaaccacagtgtgctcctaactacttgtcttcactaccattcccaggcttcccaaggtttgcaactcttcctgacataacacttaagcctagggataccccttactgaacagccttccgaatgccacaggccctgcttagtcatcattagtgcatttcagatattccatgttcacatcctagctctgacatatgctagctatgttgaacaagttgggttacttctctgaacctcagtttccttatctgtaaaatggaaaaaaatcacttaccctctctgagcctcagtttcttgtttatctcccaggtctcttctagctctcaagccttcatgactaacacactggtaccacagatctattgctgccccacccctaatgacttacagccccttgtcaaagttctgcaaataggtctggtgccatgagaatttgctaggcttttagttactaagatctgcctgcagttaccaaatatgcagaattcaatgatttcttacctcttttgaagaggtatacatagtatttctgcctttattcctacctaagacattttatgcttaagatctagaaatgaaagaatgagcaagatgtcttctgcctgggaatttgatgatcagaggttgaagccatgaatagtaagtatttgaggagaagtattagctatataaagctgttagcttgttgataggacctagaaggactcctatgtataattcctaaaaacttacctttttttcatgttttccttttctgaaaggaaatgctacagtaaaattaagaaaataatggtccctgttttatggcctcaaaacattgttccttccatttgcatgggtaacaccatggagtcctagaaaaataatattaaccttgtagaagaaaatgaagcctgttgccttaggcttgcctggagctattcccttctgtggcctctccttcttatgaactatgaccttcccagatgctaccacctggttgacagggatctgccccagtagtggaaggctaactgacccccttacaaactggccctatgactctggcttaagcaggccacagaatttccagccacttccatcattatctatgaatccatcccttccacacacagcaacagagccatccccatgacaaacacccttttggtccttatgccactctctaaagcttctaccctgaaaagatttgtactttctctcttggaatccatttcacaaatgtttatgactctggaatactgatggtattattataagtagagtggcaaagtgatatgtagaggcaataactatcttcaggatgggccagttcagagtgagcttcttagaggaaattacattccaagcaggcagtaagcaatgccatcctggctccctgaaattgactgggtggcaatccaactacaacatgtatctgatcattttataccttgtggcaacatattgagatcagaccacttcaggggagtggaatattccacctcagcggttggcccactcttaatgggtccttaacacatatataaggagatataataaaataataactctgttctttaagagctaaggtatccatgggtaaatgtgttatgtcatagcaacaatatatcaggcaataaggcaagagggtgcaaatgacaaaatctcttctaaagacgaataactggatcgtaagctcaaatagcacatatgcattgagggccaggataattggtcctttatcttctctttataaaagcaaaggtttatttgccctttaaatggttcaataaaattaaattggtaccctgtagtgtgtgctgaatacataatcagaaattggaagcaataaaaaaaaagagggaaaaggcaaaagtaataaaatctaaaatttggaacagtgtacaaaaacaatgtaggaaaataatgcaattcccaataacacctcctcattgtgtagcagatcctgtaacaatcacttcttctcctgaaagccagagatcaccaactggatccacagtacctcaaaggcacaggctgcttgactttgtagtatcctcagaaaaggggaggggcagggcaggactgggtaagaaaggaagtgactctctatttactttgtccacttttggagggatacacaaaactttgaaagtaaatgtagtactcatgaaaaggaatgcttcgtggaactcaaaatgtcttttaaaatatattccctgtaatccttccaaagctgctcatgttaagatcttcagagaaaaagcacaataaaaacctcataatacataagcatacagcaatccaacctccagaaaaacgggagagttggtgcttggcaactgatgaacatgaaacacaatacattaaaaaaaacacattcttctttctgatttctaattttgatggccagacacagaaatatttgtttaatgagtgacagcacattgataatacttttctgtatgaactggatagatgaaagagaagggaaattgtgttattgttcaattattttttgcaccaaatatattcacatgctttactcagagaaaatattaatcatgcacacaagaattttgacttggaaatctcagaacactttatagaaatccattgtgtagagtgattccggtggccagatacattaaaaaaaaaaaatgaaaaagagggacacagaacgagtttcaaaaaataccttcattaaaatgtcttacagttgaagattcttagtgaaggtgaaactatctagaggtcatctctttgcctccaaccaggagtacattaagtcatcctgaataaattaagttcatctgctttccacacaggacgtttcttcagcctttccaggggcctctcttagttttctccgggctcaacagaccaaaagaccctttcataactaaagaaatacacgttttatttcctttatgtctctcccaggcacctgccaaaggactctgcacttcgtttaccctcaaatatcattgctgcctggctggcacttatgtttagtgccacccataccacaccaatctggagctgggactctttcttaaacacagatgaaaaccaacaagagaaagaaaagtagccaaagtaggagctttaagggtgaaagagagcaagacagtcatagagtcactgggtctgcagcattgctttgtggagcctaggccccatactgaagattaatcttaaccaacttcatcagtgattccatttaaaaggcaaagaggcaactaggtcccagttgtgcacagaaacaaaaatcacaagcaataaaataaaattaaatactcataattaactaattggtggtacagttggctgcttttccccccagagaaggcatcttctatatgaattttggagcacttaaccaagtacaactgtaattattattattcctataataatagggttcccacagatcttcgtatttttacatgttttatactcattatggctaatccacaaaacatctctttagggtatgcaaatacttttattgccagtatgctagagaggagatagagctaaaaaaaaaggtgaaatgaaggtcacagattatcagcagtgacttacgaaatagaactagagaattcctcatctcagaacaaatttatgtcatcagctcgctaaatgcttacagtatgagccaaattatactgagtctgacacaaaagtaacagaacacctgtttcctgggccttcaaaagcttctcagtcattgatgaagttcacatttacacacatgaggcaagcaggccacaactcagtccaggcaagctatgatcaaatgccaaaatgggggcttcaggccaagtgctgctggcagtcacagtaataatagatttcttgggggatgaggcaggcaccaaatgctccacagagcagggagtatcagccaggttttgaaaggcaggcaagaattggaatggcagagatttagagaatggcattccaggatggggacacagcatgagaaaatgctcagtagcaggaatgaataagaagtatctgaggcatagaaagaccactagtctagggcagaaaattcctacaggagacctgtggaagacaattttagttagatcctaagtcctaaatatagagagccatggggtagaaaacaaatacctactgtttgttgaacacctattatgtacagattctgtgcttcatgttttcttaatgtaaattccagactgaagagtttggactatatctgaaaggcaatggagagcttagggcccagtcactgcgttccaatatctaaaataagacagagtgtgctcagttacctcactcacatgtccttggccaacctctgaggacttacttgagtgttttataactgagtatacagcttctctcaggcaataccattgttacctgaaaatacaaagcctttaattttgcgtgacatcacacaaagagaattacagagcccgaatcctctttctcttggagcaaatggaccactctgatgtggtcagatgtattcatcagtagcacataaaagttacaagttaatacatgactgagcagcaaagtgctagaggggctacttattccgtctgcagatgaaactacattctaagagttgcatgtgtttacttaattgtagctatttctagctatttttagtcagattccaccccatggagcaagttaggtactttgggagacacagttttactttcaagccactgaaggagcatctgcaaggtccatgcaaaaggactcagctgttccgtgttgctgcaaaaggctaaagtaggaattaatttgaatgatgttctgcaccagtggtttctcttcccaccttgcaaatggattgagttctaaaagatgtgtaatctggctggcctacaggtggccttaaataccagagctgcttgttaaagcacataagacccagggtacaactgaacggttttacagcactgaacctaactctattgcatgctcatgtttctgtgggaagatgcgttcaccttcccaactcaaaagtttagtaacacatgttccctaagcactcccatctgagacagtgggagcagaaatcccatcggcttccatccccaggtgttggcaattcaatgtgactccagctgggtggtggggatgagttcagatggaggctcagagggcctagggaggagggatggattgtgagaacaggaaaaagaatgagatgggtcctctgcaggaagtgataaacagtgaggacacaaatgttgtagatcaaaccagtactaggcttgggacagggcatggaactacagtggcataaggtagtaaagaaatacattttattttatgacccataacacatatgcatgtatttaaaacccaaaacatatgtttcatgaaacaatgaaacaatacgtacctttactacaaagatgcaccttggcatttttctaggctgtttcatttatttttaatgctaggtcatgactcactacattgatttcataagccactaatgggttgtaccctgcataatttgcaaacattgtaggaaaagggaagaaagattagttttcctttattctttttttttctcttatcgatcatagactctggcctggaacaaatcagaatggaggttgaaaaaacaggcactgggataaaagtgatgaaggtgggttctaggcaacattcagggagaaaagataaatggataggaaaggtgtggtcatgctgtcactggaccagttatgagttccctagcaggaggtcatatgaaagggaacttgagagtagaactctgtatatctccagcatctggcacagtacttgatgctgttcaataaatgtttaatttaaaatatctaccaaattgatacacatacattagaggctgattgaacatacacatctgatcaaaacacagagtgaatatcagaatgtatgcttggccaatggcggtgttgacagggtttgttgttagcaactttatccctcccctttgtctctgcgttcaaatgccaaaaggtccccatgcagaggtatccccaactggagagtcattctcctagaggacaactaaaagactcagatcttccctgactgtcactaacggccctcaaaattttatctgacctgtgtcctgtttcctcagtgcctggttctcgtcagaactaatctgacaaaccaatccatactgaagtagtcatgagaaatactgaccgcatgtttcccttccagaccacatttgtaatttaatagggaattttgccatgctagccaaaaaaaggtggatgtttcaaaccttgtggtagtcaatggagaagagaaactgaagatgggacatctttctagggaccctcaaaccacactacaatgccactatctactctgcctacaaataggaagtttccattagtcattaaacaatgccctcctcccctccaaaaaaagtatgaaagttgctagtacaatgcctaaaacagttagtaactaataaatactggttggattagaatctaaaacatttaggtgggtaggcacaggaggcagctttaacaggtcctactcacctagcattgtctgtgataatggacaattaaatgttgcactgtccactagctgcacgtggctatggagcacttgaaatatgactagtgtaactgagaaaagtgtagtcacatgtggctagtggctatcaagctagacaagacaggtctagacagttaacagacatgagacacacattttgagcaagtacctttctctcactggtgcccttgttaaaaagctggatctttttctagattagccccaagacctaaaatgcctgtcttcaaagggttgtccttcttcttttaggacaaaggggtgtaggggatttgtgggagctggttacagagggctttgttcttagattcaagctagaccatctgttcccaatcaaagcagctttcaaatagagagcagtgcaaccctgaaacatcctgcaagggccactgaggtttacctgaatgtacaccctatgcttgtcagatggacatctcagcgtggacctccttggcacaaagttttacacagagccagaacaacctcccaaaccacaattgggcaattacttttaaaaatccaactggttgaattcaagttagaagaaatgccttttactttaacttgcctttttttttccttgatggaaaataggtttttttgctcttcaggctattgagacatatttgaaggaactgaggttgtatggatttttaatgcagcaaaaaggtgaactgttttgagtacaccaatcctgggtattgtgaagatggcttttcaagagttgctgtccatcaggattgcatttgggaaatttcataatgctgcttacaattgctttaaagtcttctagcagatatggatgctgaagaccatgaaccctagggtcggatattaattcaatttttccacctgtaaaatgggtaggccatttgcttcctaacaacaaacagcaatgaatcagcattttgatcttaggtaataacacactgcttgagttattctgtagaaaacaggagtttcccaattcttctggtggctcattcttcaccaaagaggtacttctctgtttgatcatcctctctcctctcagcatccttttctttttttttacttccttttcataaaacttgatgataaatggtaaagatacattgtcagagatgataaaacccaggagagaagaaaattgttccagttattttttacccaagatttaggcctgtgaatgtgtgtgaagaaccaaagtcagtgttaagaatcattcatattgcctaaactgtgaatgtgttaaagatataatatatttggagcatactgaagaactttagccagactatttattatctagttattgtcatcctgaaaggtataggggtgaagaataaagtagcatgcccaataattttgtccttggccctgtcctcttcagcatttttgtcaataacttggattatactacccgaagcagactgaccaaattgcagatgatgcataactgggagcgacatctaataaacttgttaaacaaatcaagattaaaaatgatccctagaggccgagtcaaaaccattaggacgtttttaaaaagcaaaagtctatatttaggtacaaaaaatcaacagcacatatccaaggttgggggaagcctggtttggcagaagtttcttaatatacctgggatataatttcaagaccacaaagtaggagtggtttccatggaaatctatggtgagctgtttgtttgttgttgtggttttgttttgttttattttgttttgttttattttttaaaaagccatgccatactcagcagcactgacagatatgtgttttctagtccagaattggggggtggggaggggtatcagttccctgtcttctggaggggttcaaccttactcacagtgtggtgctcaatcctggacgccaaactttaagggtgacatttgacaaactggaacacatccagagaaggatggccagagtggtgaagagcctgggatctctgaagaacagttggcgataggctgaaaaaaagaagtcatagacaggtgggatgcatattgtcagatgtttgaaagcctgtcatttgaagatgaagtagattgtttctgcatacttcagacaaaaaaaaaataatcctcaggtggtgaaagttacaaggaggtagatttgcagtcaatatattaagaaatttctaataattagagccatcccaaagtagaatgcactgttttgaagagtagtgagttcactatcatcagaagtattcaagaggggatggacccacctgccaattaagctatagaggggattgttgcattttttaggaagatggaggaggtgactgaggccattacaacattaagaatgtgatgctaaggaatccaaacaaagtgggaaataaaggcatgtcttcttcactgatgatggatctaaagattttattacttatatatggttttggctttaattatgaaatattttaagcctacagaaaataaaacagacaattattagttcatttttgagaataatttttgtttggggacccatctcaccctctccctgctcagcatgggctgcaaaatcaaagaaaatggctttcaaatactatatgatgtgatatcaaacttgtagctcttatctgtccatgacaaaccttagggctgatccaaagacatcataagagttcatcactttcctgcacagctttaaaaattgtttcattgactgtgactggattactggatcaattattttttcaattaagagtcctgctaaaccccatgtaaaatgagttgcaagtcaagacaagcccctgactactttagatgattgatggagatatgtggatgacagagacaggctgtaaagaatgacaattctgtggattgatttgttatgtggatgatgattactggaagccaagtaccaatactacttactcgttgatactcagggacttttgtaatttttaaaaggagaaatttagctattacttccatttattctctgcacgaacctgtgaggtgggcagagcaggtgttagcattgctgggttacaaatgacagacctgaagcccagggaagtgaccggcccaaggccatatagccaattaggggctgaactgtataaaaacccatctcagtgcaaacacactgagaaataatttttaaaataatataaataacatatatcacttatcaattgagcacagactatatgaaagtcataagcactttacacatattcatttaatccatacaataatactatggagtaggtactattataccaattgttatagatatggaaatgaagcttggagcatctaagtaactagcccaagtctatttaaccaataacttgaccttaaaaaaaaactccaaaactctttaccttcagtgccacaacacaattcaaaccactattgtctctcacctagactatagtaataacatttcaaaggtgttccctactttcgttgatgttcccttaaatctactcttcatacagcagcaagaaaagtcttttaaaaatataaatcagtttatgctatacccatgatcaaaattattctaatatttcctcccatagtccttggcataaaaatacaaattccttaccaacatctaacaaggtcctccacggttggttcctgcctcctctaccagattcatcttgcattatcctcttcctcactggccatgttccagccaggctagtcttctttcagtgcctcaaatgcatcaaatgcatttcagggccttgtcacatgctagtctctttgcatagggtgctcttctaccatcaggtgtcagttcaaatgctttgtccacagataacctttccctcgcctaatctaaattaaaaccaccttatcatgaagtcacagcatcctacacattctcctcttcatagttagaacgtgataatcacacattggtatgattatttgattcatatttatcatatttactgccagtactagactgtaagcaccatgaaggcagagatcttgtctgttttgctcaccaccatatttcagcacccagacactgccacacactaggaacctgaaatttatttaatgaatgaataagcaaaaaattaaagcccacgcctgactcctgagtcccaatgcttaaccatattatctcgatataaaagggcctaaaaagcaccctcttagcccaacccatttcaacacctttcccgtcatctctgacattgctatggaaggatgatttacatttacatgtgcaaaatgaattttccaaaatacatgtgttcatatattaatgcctgcatttgctagcagttacattcaagtaggatcaaatgttgacaataagtgttttctttgccagcatttagatacatgccatgtaattgcaaaaataattagttagactttcagaaggcagtatgctcttgagagctgaacaaaatgttcaaaggaattaaccccaagatggtaattaaaccatgcaatcatcagctggagaatggggctgacacactgttctgactctgaaacctaaaaggacccactgtggttaccaggacacaagaccaaagggcactggggagggatcatgatttatatgaacccagggaaggtatgagctgactgctaccctatactcaccccaccatatccatcctctatctaatttcccctctcctacatccccaggctaaacacaaataactcattaaagggcaggatcaggaagatagctgcctgtatggtaggcttggaagagtccagaatatccaccctttttaagtttctactgctaaagtaactcctttggggttttctagatatgtatgcattttcattggattaaggttttgctctttgtaaggaggaattcataaggtaaacctttggttctcaatgtgggagatgagctatgttgccctcctgagggatatttgatgatgttctgaggcattttgggttgtcacaacaggtagtaggagtggtgcccatggcatttagagggtagaagtcagtgatgttgcaaaacatcttacaatgcacaggacagcccctggacaaagaattatccagaccaaaatgtcaatattgccaaggttgaaaaaccctgaactgacccacttacaaagattcatttattaatccattaacaattcatacacagagtaggttcttgcagaaataggagatgggatgagtatattttgattgatcagttgaaacagaaagaaggaacagtaattttatagcagtattcaatagtctgggaaaagactggaagcaactgaccagttaagagactactctcagtcaagagaaaaggaatgataacttgaactgacaatgaacaggaggtagatacacgtaccttagaggcagaattggtgaagcattacaaaagaatggtatagggaaatgagggagagaacaaaggcaatcatgatccttaagactttagctttggttcctggaacaagagcaatgcattagaagaaacagggacaacgggagcagacacataggtggaggatggacgtagagaaataatatgctgagttcgtgatgccttgagggcctctgggtgaggctgttttatgggcagttagaaatgtggctctggagctcaggagtgtggctgaagctacaggtatctagttagaagtcatccacatggaggtagtgagattagatccccttgcctggcacatagcaggtcctccataaatatttgttgaattttaaaaaaccatatttaaagtgaggagaaaagagggccagggacaaaatctttgaaacacatcctcattgaggaggtggacacagaggaaactgaaaaggaggagtaagagaggtagggccagcagagtttaatgcactggaaatccgagaggagagtttcaagggctaagatttagccaacaatatcaaatgcggctcagcaatcaattcgaacaacgtctatgaatagagggggatttgacagtgaagaagtcatcatcgaacttgagagagcagttcagtagaggagttggaacagaaactaggttccagaagctgaagactgcaagatctttattatcccatcattagtaatagtgataaaggagttagaatgatagttgatggaggtggcagggatttaggaggaaatggaatcttagcagatgtttagcctgacaggaagaaggcagcatagagagactacagtgtggcactcaagaagcccaaagagtaaaattaggttcaatttaaggacgagctccctagctgtcagagctgccctccaagggaagtagtgagttcccttgttactggatggattcaaggagaggcaatatgacctcacagaaggtggctcatgtattgaatgggaatttggactagataattcatttccaaccttttggacttatcagattaataatattttagggggaaaaaggtagggcaggtgcacattgatccagagagttaccaaccttttaattttgctatgttaaatgtattagctttctatttactgctgtaaaaaattaccacaaacttaatagcttaaattgacacaagactattatcatacagttctgtaggtcagaagtctggtacaggtctcaccaggctaaaaccagtgtgtcggcagggttgtgttcctatctggaagccctaagggagaccctgttttcttgtctttttcaacttctagagactacccatatttcttggcttgtggcctctttccacttttcaagctagcaatggccaggcaagtctttcccatgtcacattactctgataccgactctcattttgcctctgtcttccacatttaaagaagcttgtgattacactgggccacccagataatccaggatattcttgatattttagggtccattgattagcagccttaatcccatctacagcctaatttccctttaccgtataacctaattcagggactttgggactcagacatggacatcttttggggagtcattattttatctacccacataagagatatagatatataaatatatctcccatgtgatagacatcatcatcatttatcatcaacatcatcatttcagaaaataaagactacatatagcactaaagagtagaaattatatagagaaaagtactgtctttcaaaaaaaaaaaaaaaccacgagttgtctaccttactccaacacacacaataaaacacagcatacatttatttatttccttacactggtaactccaccaattactaataccacagctttagaaagcaccagactatatgatctctcaaggtccctcctagctctaagtttctttgatccactggacttcactgtactatgaaggaattacctggagaaccttgttgtgatgtagctctatgagtttcttcatagctatatttttcgtcttcctgcttgctttaaatgcaatcattaaatcagcaagagacttcagtttccctctttcctccttgattcaaaaggtatgaaaagtgttctgtaaatgatatgcaatattgttattctgaactttgaagtaatcaagttgtttgacatttttgtaatgatgccttttggaatatgggtggtataatttggtgccacactgtacattaacaatacccgtctcgaccctacagactcggggactataaataaaagcgtgacagctggctccagccttgcttgccactcaccattgaagggaacgcagctggggagctacactagagtccccaggaatccagaatgtagtcagaaacgacatcttcaatgagaaaaaaaattggtattttgttactgggaatatacagagacaggcactcttaggaggcagacaaccaagctatttcacactgagaaggcacagaggccccaggtagggacagcatttcaccagcacaaaggcattatatagggagggaagagacagaggacaatggcatcttcttgatccaaattggcagagtttctttaacccattaccacccagaagtgagactaggaaagaagaaatggataggaaaagtgaaagagatggaaagtgatatcctggggcttggtatgagatagagggcaatggttactgtggggaggataacacaatagagctaacagagggcaaagtacacagagagagagagagaggtgaagctgatatacttcatattttatttatttgtctcatttattgtattttcccctcactagtctgtaagtcccaagaggacaggatctttttcactcctgtatctcccaacatctataacagtgcctgacacatagtagacgctcaaaaaatatttgatgaatgaataaatagctagtattcattgaatgtctattatatgctaagcactgttataggtgctgcccatgaatgaacgtattttaactttcacagcaatgctgaaacagttattgtcattatcccaattttacagatgaagaaactctatcagaggcacagagatactaagtaacttgcctaataagtaaaggatacaggatttcaacctatgtggtctaactttagaacctgcctatgtaataaccatcctatactgaggctcagaaaggtcaaataacttgcgcaaagttacgcagcttatgactggcagagccatgattggaaccaagatctgcctgtctatgaagttgctgcctttccctctgcacttcatgactttataagattgccaagacaaatatttcttccatcaccattttaccagagagtcttctgagataaagaaatgggtgtgaggctgggcatggtggctcactcctgtaatcccagcactttgggaggctgaggcgggtggatcacctgaggtcgggagttcgagaccagcctgaccaacatggagaaacctcgtctctactaaatatacaaaaattagccgggcatggtggcgcatgcctgtattcccagctacttgggaggctgaggtaagagaattgcttgaacctgggaggcggaggttgcagtgagccgagatcgggccattgcactccagcctgggcgacaagagcaaaactccatctcaaaaaaagaaagaaagaaagaaaaaaagagaaatgggtgtgcttcattaaggattcagataaaggaaacagacatcccccaaaagaatcatgactcccaaaagatcaccaatctgcaaccagctctcactgctgttattggggctggagggagctgagggaagcagctggcagatgaatcatgggaaacccctggtagagccatctatgctaccttgtctgagggctaggcattgaaggtaagtcactttcatgcaggtgaatcctgacccacgctgcaaaagatagctctggagtagggatggtgaggaaatgccaataaagcttttctaagagactagttcataattcttgtgtgaccttgtgtaagacactccctccctttgtgtcatagtttctttatgatagggagacatcagaccagtgaaactctgttcaatcagaagagctccactgtctcatttgtaaaataaacttttccatataaaatttcatttggagaaaggatttcaccactaaaaactatgcttgagaaacaagtgaataaaaagtaagttccttctagctcaaacattctaagaatctaaaatcatagacattgtgggtgggtcaactcagtgttccattcaaccctacttttgacagccaggaacaggcctaggatctgctgtgaaaggcccttcacaggtcccccatgccccagcttctttcagaggccattaacactgtcctcatatggcagttgtcttccccattgggctaatccttcgcaggccttctactgatgtctgtctatgttggagtgggtggagcacaggggtcaatatttgaaggacagttgtacttctgttttatatgaaaggagtcaaatgtttcctgattttcacctaaaactcttcttattgatgtccaccaccaaaagacagtggatctgccttttggaccacggtggcatattattccctgaggattgccactgatctataaatattcctgagtcccttgtctgagtcacaaccagagctgtatgcttagtttggaaattttaaatttcagtgggttttctcacacaggctccctacacatttttataagttcttcttttgtctcattcttcttgtcataatatacaggcttaaagatttcactgggttcaccttcctggagacaactcataaagttttaccaaagtctgggtttcacatatacaatatgactcccttgatataaagctttaaaacaagcaaaaataataatatatcgtttaggtgtatgtgtttgtatatttttttaaaaccaaggtaataataaatacaaatttcacgatagtagttacctggggcaggggtagcagggaggagtgttatcaatacagggagatggactagaggaggaccacatagataaaagtaagttaccagtaatgttatagttctcaggttgggtaatggctttataggtgttcattatagtctaaataaataaatgaatgcaataaataaaatattaaaagtccgtgtatgaactaacaatgattaattaattctgcaccccgagttcaaggtcaatgattagaagagcaatacaagattttttttaatcaaccagaacctcgccacttatcttctgtttccttccactatttcaagagtttttgaaactgaaagtggatcatggctatagttttccttctttttaagtttatattccccctcaattattgcccataatctagtcaggttggagttctccttactgaaaatatgttgcattttcccatgagactatttttgtataggattcatggatcctaatttttcttttgccagttggtatggatctgagaattaccagctaccctttgaatcattttggttgaagggccatgattgcttgttctagtcttccagcccatgaccattattagtaaggagaggttctttctagggttgacagataaaatacaggatgcccagttaaatttgaatttcagataaacaacaaattatgtttttagtgtatgtatgaatttgaggcatacttatactaaaaaattatttacctgaaattcaaatttaattgaaaatcttgtttttatttgctaaacctcgaaaccctatctcttgtggagcaatgattactttttaataacattattggatttgagtacatgtgagtgtgagttttggatcaagcacactcagattcaaattctggctcctctgcttaatagctagaacagtttttttggtctcagaatttttatctattaaataggaataacagcaatacctcataaagctgatgagaatattaaatgaaaaaatatttgtacagtagttagtatagtgcctggctaaatactattctcattattaatggctgttattatcaatggctattatcattattattggatgttatcattattattgtcaattttgtacagaacattatgtgcactggccaagatttgatttggtattgcaaaactccacttacaggattaatttgagaatgggacttttcttagcatcacccttggtgatgatcaagacatcccttttgtttctgagtattgtactccctttggctcttgtcatgaagtaccccagattcactctagttggatttttccttttatttatttatttgtttatttttgagacggtgtctcactctgtcggtcgcccaggctggagtgcagcggcacgatctcggctcactgcaacctctgcctcccgggttcaagcgattctcctgcctcagcctcccgagtagctgtgactacaggtgcccgccaccatgcccagctaattttcgtatttttagtagagacggggtttcaccgtgttagccagggtggtctcgatctcctgacctcgtgatctgcctgccttggcctcccaaagtgctgggattacaggcgtgagccaccgcgacgggatttttccttttaatataaagacgtttcctgtgcatgtgtctgagggtcacttagaattcttcaagttgaagactattgtctcctatgatggagatggttaagtgactgataatcacttttgaaatgctaccctcaagccaatggctaatgactttggttgataaaaagagaacagctctaatcaacatagattcgaatcaaatgcagggaaagcaaaatactacatccactgagaactctatctctcacaacagggtcaagaaatgaattaaattggttttccacttgccttcatgttttcaataccttctttatttttggtgctcaacgtcttcactgtttctcctctcagggaggactccagaccccatacacattctcttctctgacccactcatccccatcaaaatttacccatctgatttcccactcatccttgcatctaatcagacattaatttatcttaccacagtgactgctaaataagattctatttaatcactctcccaggccacagacttcttttaaacacttgaagaagtaaacttaacagtggtatttagggttttctagtaggtaagggagaccatgcaggaccccttaaatcacaccacattatgcctgttatgtctgcttcgcatgaatggaagtgagcagtggtgcagataatctaaagatcatttccactttgtttgtgaatgctccacagtgttgttgtagctgatttgttttgctaattatgttctactgaagctaatattaaaattggttcacattttttaagctcttatgggccagaagagagaagaggcagcaatgtggcccactttgaaatgaaggaaaggtgacaactgtgaggggggtgtgaaaattctacatgtgggctagtggagtctataagatacatgcaaaaggatcaagatagaactttcccaattacacatgggcaggataggcagccacctaacccctgtgactcgatgagcactgaaaggacagtcttcccatggcctgcccagagccttaaatcatctaaattaatagcccacattaagggctttaataataacataactgtggctaagacattatgtaacctgaagggtaacacatttcctagcagacttattagcagctagtcttactaaattctcagtcacctatgagaaaaaggaatgaagggtggtacaaaaaacagttgtagttgtagtttgatggacgcattagtacactaagaggcccctgggcagctaaagtggaagtacaagagcactgaatgccttggagatgagccgggagggttttgaaagggagtaagacgactttcacctctatttttcccacattttcttggtttccagctcattgtgcacatagagaatgtgtacctgtatcaaattaattctcttccctttcttactcttctcctgttgggtaactgggttttcaggggcttctttcttctgaggtatgcaatttggggcctaattgtacattgtatttctaaccctacaagttgcagcaaaggaccatggagctattgaatctttttctctttttctcattgcagtctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggtaagaagaggcacctgctctgctctttagatattcatgtaattgtgttcaaacttcctcagcttatgtgccctttgcttccaataaataaaatctaattctgttttaaaattgtatttaatattccaaataaatcaaaggttaagattaaaaaataaaagtaatagtaattttagaacctaatttttcaagctatgtaggccctccctgaaaaagcagtttggaatacctcttgattgagtcaccattgttgaaaaagaacgcctcccccatcaaaaattttatctggtctaaaatgtatgaagtaaaagcagcttagtctaagtagagagaggcttaaattggaaagtattggaaaattaatcctgtcagaaactgtaattatccccatttcatagatgagatagctaaagtccaagtgctttttcatacagcagtttaaccactaaaatgggactggtagcaatgtctcttgcttccaggactcattccatcagatcacattaggttttcagcttagcaggcctcaacaattatctgatagaaataatgagtgagacagctaaactgggctttggggattgactttttgttttgtttttggttttgtttttgtttttgttttgttttgttttaaatagtgagacagtctacggccataccactctaaatatgcccagtctcctctaatagtgagacaatatattgaggatacactctattaaaacaggctcagaaattaagagtctgatcttaaataatatacagtaaggtctattgattaatttgctagagcacacacatcataattcatctaatcaggctcctccaacacccagttgtctttgacgggttccttggtaaaaccaagggattctatcaccaagacgttccagaagacaatgttactttatcactcatttgcctgtggttccatttataggctgggggtggttctctctaactcagaatttttaaactcagaaggattaaatgaaaggcttatctgcctgaggggtacctgtagaagaggtccttctaagtaacttaacttgaacggccattttgctcttgggaatccagaacactcttcactttactctcattttgctgcatcatcaaatcttaatagcaaatacttaggcctgtatttccctattgtacttacctccaaactatcatcaaatttcatgaacctgaagcagaagaccagaggtctagtccaagctctgccacttactagctcacttaacaagttgaccttgaccaactcattgacatgctcttggacttggcctcctcacctaaggtgtgttccttcttaatgttatattccatgattctgtgattttttttgagatatttgaccagctactgacactttgtatcttgctacaaatcgtaacttatatattatcagttaattagtcaatccattctacaagccattatcaacccccaatggtggtctccaatcctgtgatacatacatatataatatggtttcaagggggtgtgtacagaaaaagatacttataaagcaattcatgaacaacacagaacaacatcaaattgagtgctacactgtatactctgaatactttaagaattgtggaaaggttgcactccagaaaagtagagttttcagagaaagcttgctagagaagctagccttgaaagatagataagttgtgggttgcaagagagaagggagatggggctttggagaggagaaaagagaacaaacaaacagcagggccaggaaggaacactgtgtgttcaggtagagccctgtctgactgagatacaaaatagcttgaatattctaattcataatttgccaaattttaataaatttcattttgtccaaacagtatacatgtactgtatacagcgtaatctagtgcatatcaatttcgttttcagaactgaactttgtaagtcaggcaacttctctcctgaaacattttaaaaacgaaatattggttccaccaacagtgtacctctcatttattcaaaagcagaagacacaattaatgaattttatcctcatctagtgtgacccttctctgctcattagctctctactagaagaacgggaggaaaagaccatctatctatttcttacccttgcatcttttctctaatcatctaactaaatagtttggacaagtctatggtcttggagtcaaagaaagctttctgactcatgtaactttatatttttcacctgcagccatttagctggtgggactaatccgctctgcttaagaagtacttcccataaacttttacactaatttaccccttgaaaagccttcttacattactgtactaggatcctgttccaaaattttcaatggctttctattgcccatattgaaaaaagcagtctattcttcaagacttggcatgagtatgcctcaaccaactaacaaacccattctccctatgctacccaatgagaacctcccattgtaggaagctcccattttccactgctgcctaaatgcaccagaaccatgcctgcctcagcaatcgtacttttactactacctggaattctctcctttatcttgatatggtaatcatgtccattcttccaattttcaaaacccgcctcaaactctacctccccaaggtagccttccttgaccactctagctcacaattattcattaatgcaatagatgctaaggctacaataaaaaccacatagatatagttagatatggttcctgctttataaacctacattctaatgatggagatagacaaaaaccaagtaaattaacaaaaaaacaattgcacatttaaataaggtgctatgaaggaaaaaaatagacagataataatggatagggcttaatttccaaaggatgttcagtgatggcctcattgagaaggggcatttaagctgagaactaaaggactggaaggaggcagcatgtgaagagtagagggaaatagtttcaagcagtagaaatagcaagtgcaaaggtcatgtcgtatggttgaggaactgaaagaagtccagtgtggctaaaggataacaagtaggtagaaagtggcctgagagcagactgtagaggtagacaagagccagatcatagccatagagtataaacagaagccatgctgaggagtatgaattttattctaattgcagtgggaagtcattggaggattctgagcagggaagtcacatgatctacatttctgtagagaatggagtgtggtgcaagtaaaaaagaagggaaaccaattgaaagtccattgtggtcatccagatgagaagtgatggcagctttggactaagctggagatggagaaaaagaggtggagttgaagtatactttggagacagaattgacagaacttggggacagattgactgtgggatgtgaaggagaggaaggattcatggatgattactatgtgtttggcttgagagattgggtaagatggtaagatggtgatgccatttactgaggtgactggacaggaggagacttagttttgaggagcagagatcttgcctacctctaaacacccacagaacccttctgtccatgtcattcatctggcattgaatataactgccttctgctgttatttcactggctatgatctatactataccttcccaagcatttctctccagtgtgataataaacaactggctagcccctagatttatactttgtgcctcccctagtacatagcacatgcctgtgtgcctacttagtgttttccaacctcctttagtgattcatcaacaataagcctatgtctgtttttcaacactggactgaaagaaagagagaaagaaagaaagaaaaataaagaaggaaggaagggtgggtatgggtaggagggagaatgggaagggaagaaagaagataggaagggaagagaaagaagagaaggaaggaaggaaggaagggaggaagggagggagggagggaaagcaggcccaattcataaatcataccaatcacttggtacagttgtttaaaatattcagtattctgtattttcttgttttgtgcaatgatcatctcttgctttagtaataaaaattacagggagaaattacaatagaaaatataattttacaatattttaaattatataagagagatagaagagaaagagaaacagaagagaacacctataattacattcataagctaaatatacaaatgatgtgactctactgtataagggcagggatgagtggggagctgagaaatgggttaaatgtttgagatcatttaaaagaattgtagcacaaccagggtaaagttttctctgaaattatgaaacattgagtggaattcagggctttgttgactctgcttctatttctgtctgcagacgaaagtctgatttggggtttgcagtttgtcagtttctaaaatcctaccttgattcattaatacaaagttgaaaattactttcttggtgctatatacataaaagaacagtttttgaaaaaattatgaggttaagtgtgttgtctgccctatcggtaccctctcctattaacaccctctttccttactatggcattatgtttacacctgccctccctggcaggagcaaaaccttaacatctctgtctcaacctgcttctacaccttcataaaaacttccctgtcctgcattttcttcccactgattaatagtctttctctgctagtgacaacagctcagctgaccaatttattcatgctaatttatctatgactattaacaacttgatgggttagtgcatccagggaagaagaaatttctattcaggcaaaggccttctgtgaatacagaaccataatccaaggtgtagctttttaattctgggattccaggcaccatgagtccagtttgtgaggtcctttgcccacatgccttcctatatagaaagtcctaaaaccatgccagggaggtggccatctcttccagttattagacttatcttttgggtgcaagtgacctagttctctgtggtgctaacatttcccccagaacagcaacatacttgagaactgcagccagactctcgtgcacctgacaactctccttggcttcaatgggcacagcccacagagatgaaagaatccggcccagctgtggctctcagcttagataatgagataatagctctgggtgccctttgaggcaactagtccctaccttcttgccagtgttcaataaactcctgctgtctcccattctcaacctgaaactccctactcagttcccaagtaactctctggaagtcaacagccttctaacagatctttctatttcctctcgaaggttgtgacaggaacataggcagttgtaacaattatcctatcagtcaacaagcaattattaagctttctccagtgttagcttgtgctaggccactggtggggtttaaaagaagcagaattagatctcagctctgagaagttgacaatactgttgctgaaagagtgacttatctaagaggcctgaaaaaaataatttttaatacaactgtttccagatccaccaatgaaatatgcattcattagagcaagaaccctgtgaaaagattaaagagttgtcagatagctaggaaggtgggaaaatgttggaaggtcctaaagggcttaagaggtaaagggattccccaagaaaaggagaaaagggcctgtcctcagaggattatgaatgtttcaaccggctagatttgaactctactgagagacaagcaaagtttcagcctcacacttttctgcatgttgtcattctccacctacttacatagcctagcctcatcccattcacccagttctactttcccaaataaagcacaaaatacctctctctctctccctctttctctatcttccttctctttcttcgcctcctttcctcctttctcctctccactccttacgcccttttctttctctctacacacacactcatgcgcgcgcacacacacacacacacctcaataccaatcaatgacacatgtcaacaaatctgttattgttatcattttattcttattgtgataagagcaactgccatttcttaagcacttattatgcactaggccctgagcttatggattatctcatttaatctttgtaacatccctgcatctttacaactgaggagaccaaagcatggaaaggttaaatgatagttcctagggtcacacagctacaaagtaataaaaccagatttcaacctgggtctgccacgttccacagtctatgtactgttctctgactgacatactgcctcctacattcttaacagttgaacacaactattacctcttcctttagtcttcccttcagccattcttcaaagaccaggtacttagaccctccctatcctggttgtcttcccgtggatgcaatccaattgccaatttccttcttaaggcatggtatccacaaatgaatgtaatatcttgttgtctcagggtaccaggaatccagacaggcaagaggtcaaaaatccaggttaagaggtaaatgagttgcaaaggtgaaggcagagagacagcagagttctaaatgcaggcagaaggtaactgctgtgatgcatactaacggagggttgtgctgaggccctgattctgagggaagggaactcatctattcttctctgggtcagagactttcctgaacacagaaagaaaaatctgcaggttgtcattggtaaggggctatatttctggttggaggagcctattctggttcaggataggccactatcatgaacttctttaaagttccagctaagtaccatgactgcttggccaaaactgttaagacagtagcagggtatctcaattatgaaagaaagaaagacagacagacagacagacagacagaaagaaagaaagaaagaaagaaagaaagaaaggaaggaagaagaaaggaaagaaagaaagaaagaaagaaagaaagaaagaaagaaagaaagaaagaaaggaaagaaagaaagaaagaaagaaaaaaaggacagactatcatggattctttttcttcttcactttaagaactgattaaaagacgtacgaaggaaacagatggctccaattctgattgtgtccatttgccttctgggaaaagtgaagtcaagagagtttttattgaaattcaagctactttttacatctgaataaattaggaaggcccagcgagtacattatcgtgtgagagacggatactaaattcccctgtttgagcagcaataatcagggttgacagtacctgagacatttggtagtttccacagcctgcctaatctattgtgatgagtcttcaactatgagagcatcttgagagcccgcacaataataatagtgaatgactatttggactggattgtgaataaaagactgtacatttgtctgtaatgagaatttcatcgaaaatgaaaataccagagctgtcatattttttaatacttcgatttgcacatccttgactgctttggggcataagaagagaaagtgccgagcaatttgttgtcagctcttgaaataaattatcatttaaacacttactctccacaaaggttattagcttagtagctcgttcctggggttggaccatcagtaggggaaaaaattcaaaagacattaaactaccctttcagaagctgaatattagttactgtggaaattgttctctcggtagcttaacatatttttctgtagctctccaatgctgcagattaggctgcagcaactattaataaatactgtcatattttacagctgtcatgcaaagctgaaaaaaggcttcactgtgattagatcctgtttactgtaatatttccagctcagactcagaaaggcagttttcctataaaggtattttccataagtagaatatttctccagaaaatgacgattaattttaatgtatttttaactccttggtggcagtgaatttgaggttgaattgacttcacagccagagacattcctctctagagacaaattaagctaaaatgtcaaaatttctctcttgggttgtccttcatatgcggaaatggtgctactgtcaggagatgtgcattgagtagccccccacccctatagaaggacaaatctgcactggtttatccaacttcttttaccctgtccctcttgtgaccaattgcattgtttgcaagacagctggtaaggatgttgggtaggaatatcacttcagtaggctagctaaaaattctgcttcctgagctaaaatgtcatcatacgagctaaagaaacagatctctagcccccctacaatgcattagctgtttgaaatggtattcacatctctgaaaaaaaaggaggtgacagctggcagggttgcttttgctctgaccttctattgctttttatcaagctccttgagggaattaaccctcactaagctgaatatctagtttttaatgaataggtagttaattaacccattaagggttatctggagtagtctataaattcagggtttgggcctgaaacatccttgaaaaggttcttccaaatgttccttggggcagggatggacagcggtatagacctgcaactgtgactttgaggtttgtcccttgaagccctttagacaacaattaaagccaaggcagggttgttgtgagagtttaacaagataatgcctctaaagcctttatcatcaagctgaacacagtaacaccccatgctcaatgacttttagctcttattattttattaccattatggaacagtggtcctcaatagagagtgagggtaattttcccccctcagaggacatttggcaatgtctagggacattttagtagtgggtagaggccaggaatgctggtacacatcctacaatgcacaggacagtatccttctccacgctctcaacaaaaaaattatccagcccaagatgtcaacagtgccaaggaagcagcaggccaaataaatggttgcagaaactccttaaggggttggcagtgaaccaatctagcatttattgagtgtctcttactatgcctagatcagtaataacagctctgttcaataagtagagcctttgattctgaagagcttacatcttggccagagagacatattaagattaatgcacagaagcaaatattagtgcaaaacagcataaagcaagagctagattgtgtggtatggatgtgaagtaccgtgggagtccaaagaagagaaatttcatgataggcaggctggactagccagggaaggcttaatggaagaagttataaacgtttctgaggccaccacagaactgcctcccctagcaatgaccttgccttgattactaaggccaagttggtatctagaaccaaaacaacatggcattcccatcaatgctcccaaacgtcacagctcaaggcaagaaatacaattaaaagaaaaaccaaaaaaggaacaatgttccttttactaaatggaaagcaattacagggctgttgaaaataggcagtaaacaaagggagggagggaaatactggcaaaatcccattttctcaactaatcctgtagcaaaagtgcaatttgcaacaaaatcaacagtgctctttccctctctcttgcagtcaaacacactgtctggcatcagtatggctacacatgatgccttagccaaaaagtgcatgcaagcaaggaggacagaatatgaattggagaggagagcagaggttaaggtggagcacagctcacttcacctccaactgaagtctctgtagagcattcccattcagaggaaagagggggcacacatagagactacttcactccctgtcttcctggatcctttccaatcaataggttgccagtgtcggctgctgtcctgctttgtcgactccacaaacgatctgattaattctctggtgctaactgcctcagcaggctttctcagcagtagaacagaggctaattaagatcatgtcaggcgaggaggctgacaggttatgttcctgggctacactgaacttttagagggtgcttcaacttcactgcaggcaggcagtgcttggctaggcgctgattccatagcaggcttcccatttatttccacgggttcctgtgtcaatgggtctccgttttgttaacgatttacatcctcctcctggggataaatagttgctactgtgttgctttcaattgcattacttgggctctctttcatttaaatttttaatatgcttgtaaacaaagataacaattaatagtgaggtcgttttccatcctaaatcacatgtgtgtctgagactgtgtatatgcttttgcatcttatcaacataaagcccacagaggtgaatttaggacaaataaaggaaactctacttctcacagcaggtagaaaatggaggagacatatggaactcattacaccaagtggtggattagactgaagatataaatagctttcccctccccctaaataaaggcttagatgaattcatggatgacagacccatagtgagctattaagggaaacagagatgtttggaaactgaggttggcacaaatcaccaagtagatttttgaatccatatttaccttctcataggcaaatggccacacagagtactggcactctatcctctgtgttttaaaataaaatcttaagaatccaccaagcatctaggagacaggaggaatgctcagaaatagaggaaacttctccaggagcattctgtctggtttcatatagagtctctaaccactgtcaaagataaacaaagctggacatttgttaaagagctaaagactgattttaatcagtaatatactattgcagtagggaaaagcgttcagcataaactgaactcaccttcaatctgtacagaggtggctgggcattttgaagggaaaatgagggaaaggggagggagatgaaagggggcccaatagagtcaggaaagtgaaaagttacaaaaagcaggaaaggggaggtttggcctatgtgaaactcatctgagtttgtcaactggcacttactgaagttaggctcccacccttccatggagactggcagacaggagaactatattgaggtgttgggtgaaacaaacaataaattattttggcagccttgagtcttctcaggcagccactttaaggaagactagaatcttcctagagatgttgtcttgggctattagaaactatgttagtgttttgttctagtctttataggccaaggttgggacggggtggagaagagggctcagaggagcatggtgagaatttggtcaaagaatctttgtcaccacatgtcaagaacactctgttatgagaggtgaatagtcccgttaagggtgttgaagaaaagcatcatcaactcagaacctcagttccaggcccccaactctgccactaagtagctgtgtaatcctgggcaagtcacaatagcttttctggtcctcagattccacatctgtaaaatgacagagtggactccatcattctgcaactaacaattcctgagtgcaggaattttgtgtcagggaagttacaggagttatggaagtgaatgaaacagagtgcctccccttaataagctcacagtttagaagggcagcatggacatataaaaaaataaatacgtaaatacaatctagagtgattccttttgattctaaaattctgtgggctattacaacacttccatttacaattgacccttaaataacatgggagtagggggtttacccacctgtacagttgaaaatccacatataactttggactctctcaaaacttaactactaatagcctactattatctggaagccttaccagataacacaaatgattcattaacacgtattttatatgctatatctattatatactgtattcttacaataaagtgagctagagaaaagaaaatgtcattaagaaaatcataaagaagagaaaatatatttactattctttaagtggaagttgatcatcataaaggtcttcatcctcattgttttcatattaagtaggctgaagaggaagaggaagaggagaagttggtcttgctttctcaggtgtggcagaggcagagaaaaatccgtgtataagtggattcatgcagtcaaacctttatggttcaagggtcacctgtataatgaaactagaacttattttcaaatgaagtttgaaattaactcttaaggagagttatggagacacaaataaccagccacattggctttggaaattggccagaggccttaagtgcactcacatgtttcccttcgtgttcatttctgagccctgaaccctttcaggaccctgatagataggcggcaaaaggaaacaatgcctagatagtagattaggatatcccagtagatcttaaaacccttcctggtagatctccaagccaggggctgacacaacacacttctagcaagttttcttctaacaaggtttgtcagtattctcaacagtggcctctcctccacttaaggcctttactgccatcactcttcgaggtcttaaaacacagacctacataaccatttgcaatttccaggattccttaaaataaaaggagtatttcttctcaaaaatgatatgaatttctaggataaaagataaagcagttttgcttcttgaatatttttgtaatgattcaaaacccttctctatgcaaaacagttgcaatttcacatgggctttccagaggccccaacctctctttccagttctggatccatagtttggtttccctctaaaacctttatcttgatgccctacctggacctcaaactcaatgttctgaattccgaatttattcttttttcccagaaaacttttgcctccacctatgttcccacactcagtgaatggcactgcccagttgcccaaagtagaaacctcatccttgaatcttgcctcttcatcatattgcacatctcatcaccaaagaccttcgtctacgtttccactgccactgactcaagctcaagctcccaccatctcctgcaccattctcctaactgatctccctgatgttaccccctccaccactgataaacagcaatcttcccatcatgtcactcccctgcctaaaagatttcaacaacattcctgttacccctagattctaagcatggcacacaaggcccttcatgatccaacaaaactccaacccactttcctactctcttctccacccatcccttaactactagtgctctatactataaccatatggaactatgctactttcagtatgtcacatggactatgaccttttttccctccattcctttgcaaatacttttcctttttttagcactcagccccctcactccattccccccatacacacacactttatctggtaaatgatatatcttcgaaattctgctgaaatatttgcttccccagaccctagatctccagccccttagccctgctgtgtgtcctcatagctatttatgcagcactggtcttacaatagtattattatttgtttatatgtttaactccctcacaatactatgaacttcttgaagacaagattgttgtcttatttatctctgccaatagtgcctggattattattatttgtaaattgaataactgaatgagtaaatgagataactttagctaaaaacaaaatgtaggattacaggaacattgaggagctagcaaaggacatggccttgagtaggctgtgtcctcagataatacattagatagtcatctacctcctgtgcactggacttgccttgattttgacccaatctccctaccaaaaacattaccttcctggtccgaccaacttagaagcaaaacagatatcttggttctgggaaccttagtcatgggtttctggctagaggacaaagctgcagtgcgccttatggttcctgagtctcagccagtagaatcattaacatatgagtaatctcaagagctagaatgtagatataacgctatttcatataaatcaatggtatttagacagccacatgaattctctaaagacaagagtagcatagtattattttccacagctcctaatgaaaaactaaagaaggaaaactgcttcaaaatgtctgtgtaggcaatgtaacaaggatgaaaaatgatgtgagaactgttataggtagttctcagttatctgaaccagaggaggtaagcttggcacagataatccaaaaggcatttctgtgagcataaaatagtgcctattcataatgcatcttccttcttggttctatctttcttaggcttggctgagcatgggaagtaagggaggttatctcagggataggaatgttttggatgtcccttcaattacatattcccaaaagtcagggagcatccttttgagggactagcagaagtaagatacaaaataattgtatgcagaaatatgagtggatgggggaacacagaagaaaagagagggacactaaatccagggagaaaaagaatagtttcagggccataaagacaaacgttactgatctcacaatgacctgagatccttgttcctgagactataatgtctgacggacacaaataaagaataaacaaaatcaacaataaacatcataagcttagtattttttgctaaagaaatttgatgtgatgttttatacttgcttaagaagctcaaaagaattgcatcagctgtaaaatttccaggttccaacacgcatactacagaactatttcacagaagcattttatacctctgagaggctgagaaaaaggcttccaaagattggtccagtctctttttctcttggaaagctcttggcacaaatgtattccttctgaaaatcctagagaaagaattactggttttcatttggcacagtatgaaaggaagcagtacaatattatttaccaaagctacccattctcttccattttttattccttttgataatataaataataatataaatataaataataataatataaatatgtcatggttcatcagtaaggtagaaaccttaaaaacctttaataatcactttaacaaatgattttttttatcccaccacttctatccacctagcataatgctgaatagtagcatttaaaaaatgaccttagacatgtcaagctagaaaggtctttaaagttcttaaggctgaggtttcaggttctgaaaaatgaattggcccatattttgtcaagttggtgagtctcctaatctgtaattctacttaaaatgtgggattcgaaaaatctaaaggctagccccagatttatcgcgttaagccttttctaccctgtctcaattcttttatctgcataatggcagtaatatactttgtaccctatcttgcaggaataaagaagaatggcatagtgatgtaagctaaaatcaaaatgccgagtatgactgggcaattgcctaaagctaaaagaactgctctgtatataagtgattaagatgcgggaggaaagcctcttccttttgtgcccacgcagtcacagtgctttgtgtaaggctttacccaacagaattgaaagagtcaatgtaccttcccatgttcctcatgtactcacccacccaggagaatgcagtcagttctatctacttctcacatcgattagcaagtcaacaagtcacggcattaaatgctaatcagaacagcggcttttgtggtatactctctgggccatattgtgacgagaaagaatgaccacaggcattaggctctgtgttgtgtggctgtttcctcaccaataaagtgaacataataattgcccctaacttatagaattgttgtatgggttacatccatgaaaggcacctagaacagtttctgccacatagttagcattctgtaagtgcttgccactaccattatgctcttactagggttacaggaaagcagacttctgagacatagaacgaagatctttagctgccctagctgatgtctcccatgccttggtgccaccttgctcatctctccaatgtgctaattttggttttcttctatgagaatcagaacctgttcccaggagaggagctgggaaactcatttacactctatgaaggtagaaacggctgatggacaacgtctctcagacatctctgtggtttaggcaagtgtagaaggcctcgggccaaaggaaggaagtcttgtttttggaatcgcaatactggtgatcagaaagcggaggttcatttccttccaacaatcctaactacatagccagccatccgcctatcccacattttgctaaggttaggcccattgctgcagagaagaatgcaatcagaaaagctggaccaatgcatttttatggctttactgggcatatattttggagaatcataaaaaggaaaatgacattctctttattcacaagcaaacggaagtgcctaaaggcagcttaagctaaacagacttctttggaaattcttgaagtcagtggctccaccaaaaatatatctacattttcatttcttaataagctgagagaaagcaaaaagcatacgtattttctgacatatttttaggctcccctggattcatagtacatattgaatcttagaattgggaaactaagcttagtttacggtcttgcatttgtttggcttaagctggtgactactaggaattgggaggaatggccatgtatctagttccaatttcctttccaagctctcccttcacctgcaggcccatttcctgaggccattgccatatggctggatggacccagtcatttgtgtgtatcatccactaggagggctatgaagagaaagcaaaggacagccattggagagcatgcagaatatttggttattttgtgggagatcatgggaaagattttttgtggccttaaagacaaacaaataaaaagataggatagccactaccctcactgacagcccacataaatctaaagtcagtgttccccaaattcaagcttccctcatcacttgatcgtaggggctgtccccgccaagtggatgctcagaattctgtggtacaatggacctattttctgaatgcaaaaacaggacacatggtctgaaaatacgttttcttttctttctggcttttctaaggcaatcctgaggattcaatcccagctctgacagagattagctgtgtgaccttgggcaacaacctgtctgagcgtctgtaaaatggcaatgattatagtatctacttcattgggctgttatgaaaataaaatgagatactgtgaaagtgcttagcacagtgtctgataaacagaaatactcaacaaagtgtaactattaattatgataaatgattaaaattgtataaaagcatcaacatgaaatcacatttagttagtaatttcacatttagttactaattttatagaaaagaagaaagatacacgaaatttggattgtcctagaaaatcctgggtgttttatcactgtatctgtattcactgtctccccttcagattaataaggcatcttagaagaagagacagaaagaagacaaaaataggaggcaaaggcaaccttctcactgaccccataatttcttatagctgctgataagctatttggagctctgtagatctgattttgtttctagaacccatctgttttcctctctgaatgtgctaacttgaaattagagaagatttccataaactatttgtttcatgatgtcatctaatatgaatctgaaagttcaaaattattgtttaactggaacctactgaaatggaagaccattcagttattctaattaatattattcaaaaggtaacctaccactttacacttccaagcactttccccatgtcttttatcatcattcatacttaatgaggagggcagtgcaggtatattgttgttactttacagattttaaaaatctatatttttagagagggtaagtgatttgtccaagttcacacagctaatgagcagtgaacgcgggactaaagcccgtttcctaacacccagtccaaaaatcttccattacaccagaccactgcacacctttaggacaaaagattattatatccttactgacaatgaaaggctcagcttcagagaaagttttggggccaatgaataatcagttcctcagactaacatccacccttgacgagcattcatgtgccatgctctgggctaagcctattaaatgcatcatttcctttagtcgtcacaaaaattttaccaaggaagtactgtcatgatcctcattttacagatgaggaagtagaggcatgaattaagtaatgtgttcaacatcgcattcctagtaagtggtggagccagtgctagacgccctgattcctaactcccagtgaaagtgttcttcctgtcactccatactgacagccactttcaactctcctattagcaaagaaaggatgttacttttaaagatgctttagggaaaaagggtaactcagtcctctctcaattccacatacaggcagagggggagaagtttagaatacaagcacatcatgcctaatcccaaagccatgaatgtgcaaatgtgggaggacagttaggaacacagagtccagcagagagaactcagggatagggatacatcctctcttacttattcatgccttgggcgtcagtcacatctggttctcagccaaatagaagggcaaagtaggtatagtcagtctgtagtttccttcctcctatggggagcctggggccctaaccacgtttcaacctaccccacagacctcatcaaaactgctctgttcccttttccctagaattccactagatgcatggagccaagtccaagtgttcatggctagggagaatagtggctacccgcctcagtgacatttgctttttaaagaagttccttctaggccttcacctttgagcctctgaatagtgggtgcagaagcaaacctgctttccacccttcccatcccaatctgaggtggggacagccagttaggcgggatgctgaagggttgccttggctaactcactagtaattggaagttgacctttctcattttcttgcctccagaaatcctcccctggggatacaaatgtgtgcaaatcaccctaaagacaggacaggtgaagctccaagtgcacatttagactgggaaagggaaaaatcagttcattatttcaagacctcttgagatgctgtaaatacacagtcaacacagaacaaagatccctttttcccccttacattatttatgtgccatctaaaaattacacacccgttctctttccagcactgagagagagaaacatgcatattcatgatctgataaatatttaagtgggatttatttaaatgagagagtccatttacaaacattccctggctctgagatcttatcctgggcacacagagggaggataatttcctctggtagattcaaaacctccgctggccacctgtccccctaaacttggagctcttccttgagagctggtgaatgccacccgcagtatttcaagggagtcttccgtacctcctccctacagtccggccttcctgctctgagctcatgtcataggatcagtcgttggcaaaatgctagagctggcagtttatttggtagtcgggggaggaagtcacagctttctttgcctgggcccttcgtccccaccacataagcccgatggcagcacccaccactgatattcctagctttcttgtgggaccatcttcccctctcaaggagaacagttatgtgatacaccaggtaaccaggactggttgactgtgctgcccctctctcaggaagacatgcattttaatgcttcaaaagcgttttgtcagtacctgttttcaaaggacttatacatagagtgtttccattcactcctcacaacaatcagatgagaattgacaagaattccaaggcaaaaatcattttcccagccttaaaaatgaagaaataaaaaagagaacccctgcttgcccaacctaagtcacacagtttgtaagttgcagagttaagacttgaacttaggtctgactctaagatctgggatcttttcattatacaaggctgcctctcatcaggaaggaggactggagagaaagcaatggtaacccaaaaggaagactaatggtgacctatcaggcattgtggccacgggggcccaagacctcttcattcctatcatatagatgactttctgtatatgaacttaactctggactttccattctggtgcccattcttggacatcactctgtctctagtcctatcccacttcttctcgctcaaattaaactcacctgttttgtgtctcattttatctagactttatgagatgatcagtgaactcacccatagagctaatctgggctaaggcattaaattaaatgctgattaatggctcaatatgcaacctctcttaggtcatacacattttttgacagaagcttctaaaactttactcaaggatactgtatatgacaaatacttcaagcaatgagccaggccagtgagagcaatatcattgggcaaatgggcttctcaggcctttaacttatgctacctaagtgaccatctattctgcctaatttagggttaccagatgaaatataggacatcccattaaattcagtttcagatgaataacaaatactttttaagtataagcatgtcctaaatatcgcatgggacatacactaaaaattatttgttgtttatttgaaattcaaatttactgtgtttcctgtctttttatttgctagatctggtaacccaaacttaattgtaagatctgttccgctgcgcataaccatcaaaaagtacctattaggcatctgcttcctcatgacacttgcttgtgaccaatcctatagcatggaacactggtggaggggtgagggcaatgagaaagaaaaagcgaaagcagacatgggaaagagtatcccatcatgagactggtcttacctagtcacttgtccatgacataaaagtaatgtcactaggtcttttcagaaaatagaactagtcccatttgcctctcatcaccaacccctcctcccatctgctatgctatactgttctgttctattttgctttttgataaatgaaaaaggaacatgttttggcaaatgccagcccctgtgttctctaagtgatctgggcctcagaaggcatatcccaagcaaacatcaaggtgggatggagggcgctaccaggccactgcacagacagtgaggctgcccaaatgtaattaagcaccaggcgcagaccccaagagtgacagtgggaagaattccatgaccaaaaaaatattagggaagtgaagtggagaatgtttacaaccctaattagcaatttgcacaacaccagaattaaaatttttcccagtgtcaagcaagtttgtagactgacactatggaagctaaactgggcccatgggaaaaggcagcactaggctcctgctagtcagtccagtccagtggctaacgcacctaccaaggcattcaaattgagaaaatgactaaattagaacacaaacagtagactgactcatatgtaagataacaacagaagcgaaggaatgcaaactccagaaatgaggcctttgagtagcaataacaaggataataacaataataataacaataataatataacaatattataaataataataacaaagataattataacaatagcaaacctatgtgagcacttatgtgtcaggcactgttctatatactttgcatgaattcgctcatttaatcctgatgacaatcctatgaggactgtcatccacattttatgggacacagagagattgtgtagcttgcccagattcacacaactattgaatgatgaagcagaaaatcaaacttaggcagtcaggggccaaggcccacatatttgaccactaggctttaccacttctctaatctgttcttgaagacattttcccagaagtgggatggatttactgagcccttcccaccacattttccagtatttcactggtgcaagagacacccatttgtcaaacaggtagaaaggttaaaggtacactgcatggatctagggcagaaggagcctagtgactttctcagcatcatcatgttctaattaaatgaactaaccaccactgggctcttgaaagtatcctagaactacgaatttaaagtgtgaattacacggacacttaaagagatcatacatatctgatagtactttggaacttggaactgaccttgatctgttaagttggctgatatcttagttatcctttaagacacatattaacacctcctccatgaaggctttcccattttcccagttggaagcatttgttcctttaagctccaaatgtgccttttcgtgtatcattgtatctagcttctatctgtctctccaaaaagaatgtaagcattttgaggccaaggattattttatttatatttatatctgcatacatttcccccaaacatacacattgagtatttttaaaacaaataaatttagtctaacccattatttctccatatgaaaagacaaaggcccagagagggaaaatgacttacctagggtcacacagcaggtcagtggctgtctcttgactctcaatccattgctccatccactatccaaggatgcatttctggagattctgaatgggtgcaatttttctcctccatattcttgctattctagtgcattttcttttagttccagaacctgctggtttcaagctttcttttttgaagctcatttggaaaacagtcactctgattcctctccttacaacctactccctcccttgggattactttttccatcctttccataaactctcatatctaggtgatgattttgagactattacattttttaattgacagagatgcagctgggtcctgtataacagctgagcaacacagaatctctccccctttcctccctcactgagccatgagctgatgaaaatttgtaaactatacagaggtatgcctattctatgccagccaatgcactaaaacaattcatggattttatcttatgtcatcctcacaataattctatgatctaggcggtgttactgtttttattttgcaggtgaggacatagaggctcagagagcttaaatgatgctcccaaagttacacagataatacaactggaatttgtatccaggcagtctaactttagtgctcatagccttagtctttacataatcccctctggaacatctcacatgacataattctgccagagaacttttcctaaagtatgtcattattgtgtccttccctactgcctctagagctgtacctctagagcagtgtattagagacagtatggtaactactagacacatgtcgctatttaaacataactttaagttaattatgattaaataaaatttaaaatgaagttcctcagtttaattacccacattgcaaatttcaaaagctagatgcagatagtggctactgtattggacagtgcaaatagagaacatttctatcattgcattttatttctgcaatgaaagctctattggacagcaccactctagaaactaaagtttgaactcctctgcctgttttttttttaactttttttttaattattaaaaaaaaattgtgagtacattgtaggtgtatttattcatggggtacatgagatgttttgatacagacatgcaatgtgaaatacgcacatcatggagaatggggcatccatccccttaagcatttatcctttgagttacaaacaatttaattacattctttaagatattttaaaatatacaattaagtattattgactatagttgccctattgtgctatcaaatagtagatatttcaagtgccctgcagtctggttcctacaaacttttcagcagaaaagcagaaaacaagaagcgaggaatgaagctagaaaaaggggtaggagtctgaggatgaaaggtctcctatgccacactaaggaagtaaggcctcgtgatgtaggaaggacacaatggatttcctctctgagaatagatagagccagtgcatgttgagacctggctcaaactcgcctctctcaggaagcctgagtaaataactacagaggtctgaatatcatgtcactctgttgactggttgctccccaaaagtgacaggaagggttccaacacttacagagaatacaaaggtctcacattcaaaatggattcaaaggacctgttctcaaatcacagttctatgtcgtgttgggacctgccactttgcatcactgagcttgtttacctatctgtgaaatgcagccaataatatctactttcctgattttcatgaccatcaagtaagacaatgaggaaaatgagataatgatgtggggtggggcctagacttttaacttcctcatgtgattctagggaatgccagggttgaaaatccttgaactggatgatctctgaagtcccttccagctttgaaattcgaatcaagctttgactcatagtaagaaaagtcagcagtcattttgaacaaaatagttacctaggtccccacaacaggctgcaggcttcataagcagtcaacgtttcaacgatcacagatagcccagatttccaggtaaagcagcttctttgatgagagtgcagaagcagttccatgtacaatggtgagcattctactcttgagagtgcaggatcagttttggcttcttggaagagtcccctccccaccaggtggcagatgtactccaaaaccctagacaaggactataccaccatttgtttttattgtcctcaaaataagtcatttaaaagagtcaatggatattaaccccttgtcacatgtatagtgtgcaaatattttctcccatgctgtaggttgtgtccccactctgttgattatttcctttgctgttcagaagctttttactttaatatagtcccatttgtctattttggtttttgttgcctgtacttttgaggtcttagccataaaatctttgcctacaccaatgtcctgaagtgtttcccctgtgttttcttccagtacttttatagtttctggtcttacagttaagtttttcatctattttgagtttatttttgcatatgatgagaggtatgggcctaatttctttcttatgcctgtggatatccagatttgccaacaccatgtattaaagaggctgtccttttcccaaatgtgtgctcttggcatcttggccaaaaatcaattggttgtaaatgcatggatttatttctgggttttctattctcttccattggtctatgtgtccatttttatgccagtttcatgctattttggttgttatggctttgtagtatactttgaaatcaagtaatgtgatgcctccagctttgttctttttgctcagaattgcttgggctattctgggccttttgtggttccatataaattttagcatttttttctatttttatgaagaatattattagtatttcaatagggattgcattgagtctgtagatcactttgggtagtatggatattttaacaatattaattctcccaatccatgaacatgggatatattcctatttatttgtgtcttcttcattaagtgaaataagccatgcacagaaagacacacactgcatgatctcagtcatacatggaatctaaaaacattgatcttatagatgtagagaataaaatggtggttaccagaggatagggtggttaggagtgggagtaggtgatgggaagaagttggtcaaaggatacataattacagttatataggaggaagaaatttcaagaaatctattgtgcagcaaggttactataggtaacaatattgtatttttgaaaaatgtaaagacagtggatgttatgtgctcttaccacaaaaataataataataaatttgttaattagctagatctaaccatgacacaatgtatatgtacttcaaaacatcatgttgtacacaataaaaacatacaatgttatctgtcaattaaaaattttttttatatagagccaacagatttcaagtttggacgttggttcaaagctttctcctttcatatggaattgctttgtttcaaggaaatagaagtttcaaaacagcaggcagatggatgtacagaagtatgcaaggtgaagaggactgagaggagctggcagagggaggaagaagtaggcggggaatattctaactaattcagatagcatccctacaagccccagcagaatagcacaacaaagctgatttcccagcatgttaatttcccaaagacttctctattagccagccctctgcacatcaacaacatatggggacctggagttctacctatggctcaggaactctttaaggtcttgaagtacctccctaaattaccaaagaaagacaaaattatgttcaaattgatacaacattataattatattttgctttatatttactctttgaaaatcacaaatccctataaagtgaatagggaagcactctgttaaactagactatttgatgaatcaaggtactccattcccaactgtgcataaaactgaaagtttgaaggattgtagacatttgtaactccatcttgcaaccagagaaaaagaatcaaatgaagatcagcagctcacacttcacaaatgaatatcatagctccaaatagggctcccagggcaaatcattcatcactttcttgattctcaatcacagccacactcctgagttcatcttgaaaagacaccctaaggttttagacatggaaaccaaaacacgcagacatttcttcttttcactatagtctcactttatttcacattcatcttttgcctctaaactgtacaaaaaaaccacttcatctttttttgtggtgcttttgggtctggctatcaaactggttctgtggcggaatgccaaattaaatacactcttttttattattaaaaataaggtagctgaggattagttcatcaaaattctcgggtaatggactgttctaattaaaagaatattctgataaactgggtttagctgcaactacaagaatgttgaaacaacgtatctagtttggtctacttttggcatattttctgaaatgtctggtttcatgtcccaccttaaaaatatgattgaatcttcggtacttgaggctctttcagggttttagagttattattttgaacatctatttttaatgtccagagttagaaatgaatatagataaaactatacatgagctgagttctggacatagctttggtgaaatttccaatgtgagaggtttattgtgtattgcctcttttaagtcaaggacaacggaagaggacaattatgctaactgaagtttctggctaaacaaaatttaatgtaacaatacattcaacttttccatacattttcacacctggattcacttgatcttcattatactctcgggagactgactcttcattttataagctgaaacctagagatgctaagtgacttactcaaggccgagattatcaagtttttgaagtcccagtctagtgttcttttcagcacatgcaatatccatgtcaattctagttttactatatttgtattgacttcctcccaagcaggccacactgagctcagctaatctcaacacagtaggagtaatatatgaatatatactcaaactttagtagcactcagaatagcttaggtgaaagtcatggctaagataatgacagctgccagaagagtgtccttaagcactccagttgagagctatttattttgcataatatgatcttggcatactaaatgttcatttgcatcctcacattgaggacactttacttgtctatggcatcattgtctgtggaaataaattttcttcagaaggttttagtgtctctaacaataactgctggacttctgagtggccaaagaattctagtatttgaaaagaagggagaatgtgtgttcttagattgcttgtatgtcttttaagaaataaaaagaaattatctctgttgatctttatagtaattttatgaagttggtactgcaggtgtcatgattccgttttacagaagtgattcctgagattaaacaagcttgtcatggtaccttaaacctagccacacattccttttcctatggtgcttactaaagctcacttatcatcagaatgccctaggagcatgttacaaatacatatagccttcccagctccttccctgacatcctgaaaattgcctgctccaccaacttcataagatgactatcaagatcaactgataaaattttaattttcttactgaaaatgaaggaattaagacactaaagaatggcagctgcttagagcaataatttaatgattacctgctctgtgatgaacaccacatcccatggtggaggttggataggaataaggacacacaagatacataggactcagagtgtggccttggagagtttataaggtagttggttgccaactaccttatagcagtagttgcaagaaccaactctagcatgcctcagaaatcatctggaggacttgttaaaacaccaattactgggcctcagcctcacagtttctgcttcattaagtctacaggtggaactctgagaatctgcatttttaacaagttcccaggtgatgccaatgctgctagtacaaagaacacaatttgagagtcactagcttaggcatcatttaaaattgtatgactgtcttggagttaaaagtgatatttcagaatatatgcatgaaagaaaattaaaacaaaaggaaacaatgatctgtagtattatacggactaccctgtgtccccctcctctttcccttcactgccctcacagggctacatgtccatgcactgcagtcacagaaataaatctttctgatatctgaaaaacaatcccattttcttaccacaaatgcactggctggcaccacttcaaatggaaacatttgcttccttcactgcctggtttctctagaaataggaaaaccctctgctttagagtccagaaggaggcagaagagaggaccacctctccccatcgccaaaggcagcgtttctcatactccagtcctcagatgaacagtggcagaatcattcggtgtctttattaataacgaaaattacaggctgggagcagtggctcatgcttataatcccaccactttgggaggccaaggtgggcagatcacttaaggccagaagttttagatcagtctggccaacatggcgaaaccctgtctctactaaaaatataagaactagttgtgtgtggttgcacgtgcctgtaatcccagctactggggagactgaggcaagagaatcgcttgtaccagggaggtggaggttgcagtgagccgagattgcaccactgcacttcatcctgggtgacagagtgagacaatgtctcaaaaaatataataatgacagattaaaaatgaaaacatgggtggctggcaagacggccaaataggaacagctccggtctgcagctcccagtgagatcaacacagaaggcaggtgatttctgcatttccaactgatgtacccagcttacttcatggggactggttagacagtgggtgcagcccacgaaaggcgagccaaagcagggtggggcattgcctcatccgggaagcacaaggggtcggggaactccctcccttagccaagggaagccgtgacagactgtgccataaggaatggtgcactctgacccagatactatgcttttcccacagtcttcacaatccatacaccaggagattccctcgggtgcctatgccaccagggccctgggtttcaagcacaaaactgggcagccatttgggcagacaccgagctagctgcaggatttttttttcataccccagtggcatctggaatgccagcgagacagaaccattcactgccctggaaagggggctgaagccagaaatccaagaggtctagctcagcagaccccaccctcatggagcccagcaagctaagatccactggcttgaaattctcgctgccagcacagcactctgaagtcgacctgagatgctggagcttggtggggggaggggcgtccaccattaccgagacttgagtaggcggttttcccctcacagtgtaaacaaagccacctgggaagttcaaactcggcagagcccactgcagcttggcaaagcagctgtaaccagactccctctctagattccccttctctgggcagggcatctctgaaagaaaggcagcagccccagtcaggagcttatagataaaactcctatctctctgggacagagcacctggaggaaggggtggctgtgggcacagcttcagtagacttcagtgttcctgcctgctggctctgaagagagcagcagatctcccagcacagtgctgaagctctgctaagggacagatggcctcctcaagtgggtccctgacccccatgcctcctgactaggagacacctcccaacagggggcaaaagacacctcatacaggagagctccagctggcatctggcaggtggccctatgggacgaatcttccacaggaaggaacaggcagcaatctttgctgttctgcagcctctgctggtaataaccaggcaaacagggtctggagtggacttccagcaaactccagcagactggcagcagaggggcctgactgttagaaggaaaactaacaaacagaaaggaatagcatcaacatcaacaaaaaggatgtccacacagaaaccccatctgaaggtcaccaacatcaaagaccaaaggtagataaatccaagaagataagaaaaaccggcacaaaaaggctgaaaattccaaaaaccagaatgcctcttcaactccaaaggatcacaactcctcgctagcaagggaataaacctggactgagaatgagtttgaggaattgacagaagtaggcttcagagggttggtaatagcaacctcctccgagctaaaggagcatgttttaacccaatgcaaggaagctaagaaccttcaaaaaaggttagaggaattgctaaccagaataaccagtttagagaagaacataaatgacctgatggagctgaaaaacacagcacgagaacttcatggagcatacataagaatcatagctgaatcgatcaagcagaaaaaaaggatatcagagattgaagatccacttaatgaaataaagcgtgaagacaagattagagaaaaaagaatgtaaaggaacaaacaaagcctccaagaaatatgggactgtgtgaaaagactaaaccggcatttgattggtgtacctcaaagtgacagggagaatggaaccaagttggaaaacactattcaggatactatccaggagaacttccccaacctagcaagacaggccaacattcaaattcaggaaatacagagaacaccacaaagatactcctcgagaagagcaaccccaagacacataatcatcagattcaccaaggttgaaatgaaggaaaaaatgttaagggcagccagagagaaaggtcgggttacccacaaagggaagcccatcagactaacagtggatttctcggcagaaaccctacaagccagaagagagtgggggccaatattcaacattcttaaagaaaagaattttcagcccagaatttcatatccagccaaactaagcttcataagcaaagaagaaataaaatcctttacagacaagcaaatgctgagagattttgtcactgccagtcctgccttacaagagctcctgaaggaagcactatatactgaatggaaaaaccggtaccagccaccgcaaaaacatataaattgtaaagaccattgacactatgcagaaactgcaccaaccaatgggcaaaataaccagctggcatcataatgacaggatcaaattcacacataacaatattacccttaaatgtaaacaggataaatgccgcaattaaaagacacagactggcaaattggatcaagagtcaaggcccatcggtgtgctgtattcaggagacccatctcacatgcaaagacacacataggctcaaaataaagggatggaaaaatactttccaagcaaatgaaaagcaaaaaaaaaaaaaaaaaaaaaaagcaggggttgcagtcctagtctctgataaaacagactttaaaccaacaaagaccaaaaaagacaaagaagggaattacataatggtaaagggatcaatgcaacaagaagagctaactatcctaaatatatttgcacccaagacaggagtacccagattcataaagcaagttcttagagacctacaaagagacttagtctcccacacaataacagtgggagattttaacaccccactgtcaatattagacagatcaacaagacagaaaattaacaaggatattcaggacttgaactcagctctggaccaagtggacctaatagaaatctacagaactctccaccccaaatcaacagaatatacattcttctcagcaccacatcacacttattctaaaactgaccacatgattggaagtaaaacactcctcagcaaatgcaaaagaacagaaatcataacaaacagtctctcagaccacagtgcaatcaaattagaactcaggattaagaaactcactcaaaactgcgcgactacctggaaactgaacaacctgctcctgaatgactactgggtaaataacaaaattaaggcagaaataaataagttctttgaaaccaatgagaacaaagacagaatgtaccagcatctctgggatacagctaaagcagtgtttagagggaaatttacagcactaaatgcccacatcagaaagatggaaagatctaaattcgacaccctaacatcacaattaaaagaactagagaagcaagagcaaacaaattcaaaacctagcagaagacaagaaataactaagatcagagcagaacgaaaggagatagagacacgaaaaacccttcaaaaaatcagtgaatccaggagctgctgttttgaaaagattaacgaaatagaccactaaccagactaataaagaataaaagagagaagaatcaaatagacacaataaaaaccgataaagggacatcatcactgatcccacagaaatacaaactaccatcagagagtactataaacacctctacgcaaataaaccagaaaatctagatgaaatggataaattcctggacacacacacccttccaagactaaaccaggaaaaagtcgaatccctgaatacaccaataacaagttccgaaattggggcaataattaatagcctaccaaccaaaaagaaccaaggaccagacggattcgcagccaaattttaccagagatacaaagaggagctggtaccattccttctgaaactattccaaactacagaaaaagagggacatctccctaacttattttatgaggccagcatcatcctgataccaaaacctgggacagacacaacaaaaaaagaaaatttcaggccaatatccctgatgaacatcgatgcaaaaatcctcaataaaatactggcaaaccaaatccagcagcacatcaaaaagcttatccaccacgatcaagttggcttcatccctgggatgcaaagctgattcaacatacgcaaatcaatacacataatccatcacataaacagaaccaatgacaaaaaccacatgattatctcaatagatgcagaaaaggccttcgataagattcagcacccctccatgctaaaaactctcaataaactaggtattgaaggagcatacatcgaaataataagatctatttatgacaaacccacagccagtatcatacagaatgggcaaaagctggaagcattccctttgaaaagagacacaagacaaggatgccatctctcaccattcctattcaacatagtattggaagttccggccagggcaatcaggcaagagaaagaaataaagggtattcatataggaagacaggaagtcaaattgtctctgtttgcagatgacatgattgtatatttagaaaaccccatcgtctcagcccaaaatctccttaagctgataagcaacttcagcaaagtctcaggatacaaaatcaatgtgcaaaaattacaagcattcctatacaccaataatagacaaacagagagccaattcatgagtaaactcccattcacaattgctacaaacaggatataatacctaagaatacaacttacaagggatgtgaaagacctcctcagggacaactacaaaccactgatcaaggaaataagagaggacacaaacaaatagaaaaacattccatgctcatggatagaaagaatcaatatcgtgaaaatggccatattgcccaaagtaatttatagatttaatgctatccccatcaagctaccattgactttcttcacagaattagaaaaaactactttaaatttcataagggaccaaaaaagagcccatatagccaagacaatactaagcaaaaagaacaaagctggaggcatcacgctacctgacttcaaactttactacaaggctgcagtaaccaaaacagcatggtactggtactaaaacagatatatagaccaatggaacagaacagaggcctcagaaataatgccacacatctacaaccatctgatctttgacaaacctgagaaaaacaagcaatggggaaaggattccctatttaataaatggtgttgggaaaactggctagcattatgcagaaaactgaaactggaccccttccttacaccttataaaaaaattaactcaagatggatcatagacttaaatgtaagacctaaaaccatcaaaaccctagaagaaaacctaggcaataccattcaggacataggcatgggcaaagacttcatgactaaaacaccaaaagcaatggcaacaaaagccagaattgacaaatgggatctaattaaactaaagagcttctgcacagcaaaagaaactatcatcgagtgaacaagcaacctacagaatgggagaaaatctttgcaatctatccatctgacaaagggctaatatccagaatctacaaggaacttaaacaaacttacaggaaaaaaaacaaattaccccatctaaaagtgggcaaaggatatgaacagacacttatcaaaagaagacatttacgtggccaacaaacatatgaaaaaaaaagctcatcactactggttattagagaaatgcaaatcaaaaccacaatgagataccatctcaagccagttaaaatggcgatcattaaaaagtcaggaaacaacagatgctggagaggatgtggagaaataggaatgcttttacactgttggtgggagtgcaaattagttcaaccattgtggatgacagtatgatgactcctcaaggatctagaaccagaaataccatttgacccagcaatcgcattactgggtatacacccaaaggattataaattattctactataaagacacatgcacacgtatgtttattgcagcactattcacaatagcaaagacttggaacccacccaaatgcccatcaatgatagactggataaagaaaatgtggcacatatacaccatggaatactatgcagccataaaaaagaatgacttcatgtccttttcagggacaaggatgaagctggaaaccatcattctcagcaaactgatgcaggaacagaaaaccaaacactgcattttctcactcacaagtgggagttgaacaatgagaacacatggacacagaaaggggaacatcacacgctggggcctttcagggtctggggcactaggggagggatagcattaggagaaatacataatgtagatgatgagttgatgagtgcagcaaatcaccatggcacgtgtatacctatgtaacaaacctgcacgttctgctcatgtatcccagaacttaaagtataatttaaaaaaaatatatatatatatataaagataaagataataataaataacggaaattgcagtgacccactacagaccaagtgaatcagaatttctagaagtgagacctgggaatctggaatcttaagtgccttgagtcattgggcttttctgaggcacagtgaaattggagaatccctattaaaagaattttcccaatattcggtttggataaggacactaaaaagtctgatttctcctaactgaccaccacttcccctttcctgcgtcttcatgtcccttgagaaaccttgtgagactggaagagacacaaggctcctccctccttcacccttacacatgaccaccctccacccccccaaccaagacatgtaaatccatttggactgagacatttctgaggttgctaaagtacccaccctagtccctgccaaattccacccagtgaggaaaacattcctttattttttaatgcactttttataatttttttatcttctctgttctaaaatgtttctctctcctgcttctttatgatatattctggagatatttcaaagccatttatacttcatactgatattggtgttttcactgttctgtgaaatgccatagtttatattgaaatgatgcattaagatataggagaaaaagagacattgagagaggaaaaaaatggtgaggaaaataaccgagagcaacattatgagaaagatgaacagacccaagggttggaactctccctcctatagcactaaaatattatcaattcattacttggcatgcacctcttctttctagggtggggaagactttggaagttaggggatgaaatgcaattctttcacctgctttaccagctatgggtctgcccgagtttttgctttttggtttattgtcaagttacagcaaatatatattttgtgtcttctgggctagtcactatataacttacagtttttcattgtgagcttctcaatacaattccacacagagtagattaactaatgaaggtcagaaaacactatggagatataggttgctaggacacagaaccaaacagatgagtcctctatatgggagggggcacccaacatgtgcaattcactaatgctcagttttaattggcttctaaattctgtttctcttgctccctctcctcaaaggactgtgtgtgtgtgtgtgtgtgtgtgtgtgtgtgtgtgtgtgtgtaagggtatatgtataaaaaaattatttgcattagacatcataatcatgttctcaatttatatagcacaataacttttacatttctgcagaggatcttatccaatgctctttttcgcattacttttcaggatcatgcaaatattactgagaatttgaataaaatctgtgaaagtaataaaaagtcatccctacaataattccaaatggagccagaccttttgaaggtggccacttataaggtggggttaatgagcatccaaagtctttctctgacccaaaatgtgtcccttgatttccctgccacagctatcaaaatccatttgttacaatggaggggggtcaccctttgaggctaacacagtggagaactctgctataagttaaagctttaacacacaggcatttattcaattagcttctatcacttcacaaggccctgagggaaacaggacacagaacagattaagctttattggttttaatagtggtagtgaatggagatcaggaaagacctgaaactgggcacactggcatagcaggctgacctggacaaagcaccctactgaggagaactgaatagccaggaactgaaaagccttgaaggtgctggaagcctggtagtaggtagatatgtatctattaagataacaaggctgcaagtagcaaatcttgactatctgtgctttaaataagtagtaaaagccttcaagcaggtagttgtaggcattgtttctgctgcttaagaataccatcaaatggcaacaacagacaccgggaactactactgagagagggagagaagaaggcaagagttgaaaaactgttgggtgctatgctcagtacctgggtggccaaagcaatcataccccaagcttcagcatcacacaatatacaaacctgcacatgtacccctgaatctcaaataaaagttgaaattatttttaaaaaaagaaaagaaaaaaagtacaatttttaagagaaagtataaaagaataacatcaaagacctaagctcttcctttttgcttctccatccttatcacctggctttcacctatatgcttgtttcccattcacatctcgtttgccagaactatattgcatggcccgcctcctcaatatcagttgcaagggagcctgggaaacaaagtatctagctgggcacattgccaccttaaacaaaaccaggattgtgttagcaaagaaggaggaaatagatattgggtaggcaacaaacgatgcctgccaaagaccaaaggagagctctggctgcccttagatcaaccatattcactgggcacctactaggtgccaaacactgtaccatgtgcttggagatctgacttttgcctcaggctaaccagaattcagagaatgaagctactccagagggataaattaccaaaactagcatctagctgtgtgtcaagttttatttttttttcctagccaccaagctgcactgagctttgagaacataatttcatctaatctttcaaattatttggggcagagattcaaacatcagctaacccgctcaatatagggaccatcacaaagaaaggtctttgaattttagctatcaggatcatttttaaaaactgtgcatcagagttattttatgcatgcaaatctctttctgctttttaattggatttgtgcctggatgtactacaaattgcttttaaagatgggctgcagaataggttccagctatggacaccaatacaatggcataggcaggtacttttggtgtcacctcacctccacacctttatttccacacagtctccaatctcatcctacttgctgactagtcggtacaaaggacttcttctaacctaaaaacaacctttgaagacctccccccaccccacaccccaaaaaagcaaatgcaaaatcattaagagctccagaatgatttttactaaggaatttttcctggggattctctctccaaggaaagataaataaacggctctcacaaaagaacgagtctttgctgctttgatgtgaatgaggccaaccagaaaatccctgcagcttaaaacctaagctcagtaacactttgtttttagtaaagtcagaatggaaaaagactttggggaagtcaagaagtggccagtaggattacatggcatagactcttcaaaatccaactttctgcaggctggtagcagtggaatacaaaactgtctaccaaatgtgatttgagaagaaaattcatgcccacagatttctttttaccttggacgatcatggcgaaagtccaagtcccttagggctttctggtaacaggtgcactccatttctagggaaggataatatgttatctgggattagtttatctggttggcctattgtcacccagaagagatcagagccctaagggtatggtaccttctggtgtttttaaattttgagaaataggaaagggatggtttataatttagaatccaagcagaactcagtgaggtgcaccagaaggaacttcaagatagacacggaagagtaggtggccactagacccctgggaagagagtgaaccaaagagaagtaggagagcggcagggctctggaatgagtcaatcatgacacctatctatgccaagcttatgttggaatcaaaagagtatactgaagtgggatatttagacccatttcttaaatgatgcagagtgttacaaagcacccagtatagtgtcttacagacactcatagaaaatatataataaatcctaaccacgaaacatttcataaagtagaaggtttgaggaaggataaggttgatagaaaggcagcaccttagtgaaataaatgaaagtgttcattgatactcctgtaccatccactgcatcccctgtgcttttgcttgcccatacctgatataaaatcccacccaacataacatctctatatatgagtcattagaattcatgggtggggagggtagtaataatttatggagtagaagaaagggactaggtggggaagggacagtaggaaggagaataaaagaagcagttgagggtagaagcaaaacggagaatggctgtgaaagtgcaaagcgaaaatacaggaagaagacactggatattaacataataacaacaataatagtaaaagttatataaggcttactatgtgccaagtcctgttggaagcacctcacgtacattaactcactcttcacaataatcccatgaagtagatttattattatcttccaattttatagattaagacattgaggcatagagtttaagtcaaaataatgatacttataaagcagagacaagggataaagaaagagactgaattctgacatcatttgctctccagatttttcaattaagccaataatgtctttctttcaagtcaatttaagtcaggtttctgtcccttgcaacaaagagtccttgctaataaaaaaaaaaaaaaatctattggctgtttatcatggacaaagtactgggctaagtgtttttatatactttttaaatttaatcctgatgactcaatgagtttggtactgttattattatccctattttgaagatgaagaaactgaggcacagagatattaaataacttacccagagtcatgcagctaataggtagcagaactgagaggtaaactcctgcagtttgacttcacactctgtgcttatcacaaccatactaatctttgatgtgcacacaaataggcagataaaggaagagcatgtcactagccagtagtgaataatggaaactgaaggccacttcattccaactgttccttttaaagagtaacctgataaagttatagccacccattcaaatttccaagaaatcaggtcctatgcaggtgaacatttgtttggagtctcctgactcttgggaaaccattatttttgatggtatgtagccttgactctccagtgaggagtcacttagcactaatagaaactagctctaggattttatgtccccaaaagagactccctttcaaacaggaaaaggaagaagttatggtgaagctatctctgtgggtacggctgggaatacttcttagaacaggaaaccagtagcatcacaccctggaaaccaccataccaagattcacaaagctagcatcaactgagcaaagccttcttccatttcttacgtgcctacagcctctccatataatcaaagcttgcatccttaatggctttcagtcaatccctatgagcattccttcttccacaagtgtactacaattagttgctgtagctttactgcagaaggaactatgtatatgtttttaattttttgttgttttatttttaatgtatacaaatgcctatctgctagcgataactattggccaaagaataatagtctattcaactgggattcaaacagttaaagattacaaatggctttcattgttttataactattagaaggctcccctgataattccttgctgatttatatcttggtctctatttctgcatagtcaccataaaaatgctgtgttaaataatttcatattaaaaaacaaaaccaggatttaatcgtcacttaagaggcaaacgataatttttatcagcctttgcgaatgggccttgtttctccttcattacatgtctataaatgtttgctagttcttaaaggttaaatgactagaaggatagaagagacgtgaatttttaaaaatcagtcactgtttttagctccattctaaaatacatcctgcatgacacagtagatcttctccatgagactagttaataacaagcattctgcatattttataattatgtgcactaccagcagagtgccattggatttatcgcacatttgagcccccagaatcagagtcgtgcttcacactacctatcataacaaatggcatggaggggttctttatgttacaggttactgagttggatatttaaatagcacattcggaagtgttctgagatatggtcaccctgcaagaaaggcaccatccaaagtacactatgatttaagtgtcatggcccatgctggagctagcagctagctgactcagaattgggatctataaaaaaggaaatgaataaaaccctagttgattaggagcagattgatcagaaacatctattgtttctgattgggtttttggcacactccaatttttagatgtaagaggcaagaaacacagacatacataggtcatattacttctttttttcagtagatagtccaattgcctatacctcttttctatctccatcctttaaaatgttggaatgtatcactaagtgatatgtgtgtagaaaccccttctttctctggcataaaaggtattccacacatggagcagtatttctctcactcccaccttagaatgaagggagaatgacctttgtttttccatcatatacatagaaagtttgaagaattttttatttcaatgtgtgcaaaataattactgatgcaaccttgactgtttataccacttttactcatcaacctattatcctcagataatgtctttggatatgaacactaacactggtacaattaactctacattggtatgcttggagtggtgacataacttatcctaggtcccacaacaaggtcgatataaaggacagactagattacaggtctcttgacttctggccgaatgttcttactactgaatggtgttatctgcaacctgtactgcccttggttaatttactttgagaaacatatgcaaaaaaaagtctaggatgttgttttcttaccctatgctcatgaatcaaacttgttcttcttccccctcctgttaccagcaccctccccaattcccaccccaacctccacatatcatttaaaagcctgtgtttccttctactattcaagagactggaacatccagatcatctaactatgacttgagataaatcacgctatgttccctcagaaattactttgacacaaacaattactccaataatatacggtggaaaatagtgttaagtacaatcagcaaatctaaatggcagtaattggcattactaattcttgcacacaaataaataattatactactttccttccaaatttcaatttggacatgcaaagtccacttagttcactggagcagaaaatggaagcctttaccaaagttgacagtccacatgataatgtgtagcctataccttaaactcatctttatattgttcacagtaactgttagcatgaggctttgcatgtagcagggttttaaataaagccttgttaaatgaatggttgttcatgaccagtctctaatttccatattattttttatcccatgagaataaaatgctcgatttcactttgtattgtggtatataatagaagttcttatataacttagtttattaaatatattcaagcatgcctctcccaaagcataccaattatggagaagaccctaaagacactaccctatagccttgctacttaaagtgtggtccatagaccagaagcatcagcatcaactgggagcttgtcagaatttcaggccccatcccagacctatggaatcagaatccacatttacaagattctcatgtgattcccgtgcatgttaaagcttgacaagttctgtgccatgggaacagttgttaatcctgtcacctgactccaatcgtcacactgcacattccagtctataaaacctcttgaacccctatgggtttattaggcactagatagaatacagacaaaggaaaagacatagcttttagcaaggacaatatataatctagctctaattcatgtggtttacattgcagtaatgcaatcatagggaagatcaggtagattgggttgttcagggaaggcttattggaaatggaataatttactaatcagtacttttggaagtggggaaaagtggtaacaatagctaatgtttgtctagtgcttactatctgcaaaggcctcaggttacactttttcatttatcatcccatttaatcctcacattaattcgatgagttaggtttagtgtagtggcaaagtgcgtaggctctaaagtaaaatggtctgagtttgaatcctacctttgctacttactagctgtgagatcttggaaaatattttttttaacttttattttatgttcgggggtacatgtgcaggtttgttacatagataaacttatgtcataggggtttgttgtacagattatttcctcacccagatattaagcctagtacccattagttatttttcctggtcctctcccttctcccaccctccaccctctgagaggcccccgtatgtgtttttcccctctatgtgcctgtgtgttctcatcatttagctcccacttataaataagaacatgcggtatttgtttttctgttcctgtgttagtttgctaaggataatggcctccagctccatcaatgtctcctcaaaggacacgattttttttatgctgttcttttttatgctgcatagtattgcatggtgtatattatgacattttctttatccaatctctctttgatgggcatttaggctgattccatgtctctgctattgtgaatatgctgcaatgaacagtcacatgcatgtgtctttatggtagaaggatttacattcctctgggtatatgcccagtaatgggattgttgggtcaaattacagttctgcttttaggtctctgaggaatcaaaacactgtcttccacaatggttgagctaatttacactcccagcaagggtatataagggtaccattttctccacaacctcaccagcatctgttattttttgactttctaataatagccattctgactgttgtggcatggtatctcattgtgattttcatttacatttctctaatgatcagtgatgttgagcttttttcatatgattattgactgcatgtatgtcttcttttgaaaagtgtctattcatgtccttttgcccactttttaatggggtcgtttgctttttcttgtaaattggtttaagttccttatagatgctatatattatacctttatcagactcatagtttgcaaaaattttttcccattgtgtaggttgtctatttatactgttgatagtttattttgttatgcagaagctctttagtttaattagataccatttgtcaatttttgcttttgttgcagttgcttttggtgtcttcctcatgaaatctttgcccatgcctatgttctgaatgctatttccctggttgtcttccagggtttttatagttttgggttttatatttaagtctttttttcatcttgagttaattttttttatggtgtaaggagtccagtttcaatcttctgcatatggctagtcagctttcccagtactgttcattgaatagggaatttttctccattgcttgtttttgtcaggtttgtcgaagatcagatagttgtaggtgtatggtctcatttctgggttgtctattctgttccattggtcaatgtgtctatttttttgcaccagtaccatgctgttttggttactttagccttgtactatagtatgaagttagacagcatgatgcctccagctttgttcttcttgtttaggattgcttggctattcaggctctttttgtggttccatatgaattttaaaatacttttttatagttttgtgaagaaactccatggtagtttaataggaatagcattgagtctataaattgctttgggcagtatggccattttcacgatattgattcttcctatccatgagtatggaatgtttttccatttgtttgtgtcatctctgatttctttgagcagtggtttgtagttctccttgtagagatcttttggctccctagttagctgtattcctaggtattttattctttctgtggcaattgtgaatgggagtttgttcctaatttagctctaggcttgactgttgtttgtgtataggaatgctagtaatttttgcacatggattttgtatcctgagactttgctgaagttgcttatcagcttaagaagctttggggctgagactatggaattttctagatataggatcatgtcatctgccaacagggatagtttgacttcctctcttcctatttggatgccctttatttatttctcttgcctgattgccctggccagaacttccaatactatgctgaataggagtggtgagagaaggcatccttgtcttgtgctgattttcaagggggaatgcttctcactttttcccattcagtatgacattggctgtgggtttgtcatatatgacttactattttgaggtatgctccttcaatacctagtttatttagagttttttaacataaacagatgttgaattttatcaaaagcattttctgcatatattaaggtaatcatggtttttgtctttaattctgtttatctgatgaatcacatttattgatttgtgtatgttgaaccaatcttgcatcccagggataaagccaacttgatcatgatggattagtttttggatgtgctgctggattcggtttgctagtattttgttgaggattttgcacgtatgttcatctgggatattggcctgaagttttcttttattgttgtgtcgttaccaggatttggtaccaggatgatgctggcctcatagaatgagttagggaggagaccctcctcctcaattttttagaatagtttcagttggaatggttccagctcttctttgtacatgtggtagaattcagctgtgaatctgtctggtcctgggctttttttttttttttttttttttttttggttggtaggctacttactactgcctcaatttcagagctcattattgatcttttcagggatttaatttctccatggttcagtcttgggagggtgtatgtatctaggaatttatgcatttctgactgtttatttgaattttctctcttttcttattagtctagctaatggtctatctattttattaatttcttttcaaaaatccagctccgggattcattgattttttaatggttttttgtttgtttgtttgtttgtttgtttgttttttgtatctcgacctccttcagttcagctctgcttttggttcttgtgttctgctagctttggtatttgtttgcttctggctcattggtttttttagctgtgatgttaggttgttaatttgagatctttctaacttttcgagatgggcatttagtgctataaatttcgctctaacactgccttagctgtgtctcagagattctgatatgttgtatctttgttctcattagttttcaaaaaacttcttgatttttgccttaagttcattatttatccaaaagtcattcaggagcaggttattcaatttccatgtaattgtatggttttgaatgaatttcttagtcttcatttgtaatttgatcgtgctgtggtcccagagactgtttgttacaatttcagttcttttgcatttgctgagaagtgctttacttctgatcacgtggtcaattttagagtatgtgccatgtgccaatgggaggaatatatattctgttgtttttgggtagagagttctgtagatatctatcaggtccgtttggtccagtgttgagttcaagtcctgaatatctttgttaattttctgtctcaacaatctgtctaatcctgtcagtggggtgttgaagtatcccactattattgtctgggagtctaaatctctttgaaggtctctaagaacttgctttttgaatcttggtgctcctgtattaggcgcacatatgtttaggatacttagatcttgttgaattgaaccctttactgttatggaaagaccttcttggacaagatatttaaactctctatgccttagtttcctaatctatagaatggagataatagcagcacctacctctagtacccattagaattaaaggagttaatatgtatgaaacactaagagcaatgcccatcacatagtaaccatccaataaatgtcagatgctactattttcattttatatgtggagaaactgatgcacagagaagttgaataactttttcaaagtcacacagctagtaagtggtggagctagaacttaaatgttgctttgtgtgactacagagctcacactttcaactctttattacataatttaaaatgttcctgaagagggagaaggagaaaactgttctaaatccaaacttttccaatgattatgagcccaatcctcctgtggaagctgggcccacacaagtattaggcaataagctgacaatatttgagatagtgtcttcatataagattccaagcagatttcactatttgcaacaaaattcatcaaaactttaaattgttttcccagcagtggctatggctttgcccagtaatttataatcttctgcctggataacttcgtgaccagacaaaagtaagggatacaggctgcacaaggcctagaataaacgtatctggccctcatgagcctggtatttaagaaatggtgtttctgtgcaaagcacacctttaaaagacagactgaacaccttctgaatagcctggaatcggatcttagacatagaatcagatgtcactggattagagggtagtttttggttctttctaaattctgggtcttattcagatgagattaattctgtgtcaaaatcttggctaagctctcttctgtatgaccttgagacagtcagtatccttctctggacctcagtttccaatatatgtaaaataagactaatgggatggtctctacatgtctttccaattccaatatagtctttacagttttgaaagtgtgttttatccacaccacttctctcctccctggtctttagtgatgtggaaagagcataggctttggaatcagatagacatagggttacctccttgcccccaggacttagaagctgggtgaccttggtcaaaatatgcctctctctggatctcgattctctcctagagatagtaatactcccacctcacagggttaccaggaattgtatgtagtagaaggcatgcaatttactaataaatatctctccctgaatttctgaggatcattatatgggtctattactctatcgtctacacagaaccacttttgtatgcttagagaagtcaagggtaacattggcctgtgtgatcttctaatactgaaacctttccctataagccagaaagatccattgaggagttttaatatcttgataaggtcagagaagggccaaggaagagctattgtaatggtcatggcgtaccccttagcaattctatcctctgtctaagtctaataggacaagtgtttaatattacacactcacaatagaatttcctttctatgacgtgggctcccagagactatttcaaatctgagtttcatagcaaaaactttccactgccaaccccttcacaattttttcaccccagaatggtctcctattacttttaaggactactgcaacatttatttaaagtaaaattaatgttaatgcatttagattttattcagatattgggttgcaggatctagtaagagtgtgtccaagctcctgatcaatcacattggaaagcagaattctcagtagtgggaagaatctagatttgtcattgactaaccaaacaagtcataaaatcattcacttgtttttagagcagtgctttggttcagctaggaaggcttagttccttctagtcaggaaccatatagaaaaatgaaagaacacttccgaagaacatttgtcaccttggtttgggtgacggtgtgatgtatacaggaaaagatgttaaggtgaaataaaatatataatttacccagcaggatatctactgctgggaataggttgtcatccattgatgagagtcataagcttcactatgtaaacattttaaggaaacatatatctgtgaaggcactatggttaaaaagttcatctctttctctgatgtttcatctatgtttcatgttttgcatcgttactcatttcaggcggggtcagtactggtctagttccattctttgcaataaggccatgttatttgacaccacacttcttgaccactccaccccaacttttgctcccatacccaaggagaatcttgactcacttcagacacttcttctgtgaggaggatctcccattagcccccaaagccccacttttagtgctacaaccaaggagaatccagtgaagatatagcatgtgtcagccctaatttcagattccaaaataacatttaaatttctttttacagtaaaatctctatcaaacagagtctgatgggtcagaatcttcaaatagccaaaatttctgcctagagattttagggaaaaaaaaatgatttcaaaaggagcgggtgatatcagggatttagtaaaagtgacagtctccttgggctgctccagggtcagtacacatttagccagttgcctccattttaacttctacagtcctgggtaatgaatacctatgttcagaaagatgaccctgagacattgtaatatccttgggcaccaaaaaagattctgcaatattcagttggttatatttatcaaggaagaaaagtgggcttacatattttatagaaactttcaatggcatttcaataacaacaacaataacaacaacaacaacaaaaagacttcttggtaagcattcaattctacatatgttactgaaaggaacttttccccttcctcctccctttacaatttccaagcatgccacatttccctctggcttttagtgtgtacatctgtaaaatcaaaagattaaattagatgatatctaaggtccctttcacttctgatgtcctgcgattataccatctctgtgatttcttacatggcctctataacttcagtattatgcataattctagcagagtctacctcagtggaaaatatttcctccaggctccttctcttattcagtgccttcgaagtgccaaagaccagggaacagtctcaggaatactagcccaagttgactaagcacagaggttttgcggatcccatctgtaaaggctaccagagtccctttgatgaccaccttcaagagggctaataaggacaactcccatgtaagaagaaaagtccatctgacaagtataaggcagtagtttgaagaattaaataaaggacagtttggcaactgcttccaaaaggctatactggcctggaggtagtttgaaataaagtctgtattactaattgaaaggcaagaagagagtcttggaataaatcagataaaataaataaagagattattttacttattgtcagcaatgccacaggcagtcttggaatttggtggcagtcctatcttcttaagcttttcgttgccaactctcaaaatgttcaaaatccatttctaggtcttctttccaccccatggttataaatcttcaatgacaaaaaagcaaaccttgaaagttctataatgttaaatatttctgaggatacaacccactccccaagtagagctagcacctggatacttcctcccacaagaaagaattgctggagaagcttgcctgagccacatctattaaacttaggcttctaggagtctaagaaaaatgtactgttttcacgtcgagtttataccagctgacctgattttgaacccacacccacccaaacacaatgtaaaactctgctcatgattctaactactggagagtgacttgtttcacttaccaaagagtgtcatgccaagacttaggaactaccaaaatatagcaaaaacccacaaccaaataaataagataaagaaattagagaaatgatgcataagcactatattatctgtatatgttctatatcttaaaatatagattttctacacatacccaaaagatacttcttataccaaaaataaacattgagactttggaagacttgtctcttgcattatccttgtccaattataagggattcgttacctataatgccaatactgctttcgagtttggccattagcatttatttttctgcactgagggaaattctacataggcattttgtatatgtctgagagatgagcatggagagagtggaaagtagaaaatgcacaagaaactgaggcagattctcctttcctctagcatcaggcctttatagttaaattcattcccacagcatgcagacacattcaaacaaagtataaaataggttacacaattaaatacaagtgagtttaagcatattcactatttggtactattcgaaccttggattccctgtccccgttgcaaataattgagaaaagtaagttttaaagcataggtagacagaatagctgaagatgggaggtggtgggggaagatgggttgggtagactaaatggtctattgagacttccacttgctctatcattctgttaggagtcattgacgttaatgttcttagactattctgtatgcataaggcaaattataatagaccctcagattgatcattcaagaatctgagggctgttttgaaagatggagcttaagttcttttcttattcatcccttgggtatgtggataattcaaaagcaagtaatagacatgtctgttgggtctacctggcttattggccagtttgatctttaatattatacagtcactactctagctttatctaaggctttatgattcccttatgccaccaaatcgcaagttgaccagatattacacgtgcaaacacaaggctcagagagcagaacaggtgactactgtggctgtgccccagacacactcttccctagaaagaagggagggagtaaattaacatttagtgagtacctactatgtgccaagtactgtgctaataacttccacatacattctaaagcatgttctacattggaagcagggttgatctattcaaataatatatgatacattggaaagtagaagaagagaggggtgttgcacctgggaatcaataaatccaacagcaaaatattgattcaagaaatactagcaacctctggccagagaagcttaccttccaaaaagatataatcacagcctcagccagctgaagataggaatgtcaaaaggctcaggggaggatgcatatctttcgaaatgatcacaacagcagtatttctccaagctacattgagctttcttggcaccacagacagagtaggggagcctagggttgaaccaacatacttgtacccatccagctgtgcccacatatctgccacctccagataaccctctctctagccctggggcacaagctgatcacacaccattttctgaaaataattcttctttgtcttgctccagggactttggcagagaattggggaagatgctttgtgcatcctgtggcactcaactatctaatgccgaaagcttgcagccaggggaggtttgtccaaatgtctgacctaaaagggccatggcttcacttcttttctaattaggataattaacctcccctgctcattcatcctgttccaatccaaaaagctcaaattaaaatggcacaggagactgtcaggctctagggacaagagacagtttacaagtctttcatttccatgccaccaccatcaaggcaaagccaggacaaagttgtcacagcaactttacccttgaaacaaccttggggcccctggaaggccactttcagaattttcatcaatgtaaatactccatcagctataaaattttgcacagctccataacacttgctgactaaattggggcagaagggagggacagggaagatgataataggagataacatttctctttctattgtcatgtggattctgtggttggtccaaggagaacaaaaactagatgctttgagttggtaggatttgatatgggattcagggaatgtattctttgggaacaatcactggaggcaaaactttgggagcatttaaaaaactggaagcaaatagcagcacttcaagcagggcagagacacaactaaggggaagcaattctacagttcttcctctgatgactttaactgtcctttccccacctctgagcaggttttagagtttcatatcagatgcccaggcagataggactgatgactgtcctctggatctcttgcccctccctactctaggattcagtccagcatcttcactacatgcagcccttcctacctacctgtgtgggaagccactgtgcgctgtagtctcggtgccaagaattcgttggctacagacctttgtgagcctccatggctgataggaaaggcaacggacaacaggttaatagatgagattgtgctgctcatttggactgagtactgaaaagttctttccagcccagtagtgttgattttccctgggtctgccttgtttggaatatctccagtagtgaagaccctgacttgcaactcagtatgtcctagatccatctacataaatttttcagcatgttaacagctttgacttgggcctaggttgagcaagttggtcactctctaaactttgccaaatcatgtcctggtcccctgctagccctacactgttcatgtcccatccataatctccactgcagcctgggcctttcctgctcttgaattaccaatctgtgttaaccagccaaagcgtagttctcagtcgttatacaagaatgactaggccagtgcttctcaaattttgatgggctaatgaatcacctgagaagcttgttaaaatgtacattctggttcattaagtctagagtggggcccaagagtatgcagttctaacaatcagccttggtgatgccaatgctgctgatccatagaccatactttaagtagcaagtagagcatctttagggtcttctctgtaattgatatgctgatgtagaggccacactttaagtagcaaaaacatatgctcatttcccaaatgagttagacccgacttggctgcttgaaataagacattgtggcacatcaacctctcttcttggcagtcaacaatagcatcctttcatattaaggctaaaagaatttttagggtaaccagggctgtgcagagggtgtgacaaatgtgaaccttagtgtagagtattcttcttaggacttgggttactggaaaaaagccttcctgggcacctgaagccaatcatgcaggccaaactcatttcgtatccagccactccattcatcgcacccactttcatagtggttctggatggctgctgccgccacatcactcatgctgtgatctgcatcagtggttgagacaacggaagcagctacatcatccaagccacaatccatttatttcatgctaagaaaaacaatcttctatccaagtggggcaagctaagctgggcagttgccacaactttaaggttataggaaatatgccttttgcgctatttacctcctcagtggagagcaatgacccccttgaagaggacccagatttcatcagtgcatcagtgccatgccaggcagagcaagcccatttctcctctgaggcataaggcgtataactcctggagttgtttaaacatagattttcaggccaggcgcagtggctcatacctgtaatcccaacattttgggaggctgaggcaggtggatcacttgaggtcaggagctcaagaccagcctggtcaacgtggtgaaaccctgtctctactaaaaatacaaaaaaattaacagggcctggtggcacatgcctgtagtcccgagaggtggaggttgaacctgggaggtggaggttgcagtgagccaagatcgtgccactgcactccagcctgggtgacagagagatactctggaaaaaaaaaaaaaagccataagttttccagagaaactaactgccttgtttctcgtttctctctaaaggtaattcttgaatcctttcctctttagcattgctgctgattgtgttctttgctcaaataatagctaataaacttcaaagaacatttgtatttgttttgagggatgctctgttatgttgatatttacagagttaaacactgcagatggggagttttccctaagaagattccaaagcattatgattttgtggttttgatccaaaatatatacatgttttatggcctaagggggttgtcaaacagtgttttaaaaaacactggcaaatttaagatgcctttaaaagtaggacagcttggggatccagaagggccccacacctacatttcccagtggctgtgtagaaacaagtcttgctgggctggcctattgctggctctggtggggtctccaagctaaaggagtagtcctcattaactttttccctcttatccactatccctgcccacctaggcaggttactaaactctcctggagagcttaataaatactttcatcttcacaggacctgacaactccattttcctcaaaatgatacataagacttaagacactggccaaggggatcagatgcccagccaagaggaactgaaccattttgttaagttctgtcaatgagtactttgcctgaatgagcatagaagctctttgggcatggccaactagtccctgcactgacccagtcattatgatggctagctatgtgatttataattagattcattttattcaaataaattcctagccagtatggtttcccagaagtccatctcaagagttgtcatcttaactctaagtgactcagggctttccccctgtaaactctccagccccagattctagtttgctgaagcactcctaaattcagtcactgccatgtggttgtttgttctttgcaaatattatagttagctcagctgggtatatcccctggttaaatgaagccaaagtcatgactttgatgactgctagtgccagtcagcttacttctcatccagagatctagacttttccctccatcttggccagccaaccttcttagtaatctatgccatcaatggcaaagaagactagatcaaatggtgagctggctttgcttacatctctttgctttatgctccacagctctagacaaagtgttaatttccaagtgaaatattatttgggaacaatcagggtaagggagcagaaatctttagaaatatattttctctatctctcctcctttcatattatctttcctttttttctaaattctagcctccttttgtctcttatcaaaatagaattctcaaccaggcatggtggctcacacctgtaatcccaacactttgggaggccaaggcgggcggatcacttgaggacaggggttcaagaccagtctggccaatatggcgaaagcctgtctttactaaaaatacaaaaactagccaggtgtggtggcacacacttgcaatcccagctactcaggaggctgaggcacgagaacctcttgaacccaggacatagaggttgcagtgagccgagatcatgccactgcactctatcctgggcaacacagtgagaatctgtcaaaaaaaaaaaaaaaaagaaattctcttgatctgtcctgcaaattctgacagtacctatttatacaatccttatgggactcccaggaatagaatatcattttacagatgaggaaactgagtcccagaatggaaaaaaacaaccacatgctcatgtattttaatgaggtccccaagacttttttagaaggtaaatcttagattgcacgcaagttcaaacatttataatgccttctctgaactttctcctatgggcaaagaaaaaggttggaaagtttttgagaatgagcatggctgtaacataatcaaaagagtgaagaagttaaagctgaccttagtgagaagcttgcatgaaagaggactgctggagtagcccaagcatgtaccaataataacttcagaatagctggtactaattagagcgtaaagaatgtggcagaacacaaagaattaatatatttgactttgtgtactcttagggcagtggaaggctccaagatagtattcaaattttgtaactaggaaatttgacagaaataagaaagtcagaagaaaccgctgctttggaggcagggatatctgagagagtgtgaagaataagtaaggacacaaacaataataaaacctgcccagtctaggaactccagctcaattacaaagttggtgattaactgacaggaaacataccattagccagagaaccatgactgtgtttcttttaagcactgacttacaattgattgcatggcctgtatccctgtgagcctgaaaaatcctgggcatcttcaggtatttacacaacaatgtgttctagagccctccctgccatggagtaacacatagaaaaatgtatgattccaactttcctggacaactgcacatgttggaataatttcagtcactgatggggggaagaaataagagtgcgaacttagaatccagactagttaagtgtttttcttcatgaacatgtgcgtctctgagcctcaatttcctcacctggttatttgggataactatgtactctttaagattggaagaattaaacgtgataatgtgtatacattgttagctctgtactcagcccaaagtagacaataaatgttcatttctatccttgaccccgccttgacagcccaagggaaaatagttcaatttaaaacctgagggatgagagtaaaaacattatacatcacaatacaagaaaaccacaaatctcttagtcaaaaaatgatttaaatttggcattcagctataatccctcagagatgggagtaaccatctatagcctaagattctcaggctaatagaagatggatgtgagagctcggaatcttcgtttcccactatctcaatcagatgatctgttcagtgatacgtattttaaggtgagtcttaatgaatgaaaggtttgtgggatggaagtgaggctttgtggtggagggcaaccagagtaaatcatgagagatggaaaatgctggagaaggctgtgccttgcatgagaatttgtgtgagtaagcagggtgaaccaagccaaaggctttggagcctgcgtagattagagtgggcctcagtgccaaatgggagtcccagctagatttgaggaggaagatatgctttaacacacaaacttgtttgtgggctctctcactcctccatgcaaaggtactgaaggaaaggagaagagcccttaaggaagtcacagatgtgttgtaggcaaagtgcaagggatatatccatcatgacattcctattggattttaacttttagtctatatcaaaatgaatctttattcagaaaatgccacagaaactttgttttacattaatattgaaagttaaaagaagacaagtattgtggtcatggtcaagtttgggatctatcattggggcaaaccattttgtctttctgggcttcagtttcttattggcacaatgaagagattgggaccatcactaattctggctctcatatttgagaattctgagaaacttggaagaactctggccaccacaaacagcctgacttctctgcagctcacacaagattcagccactctttctggaacccaaggccttgacattagcctataacccgcctccataatgccaaattcactctcatatccccattggaaaaaactcaattgaaagtaaacaactaatcaaagtgagttgatcttgggggtgttttacgtgggtttctttagtatggtggatggcacatgaaaatacttatttatcttgtgagttttgaaccccattttgggtgtttcccaagcagattttaaaccacagtattaagtcaaaaagaacttgtcttccgcaagagaacagcatgttctctgttgtcctcaggactgtatctttggctcctctgtaccctctaggcaagagtttgcccttaatattacctttgacagccctccaatggtattaggatcaaggagtctcagcactcctggaggcacagcaggcagaataagctacagtcctttgcactcagatccagacacttttcatctttggcatacattcacccccacttccttcccccttttccttctcactggtaaccatcattcatacctcacacccagaactcagaaatgttaagaggtttatcttggccttgctttttaaaaattgagaatgctgaagaatgttcccagataagtgacttgcctgatgagaagccttttgcttagtggaacctaaacacatactttctgagctcaagtctcacttcagtcagttcactttacaagtccataggcacaggccacaatgtgaactactctgcacagaagttcagggtatggatgctcaatataaaatatactcacttctgggaatctcttcaaagttcatcttctgctggagaaggggcagcagggtgggtggtcatcttcttctttgtagtcactaggttccatgtggaataaatgggacctgggaagaagatgtactgtggctgactggtagcactccttcctccaacccataagtgaagcccccttttaatcatgcataaggccttccccccactgccacccaactagggctggcaagtgcattctctggttgtgatctatggtcagctctctgccccgggtatctataaagtgcttactaacatccatgtcactcactacttgctctctaggagacgcagtcacaagatcagagctggaaattacggatttcaaagggattaagatgccgaatgaggaaatgtcatgtaagaaaccctattcatgggcatgattaatcctctcatggcatctgttaagagctcaacagtccatggagaaactttgagatgactcctgccctctgtgagtttgcatcgcaggcagtctatcccagaacaattatttagataccaaacagaaacatgaaggaactacacacaatcattgtagcatccccttcaatccaaaccccagttgctttctgttatttttattttttttattttttatatcagatattgtgtgggtgaggatcagaggcttgcctattctgctcttcccagatgttaagtaaatctactccagatggtcttctaaatttcctttcagctgacaatgcaaagcaagtttactttcactcaatgaaactgacatatctatttgggcatgttttcttagctcacagagaggagaatggagctacataattcaccaacagggagacaaagttcaaataaggaacaagatgaaagagaaaaatggaaaaggcaggattacatgcattgccagcttcagagccaaggttacacttgactagtagtcagtagctgcctcctggagtgagctattggagtacttggaatgcctcaagtaagatattggggtacctgttagctcaagttgccaaacaatacttgatcaatcacttacggctgtctacaatttgcccctgtattgtaagtctttggttctaatattaaaacatacatccttcatgaaggaggtcacagttgaagctgttatcagtcatggacagtctagtataagagtttcgtttggattgagagacaatttgtattgggagagaagaaaaagcacaaacaactgggaaactggggtcaccttctgttcaatgattccacaaattagccaagtactcatcctaataatgcagctgcaaggagaagaagatttgcagagggtcagctcttaattaaaggaaaatttaaacaaatacaattataaggaatggaagtctcagggaaatattaatttgctaacggtaaattaaggattgaatgtcggtgaatatttgtctttaccttgttccataaaattcacagactgacatccatatgcaaatataaaggggttcttgatcttcccatatcaaactcttcacacacagaacagtttctgtattagcgtctcaaatttagacaatcactatattgattttgatggaaaataaaagggtttaaatcaagttaaaacaaaaacaaacaacaaaacaacaaaatgtggattcaaatgtgctatagaagtctttccatgaattatttttaaatgaaagtatactttgtaatatgaatagtaatagcctgaagtactggctctgagttcagatttttgtatatcaggtttctgagatatgggaaaacataccatgaaataactaaattgagctcatcatctttctctttcctctgcctctattttttctttacttctgtctcagaaaccaccttcacactccatatctagcttctccattgctttacttggccacaatatgcaagggaaatttattggaaattccatggagaccaaagacattgcaagaaatggaaagagtggttggcataagtttggatttaaagcccatgtgagcactagaataagagtagaagagcaaattttggtcaggcacagtggctcacacctgtaatcccagcattttgggaagccaaggcaggtggattgcttgagcccaagagtttcagaccagcctgggcaacatagcaagaccccatctctaaaaaaaaaaaaaaaaagcaaattttattcgtcattcacgtgattttttgatgaaaaagaatattaatttcattaaaatgtcaaacttttattcatgacaatgtatcataaatattaaaagtaaaatacactggattaaatatatggcatatgtcaagatacttaatgtcaatatataaaggctcttataaatcaataataaagacattaacatcactaaaaagttggacaaaggaaataaacaggcagtactcgaaatgatgaataaacatggacaaaaaaataaaaaagtcactagctttactaataaagaaatgctaacaaaaaaagagaatcctctttattcacctaccaaatgggcaaatatattgttcagtgctggcaaggggacagagagacaagtactctcataacctgctaatgggaacacaaagtgggacaacctttctggagggcaatctggcagtatgtatcaagagccttaaacatgtccgtaaatgtttggcccagtattcctactttgagatattaattctatgaaaataattagagatgctgtatgagtgttgtcagcacggcattattcataataaggagagattggaaaacactgaaatgttcatgttgcagaatagttaaataagttatagtatgtctaaaggttggaatactatgtcatcattaaaactcatgtttgaaaatgtctaataacaagaaaatgttcatgatataatgctagattttttaaaggcaagacacaaatacagtcatgcgccacataatggcattttagtcaatgacagactccatatatgacagtggtcccataaaattataatactatacttttactgtgtcttttctatgattagatatgcttagatacacaaatatttaacactgtgctacagttgcctactgtattagttcgttttcatgctgctgataaagacatacccaaaactgggaacaaaaaaaggtttaattggacttacagtcccacatggctggggaggcctcagaattatggcgggaggcaaaaggcacttcttacatggtggcggcaagaaaaaatgaggaggaagcaaaagcagaaacctctgataaacccatcagatctcttgagacttattcactatcatgagaataggatgagaaaaaccagcccccatgatctaattaactcccctgggcccctcccacaacacagggaaattctaggagatacaatttaagttgagatttgggtggggacacagccaaaccatatcattctgccctggcctctccaaatctcatgtcctcacatttcaaaaccaatcatgccttcccaacagtcccccaaagtcttaactcatttcagcattaatccaaaagtccacagtccaaagtctcatctgagacaaggcaaatcccttccacctatgagcctgtaaaatcaaaagcaagctagttgcttcttagatacaatggaggtacaggtattttgtaaatacagccattccaaatgagagtgatttgccaaaacaaaggggttacagggcccatgtaagtccaaaatccaacagggtagtcaaattttaaagctccaaaatgatctcctttgactccaggtcacactgatgcaagaggtgggttcccatggtcgtgggcagctccacccctgtggctttgcagggtacagccttcctcccagctgctttcatgggctagtgttgagtgtctgcggcttttccaggtgcacggtgcaagctgtcagtggatctaccattctgggatctggaggatggtgcttctcttctcacagctccattaggcagtgccccagtagggactctgtgtaggggctctgaccccacatttcccttccgcattgccctggcagaggttctccatgagggtcccacccctgcagcaaacttttgcctgggcatccaggcatttccatacatcttctgaaatccaggcagaggtttccaaaccccaattcttgacttctgtgctgccacaggctcaacaccacatggaagccgccaaggcttggggcttccaccctctgaagctgcagcctgagctctacgttggcccctttcagccatggctggagcagctgggacacaaggcaccaagtccctgggctgcacacagcacggggaccctgggcctggcccacaaaaccactttttcttcctaggtctctgggcctgtgatgggaggggctgctgtgaaggtctctgacatggcctggagacattttccccccatggtcttggggattaacgttaggctccttgctatttatgcaaatttctgcagcccggttgaatttctcctcaacaaatgtttttttcttgtctactgcatcgtcaggctgcaaattttctgaactttaatgctctgtttccctttaaagatggagtgcttttaacagcacccaagttttaaatgctttgctgcttagaaatttcttctgccagataccctaaatcatctctctcaagttcaaagttccacagatctctagggcaagggcaaaatgccaccagtctctttgctaaaacataacaagagtcacctttgctccagttcccaacaagttcctcatctccatgtgagaccacctcagcctggaccttattgttcatatcactatcagcatttttgtcaaagcaattcgacaagtctctaggaggttccaaactttcccacattttcctgtcttcttctgagccctccaaactgttccaacctctgtctgttacccagtttgaaagtcgcttccacatttttgggtatcttttcagcaacgccccactctactggtaccaatttactgtattagttcattttcacactgctgataaagacatacccgaaagtgggaacaaaaagacgtttaatatggacgtacagttccacatggctggggaagcctcggaatcatggcaggaagcaaaaggcacttcttacatggcagcggcaaggaaaaatgaggaggaagcaaaagcagaaacccctgataaacccatcagatcttgtgaaacttattcactatcacaggaatagcacatgaaagcccaacccccgtgattcaattacctccccctgggccactccaacaacacaggggaattctgggagatacaattcaaattgaggtttgggtggggatacagccaaaccatatcacctacagtattcagtacagtaacatgctgtacagttttgtatcctaggagcaatacgctatgccatatagcctaagtgtgtaggaggctattccatgtaggtttgtggaatacactctatgatgtttgcacaatgacaaagtcacctaacaacgcatttctcagaacgtatccccatcattaagtgatcaatgactgcattacaatccattttgctaaaataaaaagtgtgaagtctatttatataaaacagaatgtaaagagggataaagtcacctatactttttcttttaatttttgtactttctgtgtttttccaaatgtccaaactgagcatattaattttatacttagagagaaacacccagatgctacctcagaaaaggaaagatatttgtaaagtgctttgagtacatctgggtttgcttcccacatactgtactcaaggtttccagattcttcatctaccacaggaagaagcaatttgtaaacctggcctgagccctcccttcttgcctctgtgtctttatttgctgatgtctaggtagtatatggcccttcttgaaacatgcctttctcacccagaacctttctgctggtcatgaagaacacctcaggaaaaaaaaaaaaaaaaaggcctgctttaatatgccacatttgtattgggtagcccttagaataggtcagtgattctccactctggctgtacatgagaatcccccagggagattaaaataaaacaaaacaaagcccaggaatcactttgagaaatcattattttattgctccagagtaagccttggccatccatttttcatacttcctagggtaactgtaatgtgcaaccagcattgaaagccacagaggtaggtgaagacacagaaaaggaaagaaagaaatggttttttcagctgatttcagttgagtaacatagacaggaatggacactaaccttctgtggacctgtctcaccattgtcttcccactccactggcccctgagataccccatatctacaagctgttcatttgttaaactccgtaagatcatcaagcacatcaccaactttcaaattcatcatctgaatgaccccataagatgggcagactcaaaaacaatgttaacattctcttttgttttccttccaaactcattcatgttaaggtcactgctaaaatgtacgtgtgttcgctgaaaggataacatgttatgccattagctatttttacgctggcacctggaaaagggaagggtgctgagggaattgagcacaggataggaaagttttaatatggggaaagaggaagaaaaagactgggattggtagtgataggcctactcaaggtactggggagacagggaagcgaacatcaggatgttgtgtgacatcaaaaagagaagagaaaaggacatgaggaattaagttctgtccacaccaaaatgttgctaagcgtcatcttaaaatgagagctataaagtaagttggacatgatgcacttgaaagaccactaaattggaagccaagagacttgcttacagggtcaatactagggcaaggtaagtgcggctgcacttgtgcaaccctcagaaagtgccttcttgaatatttaccctaggtgcttcacctgcctcaccttagctccagctctgcttgcttagattccagtctcgcttcagattctaaactgtgtgatatttggcaagtcacttcccctgtctaagcaccacctctcaaacccgagaagctccacttttacctgtctaagctattgggcttccataaaaatttcatttgaaaagagttacacagctttaaaaattgtatcctacttctctgagtcatctgtaagagtactagcctgtaatactgtggttctgtgtctaataattgtaagctacaggagttttcatgggccacttaaagcctctctttatcaacctgaaaatattgacaaggtaatttctagcacaggccactggaaaagtattgaattaccctctgggaaagaccaacttgcctctctatagaacatttcgagagggccagtaaacctttttggggctttatggcaaaccctctgagaatcacagccaggcacaaattgctataaatgtcaacactcatgagaagcctgttcatcaatatcagcaacttccatcatttgggggactgttaaaagaccccgtcagaagtacaaatgctgtggctctgagagatctggtgcagattcacagctgacagcaggtggtgatagtccctgctggaagatgcacaacaggaacaaaattatcctcaactatattttcttgggtatctttattatgaacttccatatgtcaatatcctacttattgttcttctgtgttttcagatgaaatactaaatgtgttcagcatggagcgggttttcacttgtttatacatttaacaaaatcctggccttctttcccctgtgaaaatgattttgacaattgtatatttgagaactttttgtatctgatgctatccctgtcatgagatcaacctcatagtcacagatgaatcccccagaaataaactgaaatagagattcacatgcaagaagtttattggctggtactctcattgtcagcaattgtgggaagaagagaaggatgcaggtgagggcacaaagagaaaatgagctatggtgcagtcataacaaaccctcagctcccttccgggagctctgaagctaggatgacttgcccttagagttacctcgctgggggtatgagggttgtgcctttctatcctggggcaatcggtcattggatgcaggataccccaggaaagggtcataaccttaagctgcaacttttccaacaactgaaggaataagttctatggtgctgaaggaggatctgggtggtacagcacagcatccaccacactaccctttgccaagattatcacaccttatttgccaagagtagcccaaccaccactccagtaggattaaattggtcatagctgcagcccagttcttcatccataatttccttcccactccttgccacaaactgcattatattggtaaaatgcagatgacaatctagcattcacccacttacctatatggtaactaccattctttaaaatgaggaagaagaggaaagtggatagcgacagcagtctggaatcagaatgagagaatttgctgctcaagtaaaagtagtttttagtgttgcaaaattgggcacgttaaagctcacagagagtggatgacaattctgaagctgctaaaacagcaggcttatttttacaaagccaagggtttgttacgtacctctgctcctacaagcaccaatgcctgtttttttctctgcctcctgtgtcaaatttttctctttttttttctccctcaagcgcatatttactctctttggtcagcttcatcaggaaacagtcaaactacaataaattaggtatgaaaacaaataaaagcttttcttgggctgctcagtgacaggtacggagctgaggtgaccattccccccagggttctatagtacacagccacatgcttaagcaaacacagagaaattctgcatggtaaaagacactgcagtattcagccacggttctgacttgctcaaaaaatgtgagcaaggcttatagcccaggaagcttcagacatgccctcattaaaaagcagtgtgctttttctacttaatttttgaataggtaatacattcacatggttcaaagaacaaaagtataaaaagatttgtaagtcagtgtttagtaaaatgcctctcatttgtggcagtatgcagcctacaaaggagctctcatctatcatctatgtcttccagaagcctatgttctgagaggacagcatgagttgtacttctttttaatctttattgtttttgtacttacagaaaataatacctgcttcttgtaaaagggccaaattttacataactaaatgacagtgaaaataaaagttcttggtaatcctacatctcagagataacagccaattccttcagattttttccacacatatagaaacatatagtttctttacaaaatagaattataacataaatgccattttacagcttgttttttctattattacctattatccaatatattatatatactgtacaaatcttttcttgttagtatatatagattgagctgtcttttaaacaatagcatagtattctatgcgtatttactataatttctttatgcagttttattttaaaattttaaatgtctgtgacataattctttaaacccatttctccattgcttataattaatttaccatgaacttaaatctactcatttctggagaagttaatgagaagtcagtaaaggaagtttcatggacaaagaagataattcagaaaggtctgcaggtgtagacagatgtgcctgttaagtggacagacaagtgtggctgcctggagtactgaataagtgagtgaggccattttccagatttgaatgaatttgaaaataagggagaagtggggactggaatggggtgagggattaaacaaagggagataaaagcaaattggaatggaagaaatcttgatacacggatggtgagtctttccagacgaaagatttttatggagagaactgacacgttttagttgaatccaagcttgatactaattaacaatataatttgggtatttaaaaatattggcaaaggctgctaaaataacaacccacgtcaaagcaagcaataatctcattgtcgtccacactgatcagatcacactggaattatcaggatcaataaaatattgacagatatccataggagagagcaacagtgagggaacttgtcatcatgccataaaagtaacggtggaaggactgggacgtctttagcctgaggaaaagaatgttaaagggaaacatgctaactgccttcaaaaatgtgaaggactaacacatgcaaaaggagttaaatttgctctgtgtcatcccaaatggtggaataagaccaatgagtagagattacgagaaggcttattttgattcaacacatgaacagctgtattctgctaaagggcctttaaaaaagtttactttaaatatattaaagactctgtccactttcattaacattattatttagccaatgttttcttcataaatagtacaaaagtaaaattcaactcagtccttgatgaagtttcataaattcttaattagtgagattcaaaataatgaggctttatcgtacactgcttgagaaagattttcaattgccttaatctctttcttcctatgtttatttctcaatcccatgccttggcctaccatgtcccctcaactcccactgaagcagagagcacatcaacaacccacacgaaaatgtaaatctgagaaataaatatgcgtggttggtttaaaaagagaaagaattaacatttaaagcaatggtaatttactctgatctgtaattttgagctcctgtgctgaaattgctcatttggaaattaccaagtgcttgggtctcatttgtgatcttcttcctgcatacacccagcacacaaaggagtcataatgaccggctgagtcactgctgccatctccctgaagcgtgctcttcaaatgtcaataccattttctatggtacaatgaagaaaattccgaattgtagcctgcttacactaaagggtgagcccgaaacagcacagaacctggaatatgctcaaagggcatcgcaatcctctcccattctcttctcctccagtcatcaaattgctatggcatggatcattttggctttgcaaatcatccctatcacccactcccattagtcattacttgaatataaatgaaaaactatttaggtttatgggaagaaatgagctgcttttggcaatatcccaataaaattatatctatagttgaagttatattcagatatggattcaaaccagaagcgaaactatagacacaatgtaatattagagacatgaagactctaaaagaccagcatgtagaaaactcttgtgctattcttatggatcatacttcagatattttgttcttcccaacttcttaaaccctaactccaaaaaggttacccaaaactcaagcatcagatcttttctctttttctcattcaatatagatccagggtaatggtagctaacagttatctaatgtaaattagataaaaaggaaccaggaattcctggtaaatttaattgagaaagggaaagaactcaggaaagcttaatatgactgaactttttaataatgtggtgatcaagagctcacgagtatgatatctttgttatagattgtctttttcaggttttcataaaattattttacttgggagacataatttaccttgttggatagtctttctatgtaaggagaagccatattataatgaggcgctatctctactgaagttatttctaatttgccacaatgcttatatagaagatgaaataaatgagcttcaactgcagtaaggaaattgcaggcagttgtaagaagttcttgattttattccatagatattttgagagtgcatgtcaataaaaacaattagataatataattcagctgtgagctctcatgtagccacttgatgcggggtgcccaaaagttgtagaatcttctttcctttgcaacaaaatgaaagtgcaaactgtctggagggttaaggctgaggttatgagtaagcctgctttccataatggataaggttcaaaggcacctgatggactgtgactagaaattcagtagaatctttaatacctacagaaagatttttaaatcattgaagctgtttttccttccttcaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggtacgtttgagatttatttcaccgccagccaacatgttaaattatcaacctaagtcagctcccatatctgctaataaattaagtagccaacagactaaacgtgccaacagtttttgatagtctctctaatccttttttcctccccagtggctgcagaaaaaaaaaaaaaaaaagaaagaaagaaaagagaagaaaatctaagctgttgaaaattgcatgccatgattaatctggaagtatttgcaatttaatgctacctatcagataaacatatccctccacacctctgtttcatagacaactgactttcaaagtaatccccttcctttcccataccttcttcccaacagggaacagacaagggactaagcagtgcagatggaaagggtttttgtttcaggagcctcattgctggaatatgtactatttccagacccttctaaagatcaccacccattcttgatgactatggatagacagactgtcaggacagtactcaccaagttttgaatttgtctacatttttgcagattatccctctggatcagagagagagagagagaacaatttaagaccattttttcccattttataactttttaattcattcactccacaaatattcatttaagacccattacatgctgacaatgtgggcaacaagttatcactgtcccataatttctcaaaggagaaataagatcttgtattactttaaaataacaattttttttgagacagagcaagactctgtctcaaaaaaaaaattatgtgaaaccccatctctgttagaaatacaaaaattaactgggcgtggtggcgggtgcctgtgatcccagctactcaggagactgaggcacgagaatcgcttgaacccgggaggcagaggttgcagtgagctatgaccgcaccactgcactccagcctgggcaacagagcaagaccatttttaaataagaagtggcatatgagaaaaatgtttatgcttttaaaaatagaattcaatgggccaaaatatattcattattaagcttggatatttaaatttaagactaaaaaatattagaagaaatgtttcaccctaaaccagatctgttcagggtagagtcaagctgaaatgtgaagaaagtttatcactttccttagaagtttcaatttgccagttaataacaatgtgcccacgctgccataaacaaaaatgtaagggaaacatttccattctaatttaatcccagtgtacctaggggccaaaacagcttcagagattgaaattatagtgagcagctattgcctgggagagctgttttatagcaaattaaatattaataatttgtcagatatgcccccataagaagagaaatgcaaacaaaaataggtgacaaaaggaaagagaagggaagagacggaaggaagggaggaaaggacaaagggagaaaaggaaggagggaaactgctgactctatatcgtagaaatacaaagtgtccccttgttaagatcggcattaccctctagtgaatcatacttcacagaaaatctacagcactagcctggttaaatcaagtttctcaactaacattctcttgagctacacaaatgatctacctgccccttcccccccacaaaaaaaaaaataccttcctttgattttcttagatcttgaaagtgaagaatcaggtcagtgatgttggtgtatgtactacatgccctctaaaattttataccaaaatagccttttagtgggtgacctacttaatagcccaaagcagaagaacatcctccttgtcatactttgtttttcttcttttgtattagtgactttggcttcttagatatcttatattctgttaaagtcttttggattttatagaactttatactgcagtctgggatttttcagcattatgtaatagaaaagtagtgggtagagctctgaattctatataattgtgggaccttgggcacttaaatatctatgcctcagttttctcatctacataatggagaaaataaaattttctctacatcacatggttggtataattgctttaaaaagcgtaaaatgctacagaaaaaacaatcattattactagacactttcagaaaaactaaactagtatcattcaaaaactctattctcttttcatgtcatacttctccatcttcctttcttctatacgcacattcacagtatcctttaaaacactttctatacaatttttcaggaaacattgttcaaagaaaagttttagcaacatctaggtaaggatagagagttactttcatttattctttttccctctttcaaaaaattgtcataaaaccatcaactcatgattgttttctctgccatttaaggtgttcttactaggccataaattctatgagggaaggactagatttatcttgttcactattatatctccagtgtccaacagagtaactggcacatagtgttggatgaatgaatggatagatggataatgaacaagaacatttcagaagttccactgcaattttgctgtatttccatccagaggcaaaaaagtacctacagttacatgatgtgattattattaaagtacacattttctcaaaggtgtggctttctgcttaagcttattccaatgatccagtgaatttgccgtaatttattttacgaaaataaattttcattaaacaaatgatctaaattaagcaacaacttcaacatgatatttatttatagaaaacattttttaaagacatcaaatgctaaaatacagagatatctatcacctttctcattggttcctaaccagtcttttgataaatttatcatacttcactatacagatcctgattggaatgatagcatttataatccaatcagtattaagttctccctagagatgctcccatcctccaagagtgtattcagctctgtttgagatcatttttatggaaggaaacttctacagtctcccacaaaatgatatttcataccactatctgaggtagaagagcctgttacaccactataacactgtttcctatagatcagattttggcataaattaagtttatattgtactctatatccaatgagtgttaataaaaatgcctcaatgtggtgcaattttaaaatataagcaggtcttcaacatagtgttatatagcataacctcctcatgtcatgatataagttctggttttccctgtgaatattcaaatacataaggtaaatcaaaattctttcaatattttttccccaaacctctttttctttttaactgtttcaacccttgagattacattaggggaaaaattcaattaggtatcaatctgtctttcacatctccatttaatagttaatctaccagagaagcattctaaacttatagatataagaattaacatagaaaaggacagcactagagagagatgaaaccatgaagggttggtagggcacatagagaatatttagagatggtatatcctgaattcaagaattaagagcactttccataagaaggtttaggtgaacaagggtgaatgaaccattggcctgacccaatatagcattcctattactgtgttgtgcttatgaagctctcctcactggtggacagctgccttactcaattcaatgaccaatctaaacattaatttttgaaaaggttgcctctctgggagttatctattctgaagagatcctccaccacagtaatatataccttatggctttgttgcacctttaatgtctattcagagacgcagcataacagcgtttcagagcatggactctggagccagtctgcatggattctgtcacttactatctttgtgacccaaggcaagttattcaattctctgtgcctccattttttcgtagtaaagtgagagtgataactgtactatgatgagttaatatatgcaaaccatttagaaaggtgcctgacacgtagtgtttatatagtgctttgatgccaaagcaaagtgttttcacatagataatctgatttgacacccactataggaggcaggcagagcagataggttttatcccaaatttacagatgataaattgaaacttggagacatttatatgacttgtttaaatgtaaccctctgctcaatcctagtaagtggcagagcaaggataaaactcaagtcttctgattcctcatacagttctcttgcccctacactgcactacctcttttaatttgtaagttactcattaaataaatatttagccaatgccaaaacttggatttggcctgcttatcaggttaaatcttaaaacagttgcaaaacaattagagaagatccaaagaagagcagcaaaaatatgattaaagtgttagaaaatggggcctgtgaggaaaggctaaatgagttgggattgtttagcctggtgaaagagagccaagaggtagtttaatcaccttctcaagtataaagagttatcattaaaagggcactgaccaactgttctgcatgcctaaggacagtaccagagcaaatgagcttaactagactagagagagagtcagtattagaaatgactcattataaaacagagaggaaatgaagacagtaaaatctcaccagttcaggctatatgaaggtgaagccatactgaattagtgaaaagtcagacctagatatgtcttaacattgttttcaagaatatacaaatattccaaattaatcctgtgtgttgacaagtaaatatccttatagaagacttatttaataaatagacttatttaataaatagtattttctaatttgtctattcattatatatctaaaaggctgtccccttaaaaagatttacacattcctccttcagtcttaaccatgtttctctttattccatagaaaatttacagacaagtctcagcatatcctctgcctaaattatagcatgtgctaatctagtggggcccaaaccaatatgtttcaatgttctacctaaaatattatataatgtataatttccccttgagatattccaggctaaaatcacttcatcatggatgatgtgaaggtagcatttcttaaggacagattcctgaagcaggtcaatccttcaggtagatttcatttcagaaaccccggctgtcactttgaatttggtagttttaagaaatgaaagtaagtcagtttcctaaataaaacagtgtaagcaagatgaacaacattaggggcccttctaaattatgagactgtaactcaaaggggagagtgctcacacttcaaaatatgtctagaaattgtggtcactagagcactgttgcctacagctggacctaggacaagtgaagcaaaaatgttatagctacatgcttgctccctgcctcaccctcactcagcagatagtggtactgcccagttcctctccactttgttggtccctttttattccagcccttactctcaatgttccatgtagaacattaagctcacttaccaatccaaaagacagtttgggttagcattctttctttttggaatattttgtttgccatatagttgagtaaacacaagcttgggactcaaatagacatgatttctaattttagctccctgatttccttgttgtgtgacaacaggggaggtgacaatttctttggggctcatttttctcagcttaaaagactgttccactaccttcctttcgtggttgttgtgaggatcaaataagattctatgtggaaagcacttggtacagtgcttggcactcagtaggtactcagtaactgataaccatagctatttgctcatgagtggtgagtttctgtgttcatgaaaatcagttatttgagaactattgctgaagaacaatgtccttgtggcttccccaaggtatcagttcaatctaaggtcatatcatgagagcaaagtctgagagttgggctatgctcaggtctcactaatataagtttagcatgttagaaaacctctctggttttttttttcctgtgatataacactgggtaacacatattgattgataagctcaagaacaatttgaggattaactagatttttcagcatcacctaaaataattaaaggcactaaaaccttgaaccaatatgctaactgggcatttttaataacaaatatatatgtattgaatgcttactatgtttcagatattattttaagcaatgtatgtgtatatatgtgtatgcttatatatctcatatgagttaatcctcatattatccctgtaggtagatggaaatattatttccattttacaaatgaggaaattgagacttagaagtcatgcaaccaataattggtagagatggaacttgaaccagggaagttgacaccaggtactgttaatcactgctctgactggcctcgcatctgacagaattttccaatcagaatagattcaaccggaagtcatcagacttcttgataccctcatatcttttgccttattccatagtattccctttcatcctatccgaagtctgaaaaagaagatggtcaggagccatggttaatataaattataaatttggagggacagggatacagaagtaaattactcaaatttttcttcctcttctccacaactactgccacaacttaccctgaagcactaagtctgatcagactcttcaatgctagagtttatctaaaacattttctatacttaggattctaaagttcttctagagacttgctttcagagacatggttgtaagcagagagttaaacagtcttccgccactaaatagtagtggctctatacttcacttaggtctctgtgtcctccatgacattcaaattttatggtgggttgggtactagatgacagacagtacagctatactggagccaccctaaagcaaatcaggatgtcatttctttaccagcctatgtctagtgtgggctggctgagaagtctttcagcatcttcaaaagacaaacacaagtaaaggatatgacagatgttattacctggatttcagaggtcaatctgaggtcatgcccccatgagagaaacaaggagtatacagaaagggatctcttggagtagatgagtaattgcttagctacctaagaaatcactgaatattcaggaggtaattcatatagaagaaggaaggcaaatgggatcagacctccagaatgggcattgaaatttacatggaaactgtcccagacaagagccagccaactgttgtgaggttaagcgtcacacaagggcttatattcagaatactatactaggcactattgggagaaacaaaagttctttctttcttttttaagtatttgtaatagcccttagcaatgcgattcaagtcagagagcagcatcttgacaaatgcaaaataatataacaaaaactaggtatgtaaatgctgatagaatgaaagatattagaaaagcctagaacttatttttgcatacgattgaatcaatcatgaaatgtaaggtgaaagtgttcttagtacctataatatctctccatcttcttctcccaagtgcatattaagtactatatgtaaaagaggagatcccattcctctttgctttccttgcttcccaatttcctaatggcgagcttccagagtagatcaatacatggccaaacaacccactggccttccttcatctcttactgtattttagtaggtggttcccttttttcccctgcctccagccattccaggtgtctctctgtaagttggttgccttattcttccttttcaaggacactttttgttacctaaccaatcatggtgtccaaatcgtggtcactatttcttaatctaatgacatggcaatttgatgctattacttaacacttattgggctacctgaattaatatcttgaagcaataatgcaacccaaactacagaatggtgtcccaaaagcaaaacctatggttggatttcttaaagatgttcattggaaacatggtttcttaagtctaacctagtatctttaggccctaagcaagcgagactctacttgtggtaaaagccttcaacaacatatgttaggtgactttgacactcactgacagccttaaataaacttgttctataaatgcaaagatatttatcctaggagttagtagcagacatcaatattctatatttaggaattttatcttcagcttattaaaaaagatggcacaattctctggtcatacctcacactagactggctagactggctttgtgactgtttagaagcaaatcccctctgggaaaataaagagaaaaaaaaaactttttcaataacattactttgaaacagcaagactcttgtttatttcagatgatagaagctttagggtcaaaaaggaaatgttctacttaatcaacagttccctcctcccattaaacaaaaatctgataaatgtttgattatttcttgtcaggtttggggggttttatttttaaaataaacacaaattcaaattaattttcattagggaactttttgagagtcgttgggatgactgaagacaccttggggttttgtaaagcagagtacagaagccttgaggcaggagagctggattctagccccaagctgtatgagttcaaaaaatcaatctctctacatctccatttcctgaactgtaaaatgaatctatggaatatgatggtcttttccagttccatcaggctatggttcccacagctgtgaaaaacaaggtaggaaatccagttcaagaaatattgattgattcccaacccattttgccacactcaatgctagggtgaggagaaaaggacatgtcttccctgctgaagaagcttgcaatctagtagggcgatatgtcaatgcaataattctagaagtcagaatataataaatatctaaaaatgtgtgaatcaactttcctgctttctcaggtttccaggctggtgaccatcattgatttcttagctgactgacactcttacacacctcaacatcagtgagctttgctgagacttggagacagagatgataggaagattgagataatgtatcttaaggccagggcacagcctggaagtttatcatttacctctatccttagaacacagaacaacaaacgtctgcattaaaaagagtttctggttgatcaaagctgtgccacatatgtatatataaataaatatggcctcagcccttctaggaaatacctagggaaaatccctattaattaagggcttctggtaattggattctgattaactgagatttgtttgtttatcataagcctatcataagttcctcattatatctatattcactgttatcctactactcagatccaacatatagtagattgcaatacagatgtattaaatcaaggccttttctcccaccctttaatgccgcattttagcattaaggctggtatcttattccaaaattataaaaatatggaccaattcaaatagaacaataaaactgatgcaaatatcctctttattttgagttaatcccatcacttaagtcaagtgagatctccaattcatactttaaaaaaaaggaaaggaaacactagccatatatagccatttcatccctccataggcagtgaatatgtttttagtgggcagaggaagaaagagccctaatacctcttacttcatatgacttacactgtgaacactcagttaagcctttgcagacactgagagattaagtcctatgagttagaattactagcttgtaaacattaatgaaatttttaaaatcatcatccagctttattaggaaattttcccagattaagagcaacaaaaatgtagcaattagagtgttcatcacacagctgcatgattacaggagtcttgttctagattctaacagatgctgtaacaaacagttttgtgagggctgcaagaaccatagtttacaaaagcaacacaaaagctagttattgttcaagctcacattgccacaggacccttatgtttaaaataatttacactcttgagctcctctactgagaggcatcaagcatgtaaatagagcaataacaaaaaataaaataaaatgtgcagactcaagttcttcactgcactaacatggaagggcaagggacattaattgatccgtacaaagttctggactttgatgagaccaaatgtgggaatcagccatggactagtttgatgtcattgttaccaagccaccacctggctcgtccagtcaaattaagctcatcctttcagggacagctttacttcagtccagatttggcaaggtcaaactatctctgctcaaaggttatgacaaattgacaagtgaggggcatcactcaatgggcccaggtgggggcttgaggagattggtgacaattagtgttacatcactaggggtggagccaaagtggaagagattcatagccagataccactattacatatatatatttagaaatatatattatatgtagcctcccaaatacaaaccaccaccaccctactctgaaaaagaatagcaactgatcaaatatttcctaaaggactccagtattaagccaacgactagcaatctggctgagttctatctatttcaagatcattgtgtgaccttgcacagccacctcacctttcatcatctcaggaacttcagccataaactataaaaatcctttcttgccttactgggatgacattaggatgaatcaggcaatttctctaaggtattctaagatcctcagagagggcaagtctacaaatacaaggtattataattagaatcactgcacctcatttcttaagggggagaaaatgaataaggaaaggaatgtgtggtcactgagcttgagactcaaaaggcatttaaaagctctttctatcatctgaggtaagtctcaagagagggaaactgatctggtggagtcagagaagagttcagtgaagaacctttgtgccacctgtgaaagtggctaggacatgctcccaggacattagaagccttcctgtttgtctttgacagtataacgttacttcactatgatcaccataaaggtttagatttgtgaataccaccaagagagtggcaagtgctttgattatgatgttgtaggccaaaaaggtcttgccttccgtagtgggattaattgttcataaaagaagaatagtatattcaagctcaagtggtttagctgaaattgttttcatgcctttaattatctcaatagcagaaatcatagctctaggtataactggataattagtggggacagagaaaggaagaatgggatccctttcagagttcagcattgggccagaatgcgcctgctgagcttaagaatggggacacagaaaaaggataactaggtgaacggatttgcaaatcagaacctggggattatgctatctaaaagacatacacatttgcaaggtaaataagagaaaaaccaaaatagagtgtgacctcagtaatactctgtcttggattaagagataaggatctagagacactgaaacaatggactaggtagccaacgagggtactgtagaaagcttcttagtgggcacttttaagtaccttgccatcactatcttttgaacagctctgagggtccttttcagtcctcttgacctatttcaaactactacttgtgcttaacttgaaaacttcctactcaacaaattgttcctcctgcttcctttgaccaacataaaatcaattgttgtttgacagaatactttgttgctgttttctcaaaggtgcaaaggggaaaaaaacaccttatttttgcacacattaacttaatttcagtcttacctactcaagcacaacataatccttcaaactctgaccgaagccccttcaccatttggtgtccatggcaaccgccaccaagccactcagagagttgcaagcagtggcagaaaagtgcatctcccaacagagccattagctcttctgcattaaccccatcaataaaaggtggcagcaggcccagccctgcattttctttcatcagggaggaggaatgttgtccgtgtttccttcccagattgtgagaattgggtgtggctacatctcacacccaacctgttgaaaataaagcattgagggtaaattactgcaactaagtcagaggacgattttcacttgagaaaacttcccactggtatgcttccccaacgactctgtcaactgcagcctccaccacaacactgcttgctaaactacagccagtaatcttaaaccccacaaagacaataaacatgaaatcctagccacttcctgctatggttcttagcactcagtgacctacaggtcatactctttgttacccatgtcaagaatgcatgcgtgacaatttcatgccatcaaactatattttatttatttatttatttattgagacagagtcttgctctgtagctcaggctggagtgcagtggtgtgatcttggctcactggaaccttcgcctcccgggttcaagcaattctcctgcctcagcctcccgagtagctgggattacaggcatgtgccaccacgccgggctaattttttgtatttttagtagagacggggttttaccatactggtcaggctagtgtcgaactcctgacctcgtgatccgcctgcctcggcctcccaaagtgctgggattacaggcgtgagccaccatgcctggccccatcaaactatattttttaatgaaaaagagcaatgttaataatggtctaggtactggaggatttatgagccaatagtaaatggtatggtttctccaaatatagacaaagctgttcagtctacaaactgtttttatgtgttccatattatttgctttgttcagagcttagcttaaaagttgtcagataggaatttccctttactgtactccagaggaagactaggatgtttcatggggatggttctgtcattacaacagaatccaacatatctaacagagatatttttgcataaagagaaccatctcagactaggttctttgtagaaactaaaaaggacctactactcaagtatcttcttcatagaatctacataaataggaataatatttagagtagaaggaacaagtgagtggttttatcttctcaaccgcatgaaaaagaaaacagaaggctattatgcacaatcctttccagtaggtcctctgaaatctaaggaaacaatttcaagctctccataaaaagcaagacatcatgactaatcacactgcctatctctgtagtcctggataaggactagtaaagaaaaagtgaaaaaccaataagacatagttccaggcctcaagaaactcatagttcatagggaagcagccaagtaaacagatgatcatagtctagtgtgataagagcagtggcagaggggaacacagatcttaatggaaatgtagaagaaacatcctaactcagcttgactcagatcaggaaggcctttctcctcaggattggttgaactaagtttccaaggacccattgaagatcatctggtttggaaagggatggaaatgtataattgcataagtatgacaatccccacttatgtgtcagcatgaacgctagtaagaagtgctgattcaaaaattgaaactgactcagatgtcataagacagaacagtaaaacctgatactaataagaatacgggttatactggccagaacacaacttgacctttcatcatgacctttggatcctcaagaaacagacattttccgtctgccagtacactaacatggtatctgaaatgagacgattctgcttaggcattaaaccacctcccttcattttacagtgaagaaactggggtgctgagagagactgacatacataatggccacacaactagtgagtgaaagagcaaggatttaaacacagattttactccagtgctcacactcttggtgccacaccacccaagactatgccattacatggaccaaataagcatctatatatgggttcacctgaataggtcacctgccttcttacccccatttcacatcccacccaactgtctgtaattagcatttagattaagatagcctattcacatgaaagcatactaaaccagagagataaaatttaaagttaatattacttcccacccttcttcccagtttttggagtcctttcctttctcattatccacaaacattaattgtatatctgcatacaggcaactgtactggatgatgtgcactctaagaagtatgaaactggagccctgtcctcaaagacatatcatttaattgggatggtaagacatgtgccctaagttgggtaaataattagtagactgagggaaagatgagaagtagagattatataggaattcacagggggaagtgcactagacaaatgaaccagaatataaggcttcatgagggcagggtgttttgtgttttgttaactgtcataccccttgcatctaaaacagcttggagcttagtaagtactaaataaatatttgttgaattaaataaatatgcttcttgacttgttttaggaaaaaagtcctgatgtttatcatttggagactaactctcagtcctatatgcattccactttgtggattttactcacggtacacacacagcaggagctctctagggagacttgtagaaatgactattcaccctatgatgacttaaacctttgcaaaaccctagcaaagctgtgttctctgctgctccctgccacggatgggtgtttcccagcgatgaaaaacaacagggagccagagctttttgtttgtttatttgttcattatgacctcaagctcttttcagcaaagggcacagaccttagatagcaatgcaattctgggaaatacaactccattatttgcttggctcatctaacaagatagaatgcagactctgatttaaaagcaagctcctttaatgagttttagttagggttgatggataaacagttgttattactgtcagtaggcacaggttgtaaatgtctgttttcaatgcttatattccattacagggaactcagatgggcatcagaatacaatttcctttaaaaggtggaattaaggggaaacaaaaaagcaatttcaaatgtggtcattttgtgtatccccagatggtcaaattcttggtcttccaaggctccacattgcgttatgattttttgtaacttatttcatttttaccattgtacaaattcttattacttttggcttcagggcttggaaagatacggacaattagaatgtatcagaacactgaaaggaaacccaagcattcattaaaaaaaaatgagtgaggctaaacccatccttctctcaccatggcttacactaacctcgcagcaccacagtctgtgccagcaggtaatttcaagtaaaagatctatattaacacaaatggagaaggatctgatttcataacaaacaatgctaaatttgtgtgctctctgatttcctccaaaagcttagaaagccaaaatcgtgttcagttctgtgggtgcatctaagaaattagaatatcacgtaccaccatacaggtattgtgctaaacatattgcccactataatcctttcactttctgagaggtgtagctcagaaggtacctggtttatcacggagtctaaagaaaaaatgagaggccacacctaaagcaggcttatactttaaaaacaaaaatgttttattaggaaactttcctgaactaaagcaagagtaaacactgccttgtagagctttccatatttttcaaagatttttcctgaagtagcttcttcatcctctgaagtagataggactaagagtggggttttttttttcattacatagatgagaaacagacataagaaggttaaataacttgcctaagaccacatggttaaaagcactaaattttaatccttatttcctaaagacctagacctattttatgtaccacatctaaagggatgcatttggaaagacagcaatgaaattcttgttatacaacattaactatgcctgccccaatcagcgccccctgcttttgaaaggtatagctatagctaataacctttactttgggcttggacatttctctttaccccatccccactctatttcctgaaagaacaattaagatccatctgggactaattatagcgattcttgaatttgaactcgcagccattacccaattgaggtcacttattttaaattaacttgcctggtcagaacacaggtttggttatcttcagaacccagtgcagagaggtaccagctcactcagacttttaattaactagctaaataacctgcactgtgacaagctgcctatgatttgatggactcattcatttgcattcagacaaggatcaaaatacattgtcagagcttcagggactgagtcctagaaaccttcacagtctcttgttaaaggctgtgagccacttccctttggttcgctctagttatttttcctgtgcttttgttctgattatccaacattcatcacaagtgcagcttgtgattaaacaatgacaactcatgtcatatgctgatagggaatcgaaaattggagccatgatcatatgaaccaagcacaaagctttgcaaaataattaggggaaaccaaagggaattccctggatgcccagcaacaaaggagaatttccaaagtttcgggccacaactgttccccacttaggtaataatacataataatggtaggtactcagtctttttttaattgaattcatggtgggagctgaccatcccacaatagtagtgacagttgttatcatcaataattattattacagcttccaacatttagttcctgggttcttgagtcagataaatcagattttgacttcaagctctatcattttcagcctgtgaggcatgagacaaattatccaacctctctgtgcctcaatttccttacctggaatataaaatcaataacaatgcctaccttaaaggattgtggtgaagcttcaatgagatgaagtgtgtgaaaaaatcgtttaacaccatgcgttgtacataacaaaagctcagtacattttagctaacgtttgtcttgttacatcccaccaccaggtttttatccagggcatctttccacctgggatcctctcttctccctgccagcaacagttcccctcatcattcaaaacctagtctaaagatccttcttttttctccagtggaaagccttccctggttctatcccctgcatgtaaacttgttcagtgcccatcctttcagtacactttctgcaatacacttttcagattttctattattttaaataggccatcttctactgtttcataggcaatctggacttttcttcaggatgtactattgtttaagacttccagaatatttatatagataacatatacagagagagagaaagcaagagagagagagagaaagacagagagagagagagagagagagagattgagcatctcattcagagacagagagagagagagattgagattgaacatctcattccattgtccaggctggagtggcgcaatcatggctcactgtagccttgacctcctagtctcaagcgatcctccttcctatgcccggcaattttttttttttttttagagatagggtctcactatgttgcccaggctgtgaaacatttactgagaactactccagtgccacacactggggctgtatgctgtggagtacaagagatgagtagagatagggatgggagaatgggaagcagcattggttgaatccccttatattgcagttgttctgttaggaattttaaaagcattttctcatttaggtctcacaataaccctaaaagtaagtgtcctagttactcttaatgtacagatgtggaaactgaggttcagagaggtaaaacgacttgtgaaatatcacctcatcttggaagaggaagaactggtcgatctgactccagagtgcactcttatcattaactatgctttactgcccaactcacagttttgttttgttttatcacttgcagtgttgtatgtcaaagcaatacataaactttaaagtgttacatatgtgacataaggtgattgcagtgtagcagatgctgttggtgccctacccatatcccctcagcactaacctttcctatacctgccaaaagcatcctattgtaggcacatgctgttctcctcttgaagactttctctcagcctgggagtgagacaagtcagaagagtgagggaggaattaatatttcccaaagcagttataagctaatggtgaatgggagttgaaagtcaaagaccccaacttcctggcccttttggtaggtgtattgtccatcacctccagaggtcccagaggtaatttgctgattaatacactgttttgtcacctttcttctccctgtctcatttcctcgctcccctactagttcttcatagaatcacttccaattaaactactggccctcaaatctttgtctcagggtctgccttcaggagagtcctggttaaaacaacaatgtttcagaaattcttttttggctcctttcccaggagtctgggtgaatttcctcatgctgctccctgcctacccaggactcaccatgggtgatccctaagggaccacctcatagactcagtgtgtcccttcctatccactttgatgaggatcccatcattgagggtcctgcttttagattttcaaagtgcatttattatcagatggaaaggtggttcttaaatttcagtgtgcatcagaatcaccaaaggtgagatgttaaaatgcaggctccctggccctaacctagacttgagaattagagtccctggagaggagctcaggtgcttgcattttctagattccccaggtgatccacatagtgtacactttgagaaatactgtcctaagacatccatgtagacttggcctcaagggaatgtagattatgttccttagtgctatctctacctccaaggcctctgtggagtcaagtaagaaagcctggaatagttatgcttccctgctcctataatgaagcacgaataaggccaagagctagatgctactgtcagagtagggcagcccaagacgcctaggcaatgttctacaatgcggaggagatatgcatcttactgactgccaaattattgctctcacctctctcactgcccacccccaacccctattctcccctgtattggaaacactgtgatgactgcacatgcccagttaggttatgacctgtgctcctttgtctctgagtgggagccccccttcacaacacacacacacacacacacacacacacacacacacacacacacacacacacacctccttcccaaacaaggctactgtagagtttgagttcatggttttgatcaatgctaggggcgggagaggatggcgcaggggaaggtggcagtgcgggttactttgttgtcagtttacccccagcttctcttctcttgtcctttttgcactctcagcataaacgcccaaactccaagtacaaacctcaactccttccctccatctccagcccagtgccatcctaaccagtggccccaatactcctctgcacctgagtaatgatgcctttccacggcccccatcccacagcagcaggaaacctcttctctaccttttgagcttggggaacaaaaatcagggaaggcttcttggaggaggttgcatatgacctgcgccttgagggattgatgtgatttctacagagagggatgaagggaagaggcattgaaataaggagtaaggaagggagagcataactaatataggataagcattgggcaatctgttaagaactatagatacattattttatttattcctcactgcaattctatgaaataggtactaatggtagacccattttacaaataatgatactgaaacccagaatatttaagttgattgcccaaagtcatacagcaaagtaggaattctaagccaggcagtctagcctgtactcttgactaccctactctactgcctctcgactattgtaatccttattttacagatagaaaactgaggttgagaggttaggtaacttgcctaaagttacacagcttataactggcaaagctgggatacattgtctttagcagataccattctatttactatctaatcattcataccctctgtaacttagcttttttcaccaatcatttcagtcaccactccaattcttatggagtcagccctggataccatcacaccaaatgcttatagttgctcccaataaaaatctttcccctagtgtgtaagcactgtaaaagagcaaggctcttctgaaatcaagagaaatagccctctaaaacacatctctcttcattttcaaaatagcattctgtttaagttacctgtttgtcaggttcccacttataaaagctacaggaaaaatttctctagatctttagttggagacaaagtactttctatctatagcaaattatgagttaatcattctctcctcagttgtaccttgtacatatttctgttcttgcacttctcccactgggttataattgtctgttaacttggctttctttcccactcgaatgtgagatcctccaggctaaggaccaggttactgtgacctctgtatctccatggtccagccccagaattggcacagagcaggcattcaaaaatgttcattaaaagaagagaataatgaaatgtggttaataaatgcagcccttccatccacttgagattttaatcaatattctttctgaatccagtggtatgctggaaaactggctcccagagagcaaaataaaaagccctgatttgtagtattgttcgatttttgtggtgttagtactctcatcatggctgatttcaagcaaccaatggtttaataactggctcacaaaatttctgaatatttaacaatgggctttcaagagccccctgtatttcgctgaaagtctataattctgcctagggtgcttgaactgttagcgtgtcagtgtgatcagaaaggtggatgagctggcagagtggggaaaataatgccagatgcaaatagcaggagcgaaagaccaaaccaaacatttgtgaattaagagaattctgtgtttgcctcccatgaactaagcctctatcatttgtcatccatttgcaaattgagatccacttaaatgacatggctcccagtagaaagagaaatctgccaagtaagcaactatcctgaaaaatcaaaggcccaaagaacacattaggtttctcagagatatttacttttattcgaaaatataaacatgttcactcacttctttcagcaatcagaaaatctccatagatgaggatatcaagtgctggaagcactgcacagatggaaaatgcatagacgaggcatacctagggagttcaaaaggagaacatcccaccctctacatccccatatgtttctcttccctccccactcggaggctccattgttctaggctggacttggtctctaatacaatatcctaccagccatgcttaaattttgcacacaataatggaactaataagtaaatggcaggatttaaatccagaaccatccgacttcgaggtttatgtctctttctagtacatcacctttaataaataccaatttgtttgcagctttaagggcaactcagataacatttataaagaattttagactcttacaagtttaaacactgtaaggtatcattttaggtgtgacgagttattgatcctaataaaaacctaaagatggagaggtgtgactcttgagccaatgaaggaagtcttgttttatcccacccaccctcaagtagctgtggctggaaataacacacatttgagtaactactcagccatatacccgatggtgccattccttaaaaaataaaaaatcaaagtaatgagttcactggcactctcaagcttgctactcagtacccatacagtgctttcagtatatctgtcagatattcatgattatattgctttgggcccaaatgattttgcaaagtctatagagaacacaaagatacaatttgatatttagaataagggtgtcaatattaaaaccaaacattgttgtgaatgtgaatatagaaatatataaatagttcacagtaaatttcacaaaagaagatatcaggaatgctgtaatttaaaatttactctctaaaataaatttcttgctaatttggggagatagctaatatcagagaagctacagaagtcataaacatggtcgtgttaaagaaaaactaatttccctttgctgtgatactctagattgaatactagttaaaaatcactccaattctgccttccaaaaaaaatctagaatatttccaaatataaacagggtgccatgaaaagtcctctagataaggtactccaagaacagcatttgaaaatgcaacatagcttgataaagcatcattttacaggatgctggctggtggaaagatccaggaatttaaagtatttactgttggacccatgaccaaggactctagctgatcaaagctgcaggcatcctgtgtgggaaaatacatgtaaattgcctcaggaaatggttttgtaagtttccagattttttacacagtcccaggcatcatttgctaccttccgaactctgtccatcattttgctcctttacaatactcaagaagatttgaaagtagatgaagatattcttaaaatttcaaccataaatgggaaactaacctttcatcaggacagggaaacctgatctacattctctcccctaaagatatgatggctttaaggcaatatttcccaccatccctggtggtacacaagaggattttcagtgacacctagatgaatacattctattttcatacagttgtatttattttcttgtattagtgtcattgatattatccctctggacatgactagatttaagtagtgactagctataaaggaaaaaattaagtaaataatagtcatgtgatatgcagataagacaaaaatcattaaggacgtttgtgaaggagtgaaatttgagaaatgctgttttaggattaagacaatgaagtgttcccacaaaggtcaacatgtatttaaatggctgtttatccccaataccaataataatctgttgctcctttaatttattcatggccatttattgcctcttatttgcgttggttctttgcctctcctgctgtttagcattaaatcttccatgtattccattgagtcatgatgaatgcaatgttaaagtctggaaagtgaaacttcccaaagacatgttctttggtgaaatccttgttctctaatcctcacatcctagcattttatttgatgccttattcaattgccttctctctgcataagcttccctgtagatagcataagcattgatgagattcctcggttatacttccgttttccttctttacaaaaagcttcagcctgtctttctccatctgtaccacccccacccccattaccattgggctgactttggtatgggtgattggctcttctctgcctcactaatccagcacatttattcaagtcagatgactgcaatatgaagcattgtcattcggtgataggagagcatgtgtgtgcagattaagattattagaaaataattctaacagaattgacttctggtatgtatttacgaagactcaggcaatttagtaccttgggggttttattcatgaagatgaatgccttttatcatatggaagatttcttctgtaaagtatggcatgttttaaggctgatttctgtagcacacctcttattcaacttccaacatagccaaatgtaaataggatgccataggacaacagtatctttttaaaaaaaaattaactaggagagcaggaaaaaatgaagggggctgaaaaatatcccctctttgaacataaagaatgtggtctaatagctttttcttaaagagaaagtattcatacaataaatgaagaaaacttggtgaattaaaccagcaatcccccacacccacacttctctcctagcccctcagacatttgcaggatgcctaaatcaaagagaaatagagtaaggtgagcatcaaggcatgttgttctgtactcaaagcaagatcaatctttatacatagatccttttttggcgctgatgtagaaaatccaaacaaggagatacttaggtctacaaataacctaatctgcataccagatggatctaagggggaaaaaaacatacacacttctccacacacatatttttttctaaaatgtgagcatagaaaaacagatgcttttgcctcccaacggatctgtgggcctctctcaagtagtcttgtggagcaatttcatttcaaatttctaaaattatgaaaatgtctagattaaacattaaattgaaaaggaaagggcctcttacatagaaaaccaaatgaatattttatgaattatttttaactgctcagtgatacccaacccccagtttcacagatgagtggatatggggagggggccagtaagaggaagtctccccagaatgggttgactatgattcactaacttctttgacaaataatttgatgctatatgcatcactctgtgtgttagtatgtaagagctctttcttctacgaatgaaactctactgataaagcttcagtgaataaggattgtggcatttttttctttcagatcctatatgtgaggattaaaataaatttccttaaaacaataaattttatctatatttcacacatttccccttattacatttaatatatctgctatcatatcaagccatccatcatctccaacaaatcttacaaaagcaaagtgaatacagaacatggatttggaaacttgctatttcttccttaaatttcatggtcgactgtaaaaacagcttttatacttgaagttctgcaactaattcagaaagagctattataattactgtaaaagcaaagttgaatattcttttggttaccagagtcattaagtaactgagggtacaatttatgccttgttcatctataacagatggaaagaacaaagatttagggtgagctgaacaagaaccactcccattaactagttccattatgcatcgcactaagtacaatcctcccatcccaccctattcccataagccctgtaccaaaaattcaaaaaagggaaagatcaagagcaaaacatgacactttttgtggtgagggctcctgtagctcacatcagtaggatcatagctgctccacgtaagtaagatttcaagataactgaaatttactgtcttaagtattgggactttgagcatttcttctggaaaccttccctaaaatatgcatatccctgggtttttcagcagagattactgaacacaataaaccatagcctgatgacttagggaacatccatgattatactgtgcactagtatgatgttgtctcgttttctcatcccttctttctcctttaagtcagtctgtcacttccactgctactaatgtacctctttctaatatcagtccctcccttcacacacaccctttctagtttgcagcttttaatttactgtgaactggaaaaccaagattggtaagaactatatgttaagtaagagttaaggcactgaaagcaaggatgaggaattaattatgggcttcaatacatcagctttgtgacactttaatgttcctatctttagataagcttcctatcccagtttaaagctaaattttgaaagggtgttgttataagacagctaccttcaaataagtaaatttgttctgagcagaccaaagtgggcctgaattaaagcagatatcttgatagctccaagtttttctgaacctgaaaaacaatgtctcaatgaatgaccccttcccacatttatatagcatcacacacttaaataatgcacatttcaaacattttttttttttgagatggagtttcactctcgttgcccaggctggagtgcaatggcacgatctcagctcactgcaacctccgcctcccgggttcaagtgattctcctgcctcagcctcccgagtagctgggattacaggcatctgccaccacgtctggctaattttgtatttttagtagagatggggtttctccatgttgttcaggctggtctcaaactcccaacctcaggtgatccgcctgcctcggcctcccaaagtgctgggattacaggcgtaagccaccgcacccagcctcaaacacttttggagacattatccagtttgatcccagcaacacttctgatataggcagggccagattatagataaggaaatgaaggctcagtaatttgcccacaaacaaacaattagtaaatgacaagactggggtcctgggttctcattcactgttcttttcacaacactgatgtcttctattgctccctctcatcttctctacacacaaaaaaacactaaactctgcctctgatgaaaaagacgtattccttttccttgggattccttccttattcccctctaagcattgccagatgtctttaagaatattgctcatttttctagcagaactcaaaaccctctggttttattatgttgagagttgtcagttaattaaaaattcaacaaatgtatggtcccaacttgccaccaaaagttaacaaatgtcaccggcaaggatgtttctcgcaagcggacactgaagaatacatcccagaagatacctaacagctcattttgtgtcatggaagcatgagaaatcacatcctcaagacatttattaacctttcatttcctctataaataatcagtcagaaatgtggctcataatttaaattaatcaaaaactgctctcttgtcctctctctctctctctcatacacacacacacacacacacacacacacacacacaaacacacacacacacacatacttaaaatgacttgttgaaatgacttgagggcttgtaatgccagcatcatagtcaaatgtatggttccacttctctgggtcaacttaaacattgcctcgtccatgaagccttccctgttcatatcaggccttaaatatctcttcttcctcttgtccaagactttatagcaattactagcatttgctatttagcatatatttagaaaccatgtgaagtactgccaagagtatgggttctagaggcaaatggacccagattccaatcccagctttaccgcttcctagctgtgtggccttggaaaaattacataaactctctctgactgaaattcctcatctgtaaaatgagactaatgatacttaatctgttaaactgttctggggattaaatacatataaagcacttagcaccgtgcctgcatatactaggcactcaaataaggacagttagacttattattattacaatctttcatgtatagttctggtttgatatatgtgcaattttgaggccttctcactttgttctaaaccctttaatagctgcatccagagagaaatttatcataaagcttaagcttaatggcccctcacttgcatagcttctttccaaggccttgttccaaattatgacattcataattttatatttttttaaagaaagatcctaaaattgcattagcttcaggccagtacaaaacctggttccacctctggttgtgtctttaacctctatgttatcctgttccgtccatgggtactcattgtagtactttgtacacagtcagtactcaataaaaatcctcagttagccagagtttttggtgaatttggcttcaaggaaataaacatcaattatttagtcaaaaacttctaacttctaaccaatacatttgattggaaaatattcagcccactcacatattttgagataataaaaatgtacttcgtgaactgtacaaagtacatttttattaatacaaagcctattattagacttggtactaatatagcattattcataaaaattatggtaagaatgatgatactgaggaagggtttctcaaccttagcactactgacattttgggcctgagaattctttatgtgtgggctattccaagcattgtaggatgtctagcgacatccttggccattactcactaaatgctagtagcacccttcccagttgtgacaatcaaaaatgtcaccaggcattgccaagtgtcctcgagaggaatccctcctcagtgccctaaggcatcatgatcagcaccaaaagatgtacaagcgattacaagtctttcaaactaaagcaggaaaaggaagataattattttagaaaagttttcaataagcaaaagcaacctcggttaacctgaaaatcccattaaccccattccttgaatgttctattcccttagcattccagataaaaacaacaaaaaaaaaatactgtacattctattttctactttgtatgcaaagttcagctgattttccatctcaaaagctaagtacagaaatcgagttcatgagtgggggatcttcagcttcatcacttttgccatctattttaagtgacagtgatgctattgacctgaaagtttagggagtttttttccccttgttttgacattttaagtttggtattagcaagtcttcctgttttatctagttgaaagcgaaatgcaacaacaagaaatctgatccaattaactgtgattttcctgtatataaaagctctaacattttgttctagccaccccactgattgtgcaattgaaaatgtccttcttgaataagcaatatgtcttatttcttctttctgcaggttgtgatcctagggaaacactcaagaggttatcactacatgctcgctaacctggtaagaacaagcaagtgtccctgggcaatatatcctatttagtttgaatttttctgtaatcatccaaaaaggaaatacatcaagtacctaatgctttctccagaaacttggagaaatgacttcggtaaataccaaaacctgaatgcaatagccttgctttcaattatgctgtcgttttagctgtgaagcagctatattctttcctaatttaaaaaataatttgatatgattcattacttatttttagattcaatttcggtttgaaatgtaaactattttaattgggtttgaaagataaaccatggaattggggacacaggaaactgactctttcccaattgattcaagtatatgtgcagatcagtactgcatttgtcctttcagaagcagaccactaccaaatctttttgagcagatgtcagagtaggtttcaacacagtacattatatgaccctgccaaagtgtatagccacctttctacttacataaaacacaacttgaatctttactttcaaacttcccatgcctttaaaatttgtgacactgtagaagctagtatttcattaaggttattttatacattttctttctctggaaggacaatttgtttaggaattaacaaaattgcttctaaattagtaatatctgtttggcagaggttctgaataataccatctccatgaaatgaaagagaaatgttaaattatcgctataatactaaaaatctattaagttattacatgagttctaaccccaattttgtttcattagcacaagaaaatcatgatcattgtaaagctcttaagccaaaagaatagaaacaaaggtgaaagattattgtaattatattcttatattttttaatcaaagaaatatctaatatcttattttgttttcataatgaatattttttaaatgaaaaaggaaatgttacttaaacctctttcttaggggtatgtgcattcaaacactttataagatgcagattagagctactgctttcaaatgtagtgtgcatttttctccaataatttgctctaagtggagcacttagtccattttgggaataaatgaatctagtcttttagaagaagaaatcttgattcttaaattacatccatatattttcaatatggtttttaggcaaccaacaaataaaggacttttttaatgcaatggaggttaaactgtggcttgtcaggatatatggatgtcacaacaaggcacctgatacagttattgatgactttttgtcattactttctcaccagaaaatattttgctctccttctttccttcctttctgttttccttccttcctttcttctttccttcttttcttccttcatctctttcccctttccttctcctcttccttcatctctttcccctttccttctcctcttatttgtatgtcctagaaagcagcaaggtttatagcacagtgtttaaaaatgcagggttcaccaatcactgaccatacatgaggtgactttaggtagtatacgcacgcaaacttttttattttaatgaaaatatatttccttactatgtattagaaaaatataaaactagcatatcaaaattgaaattgtatagatactattacttcaaacagggctaaaatagagatataacaaaagtaaaatatgtttttaatgttcaagtaaacaatagcaagggggataaagagatatagcaaaatctgggttttgcctacctggttgttttatacatgaatgactaagtttgagatataacattgaactggggatcagaaagtttgggttgtcaaactgactttgctactagcaaggtaagggaccttgggcaagtcacttcaactctacagacagtgttacaattccattactttaactcaggtgggagtggtggggggcagtcattgatgtgtcggatgggtcatttgaaagcagataataattagaagtgcaagatatttattgggagtaatacctgtgaaagataaaagggaaagggacataagtaggcagggagagcttcagaccacaatacaggtctataccagtaacagaagggaaaaggaagcaagtttaataggaaaagcttcagactgtgctgtagcattgataaaatcttggccaacacaactaggagatcagttcaaaagatagctcatagaggagtcctatgcttcttccaaatggcaaatcatttcatcccgactttgctcagtcattagctggcagcagcccagaaagcacacaccttccacttgaaaaactgaggcagatctgaaggtacctgaagctggaggttgtcagctaacttaattctttgagacagattttgtcttaaagagcgatctgagccgtgcataagaatggctatctcatttggcctaccatgaccgatgatctgtaaaggcctttcccattctataattccaactgggtctccttatttctactgacaaacttttttattttttttatttttgtgggtacatactagatgtatacatctgtgggttatatgagatattttcatacaggcatgcaatgcacaataaccacaccaggataaatagggtacccatcatctcaagaatttatcctttgcctactgacaatcttttaaatcagcttttattgcaattttgagatccagacctgacaaaaattaaagtctatggagtgatagaactgaaagagaaaaatcactaggacaacgttgggaaaaagaatggtaaactgaatcctatacacacaactcagaattatgagactttgggggaatgtctactacaagaacaagcaaagtctgttcctttaaaaataaagtaatgtatagtatgatgtcagtctaagtaatgaaaatgtgacttcctttaccatgctttgagctgccaccctttttcttcctttagtgaccctcttttcatttgaattcagccgtgtaagtccctgtactctatatcaaattgcatttgggtaatagagataggagctgctgttcatctctgatgataataataatgagccaaattatccctactatggtccatggttcccagttttttcaaagcagataaaaattaccccaaatgcctccatcaaagacagacagagagagagagagagagacagagacagagaaccaaaactatttagaagtaagttggatggtcaagaaaaggggaagtggagataagaagatgtttcctttcaagatgagccagctggatgaaagctgagggtggatatctatatacaaaagagcaaagtccaatgtgagtcttggtgttacagacagcacaaaaccactgctttcttctacaaatgtagagtcaagaatatttaagctacttaactaagcttcctggaatcacttcctgcagttccctttgatactgagctctatctggcaaagacatctttgtacatttacatggaacttcccctggtaacaatcctaaagtgagaagacttggatattccatgaatgctttaacgaagacctctcagaggtcaagatgtacatttcagagtggacaatgagctgcagaaaattctagcttgttgaaatcccggaaagaaacagaagatttcaccaggagtacaacccagagatgtgatctactcaggctagaagtggacatcccaatagagcaagtaagtctcttagaaattcttgtatcagttgatgatgtcattttttaggagttgttctgtaattaattgttgttttatcttccaggactctctctaacatggcgctgtttgtcaacgttagtcccagaattagccatcatgtgtacaatctgtcagtcaagcagcctctcaatctctcatggtaaggtcctggatctggatgctttacactgcattgtcaggcatgttatgtaaagtgatttagtttttttcacctatgtcagtaatgatagctcagttactgtgtgtagagccctagagtaatattaggaatagatgcaagggcaggaggcagtgtggtataataataataagaagaaaaaaaagcacgaggctaggaggtaggagtcaggtttgaatcccaagaattcatctaactagctatatagcaaaccaaacccctctgaacctgattatcaatctgtaaaatgcagacgtagacaagatcagtatttcccaaaatgtacatgagatgattttagatactacatagcaaaacttctcttttaacttattagttttgaatgtatattaaatacatattggaaaaacaactatcccagcaattctgtgattttatagataccattccttagaatgaggctaaagtagatatatagataaaagaaactcagtcaatgtaaataaaaatattaagtaaattatagttcggatggtccacctctatggcaaaaaattgaaaaggtggtatactaatgactagaatttggaaaatacaccactgtcgcttctagatctacatttcttccctcttggagttcagtttgggccagggtaggccaggtgaatgctgaggacacaaacagggaagcaaaaccagagccccgttatccttggggatataaagttataaggcagactaaagctttaaaatcagtccaagggggcaaaaaccaagatagatatgagtattcttagccaagttctaagcagagctgaggatctgaaggatcaatcaaaaacagtctagcagattacacagggcaaattggatctggattgaatgatccaacaacagatgttcatcactccccaaataagaccaaaaacaaaaacaaaacaaaacaaaaacccacaaacaattgaagtgcccaggggagaacatgagccatagcagggctcattcagtgttgcaccagttaaccactgccttagaagacctgacattttccctgcctaggttgatactggtaccagagttggagacaattgctgaccctttaagtggaggaatttaggtaatgtctgctgttagcagtagagagctacaggcaatcaaacaggtcattgtgcaagaagagaaaatagaagaaagttcatctatcttatattcctctctgatgtgttagctgttttctttagactttcatttaattttctcagaacttctatgaggagagacttcttgcccacccaccttcctaagccttttacatatcagaaaatggactcagaaaatatatataacttgcccaaagtctcatagctaatccattgccaaactaagttttctatctagattggtaacactcttagtagagcacctcgctcttcccactttacccacccaagcttctcagtgagatagaaagccagcaccacaaaggtcacataaaagcatttgcaaagacacaaatgtaaataaatgaagcacaagctctaaatttatgaggatgaagtgatcagagataaaaagggcttttaaaaacaaggacacgttgggccgggagcgatggctcatgcatgtaatcctagcactttgggaggccgaggtgggtggatcacgaggtcagcagttcaagaccagcctggccaatatgatgaaaccctgtctctacttaaaaaaaaaaaaaaaaaaaaaaaaaacttagccaggcatggtggcatgtgcctgtagtcccagctacttgaggggctgaggcagaagaatcgcttgaacctgggaggtggaggttgcagtgagctgagatcgtgccactgcactccagcctgggtgacggagcaagactctgtctcaaaaaaaaaaaaaaaaaaggacacctttgtgaatctggttttgaaaaaaaccatccaaaagcccaacatgaactgtatcttaacaggcatcaattacatccccatcactccctgctgtctaaccattttccttccctcctctctctctctctctctctctcacacacacacacacacacacacacacacacacacacacacacacattttcattccccttttttcttatgcttcgtcttctctctccctcctcatccaacctcacttatgccagaaaataatgatggaaggggggtactagatgacatctaatttttccaaaattttactaaaacaagagcattactcataagattgaacccaaacaggcagccaggagcttcaacaagcttgaggaagtgaactctgcagctcaccagatctcagaatgtacttgaaaaacagaagggcctattttgcttagagagaaaacaagtttaaataagatttagttatgctgttttgcttgccaataacaactattcccttctctcttccccttccaggtcttcttcttctgttctctactttccctttctttgttccgacattttttatgttctaaataaaaaattcaaatgctcaaagccacgtgttgtgatcactgacacctcagcagatggcatgtaaacacagagctcactgggctggagcctggctttgcaggcaagggaggtgggcttgcaggtaaaaattccccctggtcccaaatgccagggagcccagtcacctctcctggtgcacaacttctctggtagctcaggattcactttcttctccaaatggaaatggtacatagaacaccaagggaatgaggagtggggactgggctggtttccaacttcctgccatgcatttcaaaagccacaggcatttgtcagcttaaagttgcgaactctgagactcctattctctctctcccaaaatgcctttattatagtcaaccactgcactgtgtctctcttctctctctcccctgcctgaaattaacaaggaaagatcatttcctacccaatgttatagcaagatgaattaaaagcattttatcttctccccaaactctcagattatgtcctctaaaacagtgcttcctaaactacctgtgaagaagaaccagtttttccccccaagatcttcatggaccagtaaacatgcaacaaaaataaattacttaaaaaatgaaataagcaaaataagatatataaaatataagttcagtatttttagtattacattcaatagccattatattaccctgtcaagttcctatgaaggttggtaaagacttaccctccatttctttccttatatcatctcagactggtaacaaacaatgaaccagcaccagtctgcacacattttgagtagcactgctctgaaggtctttacagtaagtgtttttttctatatataccactgtatgtccaacaacttgttcacttcacagcaaggaaaacagagtgtattgtccttaagaaccttataattgtattgttcagaccagacttgcatagcttatgataattgccactgagatagaacaggtgctgggacaatgaataaagagaaggcagattgtggaagtcaataccgtggaagtctgcatagtgtagccagagaaggcctttcagaaaaggtgactttgaaaccataatctgaaagaggagaaagattcagctacatgacgaaacagggagagttcatgcatagggaacagtacatgtcaaagtcctgaggcagaaaacagcttgatgtcttccctgaacagtcagaaggcaattttgggtagagcagaatgagtgacaggacagattagatgccaggtggaagagttttacccttttttcaacagcaacagaaggcccattgaagaatttcaagcagggaaggggtatgatctgatttatgcttttttaaaaatccgtgtcaaatggatgagttttatgtgatataaattatacctcaatgaagctgttagtaaaaaaaaaaaagagagagagagagagagagatcagtggctatttccccattaatagaacttatgccacgttgtaattatttatttattcatacaaataacccccactgaactgaagtgccatgagggcaaggaccaagtttgagatggctcgccattgtaacagctagcacttaataggtttctaagtatgtttgttggtcagactagagaataaaatcatgagtgaacaatataagcaacttgtaatcaagtactaatttatatggtgtaattgtcaactctacacattgtatcctcccaggaggatggatctgctttctagaaaaagacttgtgtctctcattagcaatctgacaacttgaatcaccacaattactatgcatttctttactgaagcatcacccagatgaacagtacaaatggcaccaaaggcagagccagtcttcatccaaaatgtgagatagatagttgtctttggcagccttccaaccctcattctactgcttttatctttcctataggcaagccaccttttctcacccataatctatcatcaactcctaaaagtcacccaacttatcttgtctctgttttccccctgtacaaaatgtgccctaataatagtactgtatgaaggaaaactccacatcataccttgaaaataaatgcacttaatgtaagccttggatatatttatttccaactctcaaatatccacacttccaaaagtaaagtgaaattcagtatgtgaaaatcaacaaagatgggataataccaaagtcatttggatctttggaagactgaattgtcgggctattctcaaatcatggatggtctgtgtttggatgacagttgtgtaaccagtgtctatgtgaaagatggctttggagagttaatcaacagaagcttacaagaccctgcatgaactgcttaggcataaaggtcatgttggttttatatagctgcattcagatgtgagcaaacatgcactgatcaaacaaacagacatgatatgattgagaagtggtgcaatttatgaaatatagcagaacctacaaatcaaaatgggtagtttccgtttcagaagaatcacttctggatattatacccatatttctaacaaatatcaccattgttacacagaagcagtcaagtgtacagaaaacttagaacgcagagagtgagaaagcagaatttcaattcaccctatctatgagcagtaggattgcttccaatctgtccctgccttctctcatatcttttaatctcttcccactgcacacaaagattaccgttcaaaccaaagaaaaggatactaacatggctagccaacaaaaccattgattgcaaccaaatagaattggtgaaatgcaaacagcactagaattcgataagtttagtccaagcacacaaaaatcattgaatttgtaatcaacccttaattattaaaatccttatgaaataataagataggcttaacagaaattccatagcacaacaggaaatttgggaccttagagtcacttagcacctatgttgtagagtatacacatatacttattgcacagaaggcatgggaagtcatgcaataataagacaaaaatccataaacagtcatccatatgtacaatagcctatgtaatcattgggaagggggaggataaaggagcacaattagcccccttactacctagtagaagatacagggacaaatttgatatagatgttcttaaccattatttcactaattgaaaatgttagcaaggatgcagaaaaaagggaatgcttgcacattgttagtgggaatgtaaattagtgcagccattatggaaaacagtatggaggttcctcaaaaaactgaaaatagaactaccatatgatccagtaatcccattgctgggcatatatccaaaagaaacaaatcagcatattgaagagttatctgcactttatgtttactgcagcactattcacaataatcaagaagtggaatcaatctaagtgtccatgaacaaatggataaaggaaatgtggtatatgtacacaacggaatactatttagccataaaagggtggaaatcctgtcactgtgacattcatttggatgaatctaaaggacattatgtcaagtgaaataagccaggcacaaaaagacaaataccacgtgatctcacgtatatgtggaatcttaaaacgttgaactcatagaagtagagagcagaatggtggttaccagaggctagggggtgaggagagagggaatgaggagttgttaataaacaggtccaaagtttcagacaggcagtaggaataggttttgagagctattgcacagcagggtgcaataacaatgcatcatatatttcaaactaagagggtaaatttcaaatgtctcaccttaaaaaattgtaggtaagcaaggtgatggatatgtgaattagcttgatctaatcatttcacattgtatatgtatatcaaaacatcacattgtaccccataaatgtacacaattatgatttgtcaatcacaataatattaataattaaaaaagaaagaaaggaaagaaaagaaaatggttcttgaagaatgaaatttcaatagaggcacctaaagttgtaagtaataaagtaggggccctttgtaggcaaagagaacaaagataccaatgttaaaagagtgcatgatgtggctagagcatgaggtctgttgaaggaaatggtgtagatgaggccaggggagcagaagataacagataatggaaatccttgaaaatgaagttaagatatttggctgttaatagaaagtagggactcattgcagtcctttgagaaaggagtcttatacactaactggtattttaggaaggtaaatttattatgtgaagaataaactggagagggaaaaaaaaagaaatcagagcaccaactaggaagctaggacaataatctaggccagtggttctcaaaccctcttgtacttcaaaatcacctgttgaattagatgcttgggcctcatactccgtaagtctaaattagagaaagggatacaaaaagaagagattttaaaggaatgtaatcaccttgctttggggcacattctttttttattttttttaagtgaaagcaagtttattaggaaagtaaaggaacaaagaataggcagagcagcccctagggctgctggttgcccatttttatggttatttcttgattacatgttaaacaaggggtggattattcatgagttttctgggaaagtggtggacaattcccagaactgagggttcctccccattttagaccatagggtaacttcctgacattgccacggcatttgtaaactgtcatggcgctggtgggagtgtagcaatgaggacaaccagaggtcgctctcattgctatcttggttttggtgagatttagcaggcttatcagcaagttctttatgacccatatcttgtgctgacctcctatatcatcctgtgacttagaatgcctaaccacctcggaatgcagcccagtaggtctcagccttattttacccagcccctactcatgatggagttgctcttgttcaaatgcctctgacatttctcctctcccttttataagagaacctttaatcctaagggttctccttcgtagaaggatgaagattcatcttctgtaacttctttaggctgaatagggcaatgatattcccgcttaactattggttcccttgcatttggggtagagaggagctcagtcaaaatgctgacttggtatgtcaagggccatttataactcttgagttccaacaaaaggtgatatctggaaaattattaagtgttcaatttaagagaacattgagtaagcttatcctgcattcctacacgtagagtgtaacagcaatatattccacaacagtaaagcaaaataagccaaattattccaagtaaactaaataagaaggctttccatgaactgggaaactgttggaaccaagctgatatggggttgctagctgactccagtatgtaaggcacattctttttacaacgcacatggaatatgtaagttaatttagtcagcaggtggttagagaagggagttttagagatatgagaaggtttaattggagagtcattggtatcttattcaaagtgaattcaggttgaaaatgccaaaataaaataagaaattaatttgttttacagactctaaagcctcaaaatgtaacaagttcattttctgaggtatttgtgtggtaaatgtcatccttttgaaaaagcagattctcagagcccgactttatgaaaaatcatgagtatccccatagtcaaacactcaaaattaaaaatataaaaaggcaaataaaaaagaacaaaaaattctaatgtctttgggtagacgagaaatgccagaagaaggtacttgttttcaagcagaaaatgaactgctgaagcagtctatgattcagtgaagggagaaagcagttgctgcaaaacagcttaaacaaaaggaaccattgtttctcgcaaaaatatcaagtctactgaaacacattttgttttcggtaaaaatgctattttaaaatatattattttaataccagatgaaattcagtgaggaaatagaattcatgacacagaaatttcctttgaagtcaaacttgttaaaaatgtatcatgtattaaataaaaagatgtgggttctctcttttttttgttttttgttttttgttttttgtttttttgagacagagttttgccctgtcacccaggctggagtgcagtggcgtgatctccactcactgcaacctccgcctcctgggttcaagcaattctgctgcctcaacctcctgagtagctgggattacaggcacccaccaccacatcaggctaatttttgtatttttagtagaaacggagtttcaccatgttggccaggctggtctagaactgctaacctcaggtgatccgactacctcagcctcccaaagtgcacggattacaggcatgagccaccgtgtccagccttctggatgttgtttgtttgtttgtttgttttttctgaatagtcgtcattggatgaggagttcaggtcaagcatttaaaccctgaaacaaaagtcagaacaaactaaaaagacttaagaacatgaaaccaaatgtcaactttgtttgagccaaggacatgaattaaaaagtaaaaacttgtaaaatcgtttatcatgtatttaaactagtaatcatatacttttttctaaagacttggattttctgataataaaaatatctgtctgtgttcacatatattgctgtctggtcactgctctacttctactcacaacagcattcattatacaagggaaaaaatggaatatagggaggaggctgggctgtgggacagagagaagtctgagtgacagtaattggagtgtgtctgataggcagatgcttcatgggactagtcggaactgattggctgagggagctatgtcccactcgtgggtgttattatcagagaggaggagtgagaatggaactttctggaaaaggtcacatgataaagaggaccagtaagaggtagcttcacgaatggagtctgagccagctagctatggagaataatttgacagctggcaggcagacaggtaggatatgtaccttcctctactgctccctaccccttaaaaccccatctctttctgcttttacctctcgggtctgggtattgaaggcctaatgctgtttcattcaatttttacagaagttttaggaaaccagggactctaaattctccgacatggtgaactgtgggtggccatctccaactgctggtgatgccagaaacgaaggcaatggggaaccaggaggcaatacacaccttcctttagctagaagctgtctcctaaaatatctgtctctacatattacccccaccctttccctttccacttttacctaatggctttcaagtgacaaaaactgtgtgggcaattttacaaaagtttcagaaaggccagacatttcaatttctcaaaagagtgaagtggcaagtcccactgtagatcataatacaaaaaaaaaaaaaaaaattggccaagagctaggaaactctaataatttagctaatcatttagccagattatatgagcatttagccagatattcatataatagccatctctacattccttaaccttctcctgatagagattggtgccggatagcaaattctgttacaataattttttggtagggtttaaagaaaacaggggatcaaaattcccaaaagtgcagactttgggtggcaaacatcaagtaaaaattaccaaaagggaaaaaagcaaaaaggagccactaacttttaatatctcccacccttccactctctcctctcctcctttccccttttacttactgtatgtgtgatactcagatctgttgatttaatgtcttaacagaggttttatgtggattcttcctcaattttccaaactcaaggactgcgaattggaagctcacaaaaggaaatgtagcaacatgctatgagcaagaataatcatttaaaataaaaggataggcagaagagagccaagagccaggcaacctctgtcccataggcaaaacatctctcttttttgtaggctagtcaagtgcagcagtgggagtacagaaggcactagaacttttctcttaatacaactatgcctaccattcatcccttttttcccagttgctcagatcctcaattcctgtcgaagattcgctggccagctctgctgaattagtgtctttgctgagatgatagggagcgtctggcctcaattttcaaaatgttgtatgcactgtgcttgtccatgactccaataatgtctagcgatatgtgaaagaaaacagaatatattttaaaacaatagagtagagatggaaggtggactaagagccaggcatgtctgcctctcagccagcaactgtctccgaacttccttctttctactgttattctttacctttttctttgatctgtttacctatttgatctgtatggtggccatttctgctatgttagttgttttacagaggttttagagctacttggcatttatatccaaacttgaggtcagtgtgttatcaactcaaaaaaagaaatctagcaagagttatggataagaaaaatgtcttaaaaataatgagattctaggtgaataaggaccaggaaccagccaacttctgctcttagacaggatccctacattctaccagtgaccttaatccctttattttccttttatcctctaggtgttcagtggacatttccactgcattaatgtctttatagtgttgagtgggacttgggttcagtattcgcacctacaattcgcaagtggtcagctaaagaagtgaaacctaaaaataatttatgaacaaatgaaatgtcttaaagatattgtgataggagccaaaacaggattaggagccagcaaactgctgtccttcatacaaaagtggtcttctaataagcccctttttaacacacacccatcctacttttccttctccctcttacttccaggatatggggtggtcatgctgctgcatcaattacctacatgaaattgttgggagactctaatctcagttttctatacactgctgactgtatttactcatgtcagctacaccatttagcaatatgagatggaaaagacaacatgctttgaatcacattagaaggtacacagggaaaccaagagtaagccaacttctgcccaatagtcagtaccactctcctgccttccttcactctgccaacgaccttcacacatttgtttttcccatttccctttcaggttttcagtggtcacttctgttgcattattttgtttatagagatttcagtggggcttgggaaaatattcccacctgaatctctgcaggtaatcagaagtaaggcctaggaataatgtattttattttattttattttattttaaagggttttttatttttaatttttgtgaatacatcataggtatatatatatgtgtgtgtgcatatgtgtatatatatatgtgtcatatatatatatggtacatgatatattttgatacaggcatgcaatgtataataatcacatcatgaaacattgggtatccatcccctcaagcatttatcttttgtgttacaagccaattatcctcttttagttattttaaaatgtataagtaggtttttattgactacagtcaccttgtcgtgtaatcaaatactaggtcttattcattctaactttttttttattaatcatccttgtcttcctcccacccacccccactacccttcccaacctctgattaccatccttctctatggccatgagttcattgctttgatttttagagcccacaaataagttaaagcatgtgatatttgtctttctgtgcctggcttatttctcttagcataatgacctccagttccatccatgttgttgcaaatgacaggatcttattcttttttatgactgaatagtactccattgtatatatttatcacattttctttatccattcatctgcttgtggacccttaggttgcttccaaatcttggctattgtgaacactgctgcaacaaacatgggagtgcaggtatctctttgagatcctgatttccttacttttgggtatatacccagcagtgggatcgctggatcttatagacgacctattttcagttttttaaggaacctccaaactgttcttcatagcggttgtattaatttacattcccaccaacagtatatgaggattcccttttctccacatcctcaccagtattttttattgtctgcctttgtataaaagccattttaactggggtgagatgatatttcattatagttttgactttgcatttctctgatgatcagtaatgttgatcaccttttcatatgcctgtttgccatttgtatctcttcttttgagaaatatatattcaaatctattgcccatttaaggaattggattagattttttttcctatagagttccttatatgttctgattattaatcccttatcagatgagtagtttgcaaattttttctcccattctgtgggttgtttcttcactttgttggttgtttcctttgctgtgcagaagctttttaacttaatgtgatcccatttgtccatttttgctttagtttcctatgtgtgtagagtgttactcaagaaatttttgcccagaccaacgtccgggagattttccccaatgtttcattgtagtggtttcattataggaggtctcagattcaagtctttaatccattttgatttgatgtttgtataaagtgagagataaagatcacgtttcattattctacatatggatatccagttttcccagcacaatttattgaaaagactgtcttttccccaatatatgttcttggcatctttgttgaaaatgagttaactgtaggtgtgtggatttgtttctgggttctctattctgttacattggtctgtatgtttttatgccagtatcatgctgttttggttactgtagctctgtagtataatttgaagtcaggcaatgtgattcctccagttctgttcttctttctcaggatagctttggctattctgggtcttttgggatttcatataagttttaggattgttttttctatttctatgaaaaatgcctttggtattttgataaggattgtattgaatctgtagatttctttgagtagtatggacattgcaacaatattgattcttccaatccatgaacatggaatatctttccattttttgtgtgtccttgtgaatttctttcatcagagttttatagcgttcattgcagatatcttttacttttttggttaagtcatttcctaggtatgtaactttatttgtggctattataaatggtaatttttaaatttccttttcagattgttcattgttggcatatagaaatgctactgattttcatatgttaattttctatcctgcaactttcttgaattcgtttatcagttctaaagttttttgatgaagtcattagatttttccaaatataagatcatatcatctacaaagataatttggataatttgacttcttcttttccagtttggatggtctttatttcttttttttttcttttttatatttatatatataccttaagttctagggtacatgtgcacaacatgcaggtttgtgccatgttggtgtgctgcacccattaactcatcatttacattaggtatttctcctaatgctatccctcccctagccccccaccccacaacaggccccggtgtgtgatgttccctgccctgtgtccaagtgctctcattgttcaattcccacctatgagtgagaatatgcggtgtttggttttctgtccttgtgatagtttgctcagaatgatggtttccagcttcatccatgtccctacaaaggacatgaactcatcattttttatggctgcatagtattccatggtgtatatgtgccacattttcttaatccagtctatcattgatggacatttgggttggttccaagtctttgctactgtgaatagtgccacaataaacatatgtgtgcatgtgtctttatagtagcataatttataatcctttgagtatatacccagtaatgagatggctgggtcaaatggtatttctagttctagatccctgaggaatcgccactgtcttccacagcggttgaactagtttacactcccaccaacagtgtaaaagcattcctatttctccacatcctctccagcacctgttgttttaatgatcgctattctgactggtgtgagatggtatctcattgtggtttggatttgcatttctctgatgaccagtgatgatgagcattttctcatgtgtctgttagctgcataaatgtcttcttttgagaagggtctgttcatatcttttgcccactttttgatggggttgtttggtttttttcttgtaaatttgtttaggttttttgtagattctggatattagccctttgtcagatgagtagattgcaaaaattttctcccattctgtaggttgcctgttcactctgatggtagtttcttttgctgtgcagaaactctttagtttaattagatcccatttgtcaattttggctttcgttgcgattgcttttggtgttttagacatgaagtccttgccgatgcctatgtccttaatggtattgtctaggttttcttctagggtttttatggttttaggtctacaatttaagtctttaatccatctcgaattaatttttgtatagggtgtaaggaagggatccagtttcagctttctacatatggctagccagttttctcagcaccatttattaaacagggaatccttttcccatttcttgattttgtcaggtttgtcaaagatcagatggttgtagatgtgtggtgttacttctgaggcctctgttctgttccattggtctctatctctgttttggtgcaagtaccatgctgttttggttactgtagccttgtagtatagtttgaagtcaggtagcgtgatgcctccagctttgttatttttgcctaggattgtcttggcaatgcaggctcttttttggttccatatgaactttaaagtagttttatccaattctgtgaagaaagttattggtagcttgatggggatggcattgaatctataaattaccttgggcaatatggccattttcacgatattgattcttcctatccatgagcatggaatgttcttccatttgtttgtgtcctcctttatttcgttgagcagtgttttgtagttctccttgaagaggtccttcacatctcttgtaagttggattcctaggtattttattctctttgtagcaattgtgaatgggagttcactcatgatttggctctctgtctgttattggtgtataggaatgcttgtgatttttgcacattgattttgtatcctgagactttgctgaagttgcttatcagcttaaggagattttgggctgagatgatggggttttctaaatatacaatcatgccatctgcaaacagggacaatctgacttcctcgtttcctaactgaataccctttatttatttctcttgcctgattgccctggtcagaacttccaacactatgttgaataggagtggtgagaaaggtggatgctctttatttctttcttttgtctgattgatctaggtaggactttcagtactatgctgaataacaatgaaagtgggcatccttgtcatgttctaagtcttagaggaaatgctttccattttttttccctccattctgtacaatactagctgtgggactgtcatatggcttttattatgttgaggtatgttccttctatacccagtttttttagggtctttatcatgaagggatgttgaactttatcaaatgctttttcaccatctattgaaatgatcatatggtttttgtccttcatcgtgttgatatgatgtaacatattgattaatttgtatatgttgaaccatccttgcatccctgggataaatcccacttggtcttgatgaatgacattgttaacatattgttgaattcagtttgctggtattatgttaaggatttttgcatcaatatttatcagagatattggcctctagctttctttttttgatgtgtctttattgggttttggtatctggttaataccgcccttggagaataagtttgtaagtctagggataatttatgagcaattaaaatgcttttaaatgatacgataggaaaatgagcaggataagaggcagccaacttcactttggcctttttttaaaccctcttaaattctggatatcttttagtgttctctgttatattagttctttgctgtaattgcccaaataatccagtctcagttttctggacctgcagactgtatttgcggatatcacccttagaatctagcaatatgtgatggaaaagtggcatgctttgggccacattagatgggaaatagatgaaccagtaatcagccaactctcaactttagtgagcacttatctcctaactcttctttataccaataacctttgcacatctattttcacctttcatcttctagatgttctgtggtcatgtctgttgtcctattttatttatagagatttcagtcagctcagccagctattcccacctctgagtcttcaagtggtcatctcaagaaatgaaaaactagcaacagtttgtgaataagctaaatgtcttaaagtgttgtcataggcaataaagcaggatcaagagccagccaacctgtaaagtttatggaaaaatggtctcctaatattaacattcctagcataccactgtccccttctttcattctctatcttatgtcctggatattggttactaagctctgccacattagtgtctttacttatgttgtctgaagaatctagtctcactttcctgcaccttgcacactttatttgtgcatgtcaaccatacaatctagaaatatgtgacagaaaaaaaaacaaaatattttaaaatagaatagaagcaagtgaactaggaggcagacaactcctgctattcagaaaaaaaattgggctttcagtgtttgcctcttgccacaacctgcccttttcttatttacacccttacatcctgggtatttggtaggaaaccatcttatattcgtgtctttgctaaagttggcataagaatctagtctcggttttctgtatctgtagactgtgtttgcacatatcatgatagaatctgggaatatatgatagaaaacataatacactttgaaccatgttagaaaggaaactggtgaatgaggagtcagccaactcttgcccatcagccatcccttttctcctaacttctttatttcttccaatgttctgagtttacttttccccttttatctttcaggtatttagtggtcatttctgttgtgttatttatatagagagatcagtagggttgggccaaatattctcacattttggtctgcaagtggtcagctcaagaagtgaaacctgggaagaggttatgaacaagtgaaatgccttcaaatgttgtcataagaggaaagacagcatcaggtgccagccaactcctgcccttttacaaactttgtctcctaatattcctcttcttatcactcccctcttcttttcattcactctttttttttttttttttttgaggcagagtcttgctctgtcgcccaggctggagtgcaatggcgctatctcggctcactggaagctccgcctcccgggttcacgccattctcctgcctcagcctcccgagcagctgggactataggcgcccgccaccatgcccggctaattttttttatatttttagtagagacggggtttcaccgtgttagccaggatggtctcgatctcctgaccttgtgatccgcccgcctcggcctcccaaagtgctggtagtacaggcgtgagccaccgcgcctgtcctcttttcgttcactcttttcccttgtggatatttgttggtcacttctgttatattactttctttgctgaagctttccagaggccgaagtctcttttgtaacttggagtttgtatttgcatatatcaacagttgaatctaacaatttgtggtataaagacatgcttgaacccaaattaaatggaaataggtaaaccatgaaatagccaattccctcccattagttgtaagttccttatttctgtctatgatatttctcattttattttctcctattcccacatggatttttaaaattatctctgtaacattagtatcttttgagagatttgagagagtttccaccttgaagtctgaggtcacaacatcaaacagagaagcttagcaagcattatagaaaagtgaaattccttaaaataattaaataacaagaaagtatgaaccatgagccagccaatttttgtctttgtgccaaactatttatcctaacttccatcatcctttatagcccctccatcatcaccattctattgccttccttatacactctggttgttgtctgggctcttgtctgtgttattgtctttatattggtttcaaggattcacagctcagctttaccaccttgactactgtgggtgtcttgcatgatgaaaaagatttaacaagatagtataaaaatgtgtattcccttaatatttttggattttataaaaagaagttccagaaatcatacacctcctgtcctctatcgagatcctcaatcctaaaataactgtgatcctcagtctccctatttcacttcacttttacatatattctcatgcttgctaaatgtttcatggtcacctctcccccatcagtgtctttgctaagcctgtgggaaaaatcaggcctctgtgttcaatcttgtggactacagtttcttacaatacaaagtagcagtttatgaagaaaaacagcacgtgcattacaaaacttaattcagatggaaggtggtccagatgccagctgacttctaccatttatttaacacctctctcctagcttccatcttctactgctgaccttctttcctctattttcccctttatcgtccaaatgtttaatattcatttttgtagtgctagtgtatttgcaaaggttttagagagactcagtattatcaacttgaggcacttttttttttttttttgagacacagtctcactctgtcacccaggctggagtgcagtggcatgatctcagctcactacaacctccgcctcctgggttcaagctattcttgtgcctcagcctctcaagtagctgggactacaggtgtgcaccaccacacctggttaatttttgtattttagtagagatgagggtttcagcatgttggccaggctgatctcaaactcctgacctcaagtgatctgcccacctccgcctcccaaagtggctgggattacaggcatgagccaccattcctggccaacttgaggaccttttgtggccaactcttaaagagaaatctagcaagagttgtgggcaagtgaaataccttaaaataatgagataataggtgaaaatggaccaagagtcagccaactcctgccctcagccagaacttgtatcccaacttttaatttctataactgcctgtcacctttcttttccccttcactattcagattagtttttttttaatttgtataaatgtatggggtataagtgtaattttgttacatagttaattttaaaactctactgtcaggagtgggattgttgaaggttatttttgttgcattaatcccacctcaaggtctctgtgtagccacttcttgcaagaaatgaattctggcaagagttatgaacaaattaaatgtcttaaaataatcatacaagtggagaaagtaaaccaggagccagccaacttctcccctgaatcagaacatttctcctaacttctatcaccctaccacaaccctccctgccatcaccattttatttccctttttatatactctatgttttatagtgtcctatactgttttagtgcctttacattgatttcagggatacatggcctcaatataaacaccatgagggttttgtgtgtccaatgactaaaatctaacatgctatggaaaagtatggtgccttaaaattcgaaagcaaagaggaccaggagcctgacacctcctgctctttagcccaaaaccatctcttgctctcttctctcttaccactttctccccttctttatttcctgtctacttggtgtatgtttgctggtcagttttgttgcattagttattgtattaaatctgtcgctaaactcaggcctcaattcacaattttgccaactatggttgtacatgacaacagcctctagcaacttgtttttttttttttttttttgtaaaatttatttttttattatactttaagttttagggtacatgtgcacaatgtgcaggtttgttacatatgtatacatgtgccatgttggtgtgctgcacccattaactcgtcatttagcattaggtatatctcctactgctatccctccccctccccccaccccacaacaggccccggtgtgtgatgttccccttcctgtgtccatgtgttctcattgttcaattcccacctatgagtgagaatatgcggtgtttggttttctgtctttgtgatagtttgctcagaatgatggtttccagcttcatccatgtccctacaaaggacatgaactcatccttttttatggctgcatagtattccatggtgtatatgtgtcacattttcttaatccagtctatcactgatggacatttgggttggtttcaagtctttgctattgtgaatagtgccacaataaacatatgtgtgcatgtgtcttcatagcagcacgatttataatcgtttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcccgactttttaatgatcaccattctaactggtgtgagatggtatctcattgtggttttgatttgcatttctctgatggccagtgatgatgagcatttttttcatgtgtcttttggctgcataaatgtcttcttttgagaagggactgttcatatccttcgcccactttttgatggggttgttggtttttttcttgtaaatttgtttaagttctttgtagattctggatattagccctttgtcagacgagtagattgcaaaaattttctcccattctgtaggttgcctgttcactctgatggtagtttcttttgctgtgcagaagctctttagtttaattagatcccatttgtcaattttggctttcattgccattgcttttggtgttttagacatgaagtccttgcccatgcctatgtcctgaattgtattgcctaggttttcttctagggtttttatggttttaggtctaacatttaagtctttaatccatcttgaattaattttcgtatagggtgtaaggaagggatgcagtttcagctttctacatacggctggccagttttcccagcaccatttattaaatagggaatctttccccatttcttgtttttgtcaggtttgtcaaagatcagatagttgtggatatgtggcattatttctgaggggtagcaacttgttttagaagaaaaaaagttccatgtttttaaaaaatgaaatagatgtaagaggttgagagaagccagcaaagtcttcctccttggccatctcttctctctgaacttccatccatctatctatatattttattctcatctcttttatgttagtgtctttagggaggttttaagaaactcagcttcagttttatctccttgaaaactgtgatccaacagcctaaggagaaaatctaacaagaggttatggggtcagtaaaatgccttaaaacaatgacattctgtactaggagaaggaagacaagaagccagccagctcctctaccttagcccacacatctctcctaacctccatcttcctaccactgacccttacctttttatttactccatttttatttctggatattatatcatcacctgtgctgtgtgagtatctttacattggtttggggggaccattggcctgccttagggttataagtgtcataaccataaaaattcatcaaagattattatggaaaggagtaatgtcttaaaatgttaggataagaagtgaaagagacctagaagccaaacaaatcctgcccttgtacagtacctctctcctaatttccatcatccctctctaccttttctcctttcccctcttactgttgaatatcagctctgctgtgttagtgtctctgaagaggctgtggagagaatcagtctttaatttttgcaatatcatggactgtcagtggtcacttaaagagtggaatttagcaatagttgatacaaaaggaaaagtctttataataaaaaaggtatcagaaaaagaaagatgacgaagagtcaacaaactcctgtctttagcttgacaattttccttatatccacctgtctattactcatttcccttctcttttcctcttctacttctttgatacttattaatcagttctgctgcattagtgtttcttcagaaggtttagggaaaaatccagccttgatcatctcaaccttgaggactattggttgctctatctaaatgctgggaaccagagtgacaaacaagtcatagaatctgaagaaagataacaagcaaaatgtacacaaatgggacagagggagaagtaggaccaggatccagttaactcttgccctttagtaacaagatctttcctttcatctccctaaacacctgttaccttctttcttttttcacctcacttctgctctcttcaccttgccaaaggggctgttagtgctttctgtccatatggcctggtaagctgtaatggccctcagtaggagctagtggtgtggaggtcttgccagctaaaaaaaaagcaggttgtgatgacctccccctggtttaatctgtgctgctgtggacacattttatcccatgagcacagccaggctaatgccaatttgcagtgtgccagaactcattcccgggatgtctgtcaaaaaacattagtcgactgagagacttctagttcctcagtgatatggttgaggttgggtatagagataagtgcactgtattcctataaaggtgtttccaaatcacaatgtgtttattggagatcaagacacccaggtgggaatttgtggggtgtatgcggcaggatgaagcttcctgggagcaaggggtggtaatttttgaggtgtatttgaggtggacatctccttttagtttctctgccagaaaaagggtaattaggcaaatcttcaagaaaagagtggtacagtagacaataaccagactgaattgctggctcttaggccttaaggcagaaagtgagatttgggggaccctttctccctcgcttttgctaattctacattgccattttaacatgctatgaatattaggtaaacaggagtatgaagcttatcaaagtgagagatactgctttctagtgcatgctgtgcctattgaccctgaggactgtaatggtggcagaagcattcacaacccctttctctcaagaaagatggctctacttttccagcccaggcttttaagatacaggccaagcacaagagatcccatccttcacccacaacagcaggtcaatgggcagttggtcaattttcttatgtaatatttgttaactgccaaatgtggttaggcatggtaaatgaattaaagctattcattaaagattttaaatgatacatatttgtacatatctgtagggtatatgtgatatattgtcacatgcatagaattgtaatgatcaaatcagtgaatttaggatatccaacaccttgagtatttatcatttctgtgtgttcggaacatttcaagacccctcttctggctactatgaaatacacaatacattgttgttaactataattaccctactctgctattgaacaagagaacttttcccttctatctaactgtatgtttatactcattaaccagcctctcttcatcctgccccctctctcacccttcccagcccctactaactatcattctactctctacttccgtgagatcaaaatttttagctcccagatatgagtgaaaatatacaatatttgtctttctgagcatggcttatttcacttaacataatgacctccagttccatccacgttgctgcaaatgacatgatttcattcttgtttatggccaaatagttgtccattgtgtgtatataccacattttttgaaggccattaaactttttaagttttttttaatcttttttttcaacttttatttttggttcaagggtacatgtgcaggtttgttatataggtaaacttgtatcacaggagtttgttttgtaaattattttgtcacccaggtactaagcctaggacccaatagttattttttctgatcctctccctcctctcagcctccaccctccaataggccccagtgtctgtagttctactctatgtgtccttgtgttctcatcatttctctcccacttataagtgaaaacatgcagtatttggttttctgttcctgtgttagttggctaaggataacggcctccagctccatccatattcctgcaaaagacataatcttcatgttatcactgcatagtattccatggtgtatatgtagcacattttttttatccagtctatcattgatgggcctttaggttgattccatgtctttgctattgtgtagtgctgcaatgaacattcacgtgcatatgtgtttataatgcaacgatttatattcctctggatatatacccagtaattggattgctgggtctaatggtagttctgtttttaagtctgagaaatttccatactgctttccacaatggttgaactaatttacacttccaccaacaatgtataaagtgttcccttttcggccaggcgtggtggctaacgcctgtattcccagcactttgggagaccaaggcgggtggatcacctgaggtcgggagttcgagaccagcctggccaacatggtgaaaccccgtctctactaaaaatacaaaaattagccgggcgtggtgacacacgcctgtaatcccagctacttgggtggctaaggcaggggaatcacttgaacccgggcagcggaggttgcagtaagccgagatcatgccattgcactccagcctgggcaacagagtgagactctgaaaaaaaaaagtgttctcttttctctgcaatcttgtcagcatctgttatttttgactttttaatagccattctgactggtgtgagatggtatctcactgtggttttgatgcatttctctaatgatcagcaatgctgagctttttttcatgtgcttgttggccacacacttgttttcttttgaaaggtgtctgttcgtgtcctttgtcaatttttcaatggggttgtttgagttttttgtgtaaatttgttttaattgcatatagatgctggatattagacctttgtcagatgtatagtttgcaaatagtttctcccattctgtaggttgtctgtttactctgttgatagtttcctttgctgtgcagaagctctttagtttaattaggtcccatttgtcaatttttgctttcgttgggattgcttttggcatcttcctcatgaaatctttgccttttcctatgtcctaaatggtattacctaggttgtcttccagggtttttatagttttgggttttacatttaagtccttaatccatcttgagttgatttttgtatatggtgaaaggaaggggtcccatttcaatcttctgcacatggctagccacttctcctagcaccacttattgaatagggtatcctttcaccattgcttgtttttgtcagttttgctgaagatcagatggttgtaggtgtgcaaccttatttctgggtaacctattctgctccattagtctatgtactaatatcatgccgttttggttacggtatccctgtagtatagtttgaagttgagtagtgtgatacctccagctttgttctttttgcttaggattgccttggctatttgggctccttttttggttccataggaattttaaaataatttttatctagttctgtgaagaatgtcatttgcagtttgatgggaatagcattgaatctataaattgctttgggcattatggccattttaatgatatagattcttcctaaccatgagcatgggatgtttttccatttgtttgtgtcatctctgatttctttgagcagtgttttgtaattctcattgtacagatctttcaccttcctggttggctgtattcctaggtattttattctttctctgcctattgtcaatgggattgcattcctgatttggttcttggcttggctgttgttggttatatattttctttatccacttgttcattgatgaacacacttaggttgattccatatctttgttattgttaatagtgctgcaatatacataggagtgcaggtattccttagatatactgatttcttttcctgtggataaatactcagtagtgggattgctggatcatatggtagttctatttttagttttttcataaatcttcacactgttttccatagtggctatactaatttacattcacaacagtgtacatgagttcccttttctcctcatccttgccagcatctggttgttgttgtttttgtttgtttttgtctttttaatagtagccattctaaccaaggtaagattttttgtgtggttttaatttgtatttcccatttgattagtgatgttgagcattttttcatacacctattggcaatctgtatgtcttattttaagaaatttctattcatgttctttgcccactttttaacgggattatttgtttttgtttttgtttttgttttttattgagttgtttgagttccttgtatattctggatattagtcccttgttggatgaatagtttacaaatattttctgccattcaacaggttgtctcttcactctgttgattgtttcctttactgtgcagaagctttttggtttaatatagtctcacttgtctgtttttgtttttgttgcctgtgcttttgaagtcttagccataaaatctttgcctacactaatgtcctgaagtgcttcccctatgttttcttctagtaggtttatagtttcgagtcttatgtttaggtcttcaatccatctggagttcatttttgtatatgatgaaaaataggagtccagtttcatccttccgaatatggatatctaattttcccagcaccatttattgaagagggtgccctttccccagtgtatgtccttagaaatttttttgaaaataagttggctgtaaatatgtggatttatttctgggttcactattctgtcccattcatctatgtgtctgcctttatatgaatactgtgtcattttgattactatagcctggtgacacatcttgaagtcaggtagtatgatgcctccagctttgttctttttgctcagggttgctttggctacttggactctttattcattccaagtgaattttaggatttttttttctattttctgtgaaatatgacattggtattttgacaggaattgcatgaaatctgtagattgttttgagtagtatggtcattttaacaatattaattctttcaatccatgagcgtggggtgtctttccatttgtgtcctcttcaatacctttcatcagagatttccttgtaaaggtctttcacctccttggttaagtttattcctagatatttcagtagctactgtaaatgggattgccttcttgatttctctctcagctagatcaatattggtgcataaaaacactactgatttctgtacgttgattttatatcctgcaattttactgtatttaatgatcagatctaagaatttcttggtggagtctttaggtttgtcttgatataagctcatgacatatgcaaagaaggacaatttgacttccccctttccagtatggacctttctttttcctacttggttgctctgggtacgacttccagtaatacattgaataggagtgatgaaagtgtgcatccttgtcttgttccatttctcagaggaaaggttttcagcattttcccattcagtctgatttcagctgtgggtttgtcatacatagccttcattatgtcgaggtacaatccttctatgcctagtttgttgagagtttttattatgaagggatgctgacttttacccagtgatttttctgcgtctattgagatgatcatacagatttggtgttcattctgttgatgcaatgtattacatttattgatttgcatatgttgaaccattcttgcatccctgggataaatcccacttgatcatggtgtatcttttggatagattgtaggatacagattgctagtattttgttgaggacttttgcatctatgttcatcatggatatttgcctgtagttttttgttgttgttgcatccttgtctggttttgctgtcagagtaatgctggcatcatagaatgagttagggagaattccctccccttgatatttttggaatagtttgaggagaattggtattagttcttctttgtgagtttggtagaattcagcagtgaagcattcagtcctagacttttatttgttgaaatactttttattactgattcaatctcattactcattattggtctgtttaggttttcaatttcttcctgattaaattttggtaggttgcatgcctccaggaatttatccattttctcaaggttttccagtttgttatcatccagttgttcataacagtctctgatgatctttcatttttttcttttttgagacagggcctcactctgtcacccaggctggagtacagtggttcactcttggctcactgcaacctctgtttcctgggttcaagcaattatcctgcctcagcctcccgagtagatgggattataggtgtgtgccaccacacccagctaatttttgtattttcaatagagacaagagtttcaccatgttgccctggctggtcttgaactcctgacctcaaatggtccacccgccttggcctcccaaagtgtgggattacaggaatgagccaccgtgccaggccgatttttcatatttctgtggtatcaattgtaatgtctcctttcttatttctgattttatttatttagattttctctcttttttggttcatctagctagtggtttattgattttatcttttgaaaaaatttattttgttgttcttttgtgtttttctttagtctgtttcatttagttctgctctgatcttcattattgctttccttctactaatttgggctttggtttgctcttgcttttctagttctttgaggtgcatcattagattgtttatttgacatccttctacttttttgatattggcagttatttctataaacttccctcttaacattgctttttctgtttcccacagattttggtatgttttgtttcaatttcatttgtgtcaagaattttttaaatttcctccttaatttcttctttgacccaatggtcattcgggagcatgttgtttaatttccaggtatttgtatagtttccaaagttcctcttgttattgatttctaattaaactcctttgtggcctgagaagatatttgatatgattttgatattctaaatttttttgagacttgttttgtatcctaatgtataatctatcctggagaatgttccatgtgctgatgagaagaatgtgtattctatagctgttggatgaaatgttctataaatctctgttatgtacatttggtctcaagtgaagtttaaattcagtgtttctttgttaatcttccctctagatcatctgtctaatactgacagtagggtgttcaagttctcacctattttcgtactggagtctatctctctgtttagttgtaatagtatttgtcttggtgctttggtgtcagaagcatatatgtttagaattgctatatagtactattagattaatccctttatcattatgtaatgaccttctttgtctcctttcactgtttttgacttaagtctgtttttttctgacataagtatagctactcctgcttgctttaaatttttgtttgcacagaatgtctttttccatccctttactttgaccctatatgtacatttacatctgaggtgagtttcttgtaggcagcatatagctggatcattttttaaatccattcagccagtctatatttttcttttgtttttgttgttgttgttgttgttgttgttgttgttttattgaaacaaagtctcgctctgttgcccaggctggagtgcagtagtgcgaactcagctcactgcaagctccacctcctgggttcgccattctcctggctcagcctcccaagtagctgggactacagacacccgccaccacgcccggctaatttttttgtatttttagtagagacgaagtttcaccatgttagccaggatggtctcgatctcctgacctcgtgatcctcctgccttggcctcccaaagtgctgggattacaggcatgagccaccgcgcctggcccagtctatatcttttaagtagaaagtttaatctatttatattcaaagttattattaatatttgaaggctcatttctgtcattttattaattgatttctgcttattttgcatatactttgcttctttcttcctctcttactgcttatcattgtggtttgatggttttctgtagtggaaacatttgagtcccttctcttcctcatttgtgtgtttgctctatcagtgggttttatactttcatgtattttcattatggtatatactctcctttttcttccaggtgtaagactcccttaagcattttttatatggctagtctagcagctattaattatttcagcttttgttatttctccttcatttatgaaaggcaactttcttcagtatagtatccttggttgccaggtgtttttttgttttgttttgttttgttttgttttttcagaactttgagtttagcagcccattctctcctggcctataacatttctgctgagaaattcactgtcagtctaatgggaactcccatcagactaagtgactagatgcttttctcttgctatttttagaattatctttgacttttgacagtttgactacaatgtgccatggagaagacctttataaagatttagggatctctgagcttcctgtatttgtatgtctaaatcttttgctacatctggaaagttttcagctattattttgttaaataggttttttatcactttcattttctcttcaccttctgggacactaaaaattcacattattggatcactttacagtgtcctatatgtcatagactttgtttattcttttttagtattttttcatttttgtctgactgggttatttcaatgacttgtcttcaacttctaaaattatttcttctgcttgatctagtctagtgttgaatctttcaaatgtattttatatttcattcaatgaattattcagctttagaatttctatgtgtttttctttttattttagctatctctttggtaaatttctcactcatatcctgcattgtttttctgatttatttgtattgttgttctgatttctgtgttctcttgtatctcactaaacttctttagtatcattattgtgaatttttctgggatttcataaatttctttttgattgggatctattgctggagaagtattgtgttcctttggaggcaatgtattttttttactttttcgtactttttgtgtccttgcattgatatctgcacatttgatgtaacagttacttcttctaatattttaaatttgcttttgtaggggaggactttttcctgaagatttacctatggtgttggttgggtaggacactttggctttgattctcggtatgtgcaataatatagtctccatgatgatttatctggctgtaaacagcatcagtagtatttgtgatttccttggtggtataaggtgcagttgttggtggaggctgtggtgaagtttttctggggatggggacatcagatgggccagttcttgggcaccagtggtagtagcaacaggtcaaacatacctgtccatgggcctcagggaagtgtacatgggcaccagtgttagtgggtctagtcaggctgattcttgggccctccaggcagcttgctcagatgccagcagcggcagtggtgggccggatgggtgggtgggtccttggagccctagcaattgggcatagcataggcaatggttgtagcagaggcaacacaatcctctgactcccaagtgctttgtcctggtgatgatggtggctgcaataggctaggccagccattcttgaggcctgtaggtagcacatgcaggtgagtcccagccatggtggtagtgacaagctaagtcagcctgtcctcaggttcccaggaggagtgctaagttccaacggtggtgaatggggcagagcaatctccaggcccctggacagtttactcaggcactgggaattgaggggagtagagccaggccatctggtggtgcacgtgggtgctggctgtggtaggcaggggcgaggtgatccctagatccccagtagaatgctcaggttggggctgaagtggctgtgctgcagccctactgctggagaaggcatggttgctttcagtggcagcagccataaacaggtagcttgggagcatgtgctttggccctgatataagcaggggagcctttcctcagggctcttttaaatatgtagcagcactgctactaggagtgacagggtcactgccaatgactcgtgtttcgccctggcagcagcagccaacaataaagcccagccctgcattcaaggtattcaaccccattgatggggttccaaggatgtggaaatgcaggggctgttgggcccctggtcaggatgtagtctgatgggggctgggctctcaaaatggcaccctgctgtggctgcttaggactctggggtatgcaggaaccactcaagctccctctctagagaaatgccattatacaatctctaggcaactccttcaaagcccatgtgggttgagggctctcccagggctaggattgcaggagtccacattgagaatatggactgctaggggtctctcacttgtcctttacccatgctggggcacctcttcaggcttccagatgatcccagccaagcaggctaccttacttctttctcattccttgagtcagatgtttcctgtcacttctctattgaattccagcattctctcttaggaaatatattcaaagtgtgattatctactcactattttatttcttctttgtatgggaggtgagttctggatgcctctattcagccatcttgaggcccctttcattggagttttatcctcagcattttatttgaatataagtttaaggagtgagaatggagagttgggtaacagttaggcttaaaccccaatggtagcctctgctagactttctacacaagtgaggctctctgctgaatttattacagggggaataaaatgggagaaaacactgagtcttattttccctcatgaagaaagcctttgggagaaaactcatcatgatgaattaatgttaatttttaaaatactttgtggttatcagaatgaaggagtgattcccagtgatgtaaactatttgactctttgtccagtctcattgactcataccccacttatgaaaagaagaggaaggggctgtaagtaataactgaaaaagctgtttcactaaaatgttttctaagactgtcttgttatccatggtaaagaaatgtaaaattaagagaagcacggatggaggtgctgactctacagatattgtttatgtttagtttgtgaataaattcaccaagctatacacgtaaagatatgtgcacttctctatacaattattacacttcaataaaaccttttttagactgttaaaaaagagaggaaacattaaagaatggatatggatttgggtaataaaggtgtatgcatttatcaaaactcatcaagtacatttcattgatgtaaattttacctcaaaaaatgaagaaagaaaaagaactgtaaacaaacactgaattttagttaatgacctgcatgctgaaatctttaagggtgaagtatactaatgtctccaacttactttgaaatgaaccccaaagtgaaatggtttgatagatgagtagaaaaataattgtagaatctgagtgtgactatgtgggtattcactgtataattctttctatttttctgtatgtttgatcatttttatattaaaatgttggagggttctaaagaagggaggaagaattctacccatctgtttatgaatagaaatgatggcttcagctcattgaagaccctaacacattaatagtaattagcaggatatagttatccagcaaaagtagcagcaattcctaggctgctacttgtcccagaagataataatgcccaatggagctggcagagctcacatggagatactcctttcacaaggcttaggtggcagaagcaccagatggtagccacagcaaattagaagaaagtggtggatactatgtagtagttgttaagattcatttattgtctgggtgcagtggctcatgcctgtaatcccagcactttgggaggccgaggcaggcagatcacttgaggtcaggagttcgagaccagccaggccaacatggtgaaaccccatctctaccaaaaatacaaaacttgggagggcatggtggcatgcgcctgtaatcccagctacttgggaggctgaggcacgagaatcgcttgaacccggggggtggtgtggaggttgcagtgagccgagatcacaccactgcactccagcctgggcgacacagcgagactctgcactccagcctgggtaacagagcgagattctatctcaaaaaaaaaagaaagattcatttatggatacatgtcagataccctgggatttgtaccatcatatacaaccaagctgtcagtttcactcattggcatttctgtaaatcacaaatttctaaagtactcatcactagaatctgaagcaatccactgtgtttatcatgttaggctgaagaaaagtttgctataacacccatcgggtcaaactttttcaacattttccaattacataaagcattgtatttgtacgcaatgaagaaagactaaaaatacaggtaaatgaaacaaatcaaaatatttgcttaaagttggcacctatgtttgtccatgtggcagccacattacataaagacacatgaactaaaatggaagaatgcatattttctccattatgcctgcagtttcagggacatagtgccctaacaattaatttcatattcaaggctgtcttgattgctaataaatgatcctagggaaggagctttcacattatccttagcactctaacagatatggtgagtaagaacatacaacttcccacaatcatgatcctttcaatgtctttccagggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaaggtaatgttccatggcatgtaaaaaacctaaggccagcttttcaaagtatctcagtatgatctttatacactaacagtcatcttatgatcaagtgattttcctcagaagtgattcaaagatgccacaaaacaactgcaggtgatgctattgcatttgaaaactaaacccctgaataaagaagctgttgagaatgagatcttttaaaatccagtgcttggaaataagttaacttaatttttaatgaattttatttgtaatatgcctataacaatttacagtattacaagaacctgagccaggcaaagggtgggggcagtgggaacaggtaaggaagactgatagtctgaaacagaaaattagattttacattatttatgtgattgctttgttttaataagttccatgaatctcagtacacccaagtgaattagggtctaataaagagtgtacattgcctatatgtatattgaatggaaatgttttcctgcctgctaaagtatcttagaaaataattaaattacctagattgctcattttcacaaaatcaagataagaatattaaaagcagaaagtcatggttaaaaatgcacatttttcatgtgttcccctatggctagaaatcctattatttaaaaaccaggaattaaacagataaattaggggaaagttattcatgctacacaaaggacccttcaaatatatttttaagtaaatcgttccctcagtgcattgattcaaatatgaaactgactttaaattcttcctgatatagtgaaagtatgtaccatagctgtggtacgaaataggggatcaaaatagagtcaagaccctttcctagaaaaggaaaaggggaaaagatcttcctcattgtttcaagatactcatcctcacatccttcctccctggcaagaatagaataggggataacaggccgggcatggtagcatgcgcctgtaatcccagacacttgggtggcggaggcaggagaatggcttgaacccgtgcagcagaggttgcagtgagccgagatcatgccactgcactccagcctgggctggactccatctcaaaataataataataataataataataataataataataataataatgatgataagggagaacagtaggcaacacagaccagaaaaaagatatagagatacattctgtaccatctatgcagctccaccttaaatgggttacgtcagaacataatacaagtgaaatcttactttatgcaattggtgtgttctagaaaagttatgggttaaacatacttttttcgttcagttaagccacttactagttaaatggtaccctgtggttgtagcgattatgcctgccagatttttccaagatagtcttattttaaaacattctgttttagggtccgatcaagtgtcctaatttgctttagtaaatatggtcacaatccctatgatgaatcctttgtaatcaaaaaaatttttaatgtactaaactgatatttactggaaaataatcccaagtgaattaggctctaatacagagtgtatgttgcctacacatatattgaatggaaatgttttcctgcttgctaaagtatttttgaaaataattagattacctaagttgcccattttcatagaaatcaagataaaaatatcaaaagcataaagtcatggttcaaatgcatattgcattacatttaggtgagcttattcaaatttagatttttcataaaactgcctacccacactgctttatgatctttagatttaccaggtaataggtagaagagagaaattcatttattcaatattttagtgggttagtagtctggcacctacaatgtgccagacactgtgttaggcatgagaaaatgagtaatggtaagaagtatgaaaagggtactgaagagtagtttatgcctgtgctgaagttgcagagccatacaaaagagaaggaagccaatctcagctctggactattcattgataacacttggtgtgtataatgtaaagttctagaacccactgagaagaaatgttcatgcttataagtaaaaccctttaaataactttaaaaaattgaatatttgaatagatgttacaacttacagattacttttgcttagtattggtcattatagaaccttgcacaatatcaatcaaaccaaaagcccactttaaaaattgatgtataatatttttgattaggaaataaaattgtctacagattaaaaatcctgataatttactctataaacattttcttttagggcttgggagggtattctcacccattggtaagtagaaactgaataaagcaaaaattaaatagctcctttggcatggtttggaaaggactacattaagattgctgacaatttatgcagtcagctgaaaaaatcatcaccatgttggcttcatgtattgcaaagatgtgcagacacaaagatttttcttcatgaaagaacatatgtcccctgttacagtcacacttgatgatttgcttctgaaagacaagtaacgtgagaaaagtcagaaaagctaattgatagttgtagaggcaataatctattcactcccaattgtatttggacatactgtactagagagagagaactccccctgggacattttgctacatttttaaaaagtcaacaacattctacattctaccagtatttgtcacccctgcaaaacaggggccagcttattttaaccatagtttgttatgttaattcatttaatgaaaaagcatccaccatttcaaattgcagataatcaaatcccttgtatttagtgactgacctcatccctagtagagcatatcaatatatccaaggaatagaaagtgttcttgcctgcaagaggtggcatcatgaagtattgcctatgaattgtcaacattatcagatttaaaactcaataataattgaaattttctacaattgaaaaacagctttggtttttgctacccccaggaaacaaaaactcatttattgctggccagaagtcccacctcgccagaaacatggtccagacagaaatgattaatgttctcctccaaattaatttcaagctgtctaacttagctatttccattttcccctaagtaaacaccagatctctacaaacagcagtaacccagtcttgctttaggatgtgctgtttcctctccagtctatacatgccatcctttaacttcacacatatttcttcctctataaaggacacagccttttggtagtcactaactcagtataaaaaagaaacagtattgagagcaagagagagattgccttgagccatttgattgtaataattgtaacacatgcacacatgaggtaagaactatcactgtagaatgaatcgaattcaggcttgcccagagagatctcttaaataaataggggggtgactgcatagaacaataggtagaaatgaatgaaaattataagaaacaaggcaaattttgagggtatcatttatcatgatatcttgtttttcatgcatccatttcagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtaaagaccacaatgggttattggggtggaagaaacttataaagacataaaaaagatgagaccttgatcttgagagaagacatactaaaaggaataggaccagattatgtagaatctcagagtatgcaaagaggataagtatagccatttctataaatcatccaaacctagaaatctaaaagttggaggtcatttcttgaagcttgaaaaaaaaagagataaatttagggcaaatgaatttttggttatgcactatactatggctagtaaatgaaacttagtactctcaaaagttacagattgaatatataaatagcttcaaaaaattcaaagctttcaaacatatgacattctttagggagattagaatattttataagatgttcctaacttcaagatagacattacaaaggacagcatcctctggctcatcagacaaatgattagcctagacaggctgtggaacttagccagtgtgatagtatttctgttgtcaaaaagaacactcatgctattctacaggatgaaatgcaggaacatgatacatttctaggtctacttaagaagcttttgcctaatgctgcaaagaaaaagcctaaagaaaagtaaaaggaatcaatggatagacagtcaaataggtcacttgtttttagtatttgctgggtaggagatcatttaaggcttcaagcaatgtcctttgaacagatttcattatttataccagaagtagcatcacccattcattgcagttttccaagcaagagctctgtcctgaatattttgctttatgctacatgtgcctgcatgtattaaaatgagctttcaagagtacaagaatctcttatttctacttatttagttatcctgatgtttgggacatccaaatcaacaaagagatgggcaaagataagataattctgtgtgcaacccagcaaggaagaacttgtaacggcctcataacatacatcattttgtgtagctggctctcttattgatgccttaaatttgccaagttggaagcattcaatcaaaaggggttagtagcccttgtgtctctcttcaagaaagagatatgactcattttcccatcatgcagatttttatgtcattatgtcagttccttaacaaatgccctaagtgtagttttatggaggtagcactgtacaattttgaagagcagttaattaaattcaaccttcatagcagttacaagatttgtattgtcaggtgaaacataatgatgagtgaaatataaaactccctcagagtgaatcaaaaggagtttccatcaacaaaacctcaaggggcaagagccagcatctccaattgactccctattcatgacacaaataactaccttcccaaatagaaaactggctatcagaatgaaggataagataccaattgggctaggaaaaaaaaatagattgatcatactactgcacagaaaagtttctgcatgtctacctcactgataaagctcaagttataagccaggtaaccttcctccccaggccctaatgaccagacactcaaccaaaacaatacattacctttctataggacaatctctattgctccagagaggctggaaggcatctattttttccaaaagtagacagtgcctcagtaaaactgctctactcagagggactgtaagggaggctagtctgaagtactaaatgttttactacattaaaagaaatcccattttatttgaattaattaaaattgagactgcataatgtaaagcatccctcattgtgactagcacatagttgtttctcaataaattattctcttccttcaaaagaaatctggcaaacaaaatcattgcctggcagaggctcctaaggggcctgttttaatgaataaataagcacaacattcattcagtaaatatttattgagcacccatgactatgtatcaggctccatattagtatgcaagcaagaaataagatgaggagtgcacacatttaaattgttaatatgtaaacaaatgctttaaaatatcttaaagccacttgcaaattgggtaatcattctcctcacaatctgcaaataatgcaaagatcagcccagcacagtctactgacatatctgtcacagattctaagtctttgagacttgttcaatcaacatttattaaggatctgctctatcccaggcacaacattagttgctgagaacagaggtaaaaaaatgtctctcatctcgagatgctcctaatccagtaggaaagttagaaacacatagattataaaaatgttatgtctaagtcttgcacaggatgctatgaattaaagaagggatcccagacgggatgcggggaaactgtcactaacattcaatactggaccacatccttaaaaatagatttctctgagtggtagtccaattctacttctggtcaccaaacgttcaaatcatgcgtctggaatctgttggactatgccttgactattctccagttcatatatcatattcagataggttgggtctttagaaatagacaactcttaatgagacttaaagccctagctattttcactaatgaaggctttccttaataagttcctattgcccttgtctctgccctgtctaactcttctatcagaattcagtgctcaaaatagagtataaagagcccttcatgctcacattatgtatcagtctcatcccactggataagtaatttctatctcaacaaaggtcttttctctaactagaagtgtgatgccaccttctctgcaagcctaagctaacaatagtgcttaggtttgttggatcagttggacaatcatcttgttttcagttcatcagattggagcattttcctttcaacaggaattccacagtctcctactggtggtgaacaagcccctttccctttaaaaaatgttccctaatatttgacaacatttttctttctgcaacacaaacccactgccacctctgacttgtttgacagcttgtcattttccataagtgatgaaaaacaattccattctttcatactaggaaaatgagatatattctttctctttgaagcaaagtctttgacctttacttgccagatgagtaatgcaagtggttagcaacaattatttatatttgtagagggtatttcatccagtgtccctgcactgtaaaataggtaaagaatctatctaccctgaagagatggcctcttgctaattcataatactgagcccaggcccaggaaaaattgttccatacatgaaatcggcatttggcatcccaaacaagtgttctggcttccagtacttctacatttcttgtctagtgctccatactcctgaccccttaggcttaataaatttcatcagtctttggattatccctctatggcttagctctcttgtctgttacctgtctgtagctgagtgtgggttaaataagagggaaagctcatccctgtcactgtagtagctggcaaatgtgtaaccctctcaagaaacagaactaaatccattttggttaataataattaatatagctagcatgtattctgatgcttaatagatgccacatactgttctaaacattacgtttatatgtgtgtgtgtatatatatatatatatatatcttctctaatcttcccaataactctgaaagatagatactactaggattttcaatcttacagattaagacactggggtaaaaaagcattaagaacatgccgaaggtcattcaattaataattgaagctacgatatgagtccaggtgtaacagtgcccatgctgctgaaaccagattatgttcagatatgggaaatattaagataagacacagccatggcccccaaggaactcagtttagaatacattaccctagttaagggggtagcctgcagagtatttttaggaaggggctagtggaaatttcaggtccttgaaaaagtggcggtagagccctcattatattatataagtaacagcatcttacacctactcaatgcttcaaaactaaaaggcatgccaagaaaatactgtggaggaaatgaagatcttgtatagactcgatctggtggatagagctcaatgacttgcaataataattcttcaagattccaagatctgtcagcagacctcatcccagagacttagaaggcaataatgccgtgctatttttaaattttaaattttccctttctaccaggtgcaagtacaaggaatgactggaaatattcaatttgacacttatggacgtaggacaaattataccatcgatgtgtatgaaatgaaagtcagtggctctcgaaaagtaagtaaccaaaacagacatttaaagaaaaggactcttgaaagaggacagcatttggatgtaagaaaataagtattattattttacaaaatatcagtaaggatgagtgggagatgggaacctccaggatgaaggaatagcacacctatgtgtcagtgttgggggtcctggtgggaattacaagacccggggagacaggatgtcaatccttatagagctcaagaaagttttgttccacaacagcacttcaatttcatgcagtacttttctgagggaaaaataggcatccaggtcaaatgtcttctctttctaggctggctactggaatgagtatgaaaggtttgtgcctttctcagatcagcaaatcagcaatgacagtgcatcctcagagaatcggaccatagtagtgactaccattctggtaagtgtgaacagaaggtaggtgggctttctgtccagcaagacttccgttttctgaaaagtatttttccaccagtagaaaagacctcaagttcaaacagtaaaaacttccaacagggaagctcaggaaactctcaaagtatcttgccatgatgatgaacagaatgtcatttaacaaaaagagagaaagaaaaagaataggaatttagaacagttttagattatcattttcctctttctccccgcctccatgcccgcccgcataggactgatgcttcatctggacttgaaacctaattcttcattgtgggggaagcagcattgtgtggaggagagagtacattaggattctaaaattaggtctaccactaacctgtaaaactgtgcaagtcacaacttctctgagcctcaggttgttgtttcttcatttatgaaaggggtataataataatcacctacccatgtcataagcccgtttcaaggcacagttcactacacgaagaagttttctgcaaaactcaaagcacttaaaatgtgagatggtattctcatttagttttaaaacacttttctagaagctggtttgtttttactgaatgaagtacaaacctgggttaaaaacaaatacatctctaggtgtgaaagtatgactaactgaatggagactaggctgaagtttgcctttcatctaagcatacatatcaaatactccctttgtcttaagtactatactaggccctggagatataaaaatgtaaatgccacggacgctgacctcacagggatcacaatgcttccccagggctttgcctcaactacctgcaattcctacataataaatcttgagaaatgaaaggcacttcaccatcatgtaactaagtctgccaaatttgatgaaatcaaagacttgataggtgaaaactgggccatctttcaaactctcaaaaagaactgaaatccttctctgcttccttaaattaccagttaaggactccccctaccaaaaaaaaaaaaaaaaaagtgacccaatgaatactcaattaaagctcttctgtttactaagtaacaatttaaaggcctttttcacataccaaacctcaatagtcacagaggggaaaaattattgcatttatcttctcttagaaaaatgtataggagtaatccttttatcttgcttctggtcccaaaggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatggggtgagttttttccaattctgttttcatttattctgtgctttccaattaacaaagaagagagaagatttaattttcaagtgcagtgtttatccaattgtatagtttacatatagtctacaagaaaaatatattcttctacagttgcgctctgtaaaggtaggttgtcagtagtatcctttggacaacaggattattttactaaaaggaaaatagaattgggggattttatttggcaacattaagcacagcctgccctctatttaaaatctgttccttctgtgttctctagctcaggcagcagaattaccacccacatagttgcctaagcaactttgcctaagcaacctcatcatctttcctcattgttcccctcttatctagtcagtcaccatgtcctatgaattctacttttaagtctctcaaatctagacacactcttcacccccaccatcgtcaccttaattagggttcttaacatctatcagtcatttaacttgttaccctgcgtctgttcttaccctggcaaattagatctccacattactgtaatttcccactttaacaatcaggatgaaattcaaattccttcacatggcaaataaggcactttataatctagcacccgcctacctctctagcttcatcctgtactctttccccctcacacccaatgttccagctatagaaaagtaagtgttgttccctgaaggtgctgagctctcacttagtataagcctggaagtacttttgtgtctcttcagcagctaataccacctactagtcctctgaaacacagcagtgatacttgtttcagaaaaccttctctattcgcatctacttgcctgcagtctgggttaggtacccctgctttttgcttccttcctttccatattcatatagtacttctaagtctgtattgtaatgatccatttacaagttccactgttctactagactatgaactcctcgaggacagaagatgtagctgattcatttcaatatcacacagtctgaaacatagacattcaataaatccttgctgaattaatgaatgaaaaatgaacagaatggctctgccaggggcttatctatagtccaactgcaaaagaattaatatgggcaattagggcttttaagaaaggtacagtgatatcttcagagctcctggttcacttagtattaaatggttttggcctctgattgtgaatgacagatcttgggcagcttaatgaggcacatgtaaataagcagaactggacagaaaaactgcccatgcagtaaaccggtcactagagaactaacccaagtgcagtgggtggtggcaaaggtttagttctaacaaacaaagattacctgtaataataactctctgtctagacaatatctacactaagtaaggggaagacagaggaatctaggaggtagagatactgagaagccccagctggcaagaagcaaacaaccaggttatttatttattggactgaggttcaggagaaggactctagtgcttgggatggaaaccagcaagaataaggtatagctctccaatcatatgagagtactggggtcactaaataagttcttggaacaggcctttgggaggaaccacaaagtcggaagctcatttctaaaaataagggcacagaaaggtaacaaaagcaaagctggaccccagatataaaaactggagcaccatcctctagtcagatgaacagcaaggcaacttgaacctcagcctccatctacgggcctggagccatcatctcctgtcttgggtcaagatcggtcctgggaactgaggcagggctaagtggcagatgagattcaagtgaatccagcagtaagaaagagaagaatttccaacaccagtgcagagagggctgaacaagggtcagagcacccagtcatgatttctgaggaccctgagaagctctgaaccatcttgacatggctctaatcttttactttccaagttgttgataaggttttcttctctttcctgttcctcatctccccaacacttaggcttcaagaggtcttgtcttgcttacagctcacccttgctcttggcacattacctgatacatagtaaatgctcactttttgctttaatgaatcaatgcctggcatacagtaatgcctaagccagtattcattaaattgagttcatggtgggatataatcttgtaatatcattactatttctattactactactactattaccactactattactactactactgccattattagctaccatttgttgcatatttactggctgccagatactgtactaagtgcttttatatgtaatttaatcctcacaacacgcctctggggaaggtgccattattaaactctttctacatgtgagaaaattgaagcctagagaggtgaagtcacatgctaaagaccaaacagtttacagtgactatcttagtttgtttggactgctataataaaacaccataaactgggtcacttataaacaacaggaatttgtttttcacagttctggaggctgggaagtccaagatcaagggagattcattgtctcgtgagggccactttcaggctcatagatggtaccttcttcctgtgttctcacatgatggaaagggtaaggggtccctcttgggcctcttttataaggacactataagttccatttatgagggcttcactcccatgacctaatcacctcccaaagccccacttcctaataccatcaccttgggggttaggatttcaacatatgacttggttgcgggggggggggggacgtggggacacaaatattcaaactgtaacagtgatacaataactttaacccagatctttgactctgaagtccatgctttttaaccattacactatctgcccaacagctaaagtgtggtttcaggcccatcccattctgaaagatagttgaaatttattagaaaggcttatggtgccttagtcattctggagagaagagtgtttggcaacaacagcatggcaagaaatttaaggcgtaagtgtctttttattttatttattatttatttatttttgagacagagtcttgctctgtcaaccaggctagagtgcagtggcatgatcttggctcactgcaacctctgcctcccaggttcaagcgattctcctgcctcaagttcctgagtagctgggactacaggcacctgccaccttgcccagctaatattaaaaatattttttagtagagatggggtttcaccatgttggccaggttggtctcaaactcctgacctcaagtgatctacctgcctcggcctcctaaagtgccgggattacaggtgtgagtcaccacgcccaggctaaggtgtaagtttctactagcccaggttatccgatgtgagctataccatgaactctaccaccccatcacaactgaatgaccatatttctcctgtcactctctgtaaatagatcactgctctcctggcattgaggaagacattacacacagtgacatagagcaaggcagacttattgacattgttcagacaaagaccaattttctcactggatttgttttctcctccagcatgttccctgtactgcactcatttaatctccacatatctcttcctcattccaatttgtctacttgtgagtgagggagcttgagtattagagtccctcatttgtttagcaacttagatgccttctctccacttctgaatagtaaaagtgttcccataggaaccttcccatcttttccctttagttctttctactaaagacaaaagcaatagccggggaggctcttacagaaatgtcctcctccttcccctgcctaaaacaactttctgatgctttctgggcttataacaggaggtgattccagagaactacagcaaaccaacccatcggagaagactgccaaattccattttcctctaaaacctgtggctatgaaaaatatacattcttatcatgcttggagtaaaagctctctgttaaagaggatgatctcatgagctaaatgtgtcttcatcttcatttagaagttttagtcttttggcattgggaagttttcaacttctctatcaatgacagaaatggagaaaaatgaaaacacaggctttcatttctggcaggcctggcctcttgtggtttgcaagttgctttaaaaaaagaagagcagaaaacccctaatgatttctctaagttcttaatgagcaaaaagatggagaacagggaaatatttcttgcagtgaacatgaaacctatacagataggcactgctttatcttaagggtatttctcttatgcttttagtatgtaaaacagagcagagtggaaagaatgaaaaaaatcagagatgaagaaagctctgcaagggagatttcagtgtcagtcataaagtttcaagaaagaatcaaaatgaattaaatttgctaaagaataaggaagccaatcagcctcttttcagatgatttataaataggtttttttctaaggaaattcaaatcaggttgatgttggggcaccttgtatctctaagaaggctatttttgaaacaaacctcagtaggacacaatgtgccccattatgtaagcccttcagaacatcatggacttgaaactgtccacctgcttttagcagttttgattttgagctggatgtctgtaacaccactacatggtaacagtcccagatcaaatggcttacagaccacaagtttttatggcttccaaataccatatgttttgagggcacttaaaaacagcattttttgctagcagggctcttaaacatccttaatcctaccttaccattcattttttacaaatgcatatggggaccagccaagatcagacatcagaactgcccctcaggtaatcaggaatccaaagcctgataaaggacacaggtacagcagtggcagcaggattggacaaagtcacaaaatcccacaacttggcaacacaggttttgtgactcatggtctagtgctctgtccactgggtcacactggctcagttcactaaacttgtgagattatggaaatattggtgttgtatcaatcagatacagcatccccacctggctctaaggggcttacaatctagttggattataaacttttccatctaagatacttattttgctatttttcatccaagatactcatcctgcttatttatggcctccaggataatgtaatccacatttctagttatcactcgaaatatttgaaaacccaatatagacagctgggggttctgcccttagagaggagatatgatctaagggaaaaagagagtcaggagaaaggctaaaaggaaattgaggccccaattaacagaacacctcccagtgggcaactgccatgttccttatgttcctagcagttacaactaaggataaagaagaagggggttgctttgggaaaggcttgacaagctgctgcttaaattgcttcttctgacttagaagatagcagagagcctgggggtagtaatggggctgcagggatggttgattataggtcatattccctgggtgtccccagactccttcacgctcccaggacacatggcaactttacagatactatttgcactgacattgctctgcctagaagaaattatctcttaggtcgtcactatcctaagctggattcattttccattaagaaaggcagagagtcgatttgtccttccagctaaaaggcagagaagcaagggtccagtaacagatgccagatattcttcaggtgattatactgggctttggcagaagggctgatgatttgataaaagtcccccctccttcaaatgatgcatgtaacctccaggaaggagcattaaggacacatgaagtatgccattcgaagcagaaagagtggggaaaatatttccagctaaacgtagtctcacaaggccttcatccagctacagagacacttttttatcttgatattgtctttaactctctcagctccccaaggacaaggagccctaatcaatagatccagtcggggatacctgttctggataaagaaattaggatattctgttgtgacactgcttgttgttgcacagatttaaataagcctcattcttttctccagatcttaacaattgcagacagtaaacatcccatagagtactgccaataaatcagtttaagtcttgtcccccagcacacagcaattatattcctattgtctagcttgattctgccccactcctgttttcaacacatatcaactttccaaaggaaatgtctgccaaaggcaactagagccctgtggttgatacagggacaaagggtcaggtcatgtctgcttcttctcttggataacatatagtacattatgattacacatcaatacattgtctacttcctctctcctgtccccttccctgctttcagaaagtgttttaaaatggtgtctgacaagctcctgctcattcgtagtctcatggtgggttacaagttttgtatcagataatcagatgaaaattcttaaagatataacaagcttgcaatctcaaagagattaaaattacgtttaaagtcagtgtcatctctggctaaaacctgtcagattcttaagtgcatcagccctacacatatgagtttgttggtttttaagttttataacatttacaactttggcaacccacctatgaaaaggattataaatcccctcaagctaaatcctctccaataatgcagttgctccatgtttgcaactggtgagtggaaaattcaaacctaattcagtgtgtttactgagcccacacagccacatttaggctgcttgattaaaatcctttaagtagtcaagatgcaagcaaaagtactagtaaactcttactctgtgctctttccatttgcttgattttgtctgtcaattggagcaccctcataccactactacacacttacccacctaggtttctgaaaataacttgcctactgctattaccagtgcaagcagaggcttgaggacaactggccactggagtgattcaggacaccccaagagaggcacttcattgttgagtcagaatttcacctactccctaaccccatccataattcttaccactctctctcccagcctacagctggctttcataagagcagagactaggaaaggaattccatttgaggacttacctttttcagtttttcatcagtgtgggcctcctcaatctttaagttgccttgaaagtgacctctccctttaccttcttgctatggcaatcccaggagagctcaatggttatttttggatgctagttagttacagggtggagcatataactaactagtgttcaaaatacctactgagctctcttgggactgccataacatgattgccccacataaattatgccaagcaggtcctatgctctgaaataaccaattatcacaacaacttattttaacatttattttacgttcaggggtacatgtgcaggtttgtaatataagtaaattgcatatcacaggggtttggtggacaaaaaacaaccccataaaaaagtgggcaaaggacatgaacagacacttttcaaaagaaaacttacatgcggccaaaaactgcctgtgggaatagtggtgatagagggcaagggctttgccaaggctggctctgagctgacatgagttctgctgcttggtttcttaccaaacatacaagaaaggagaagagttgctaagtctcctaccaatagaagggaagggagctacagattctgcctcaagctgtccttgagccttcttccacctgccttcttccacctgctttttgctattcccttgcctttttccatctgtaataggtattttttaaggttcatcatggggaattctccttttggagtcaggtctacatcagtgaggtacaactgagcacagatttaatgccattcttgattgggagagcaccctccaaaacatagacaaattccacattttttgaaaaatctccttagaaagaaacaatccagaaaaaaaaaatacagaaatgccaggctgaggaaaaaaaaaggcagtgcctaagggaagcagatgattcttcctgttgtcttttgtgatttcagaagtacttcaaactaggaatggccttctttgggaatctgttcttttgatgaatgttcctgggaatcagacaacaaaaagtcctgctttatccatctggccacgtcttgttagtatttagtggtgcttaccatgtagtaggtgtttcaattaccaagtagggtttttttaaaggggtcaagattctcaaactcctttctgtaccttctagaaaagaccccaaattccttaaattcattccaaaataattttctcatgtgaatgccttcttatttcttttttctaaaacaaacaagtaacaatttctcctagaactatcttttagacttaaaagatgaaaaatactggttaaattaagtaattaaattcaaatgaaatcaagtgagaaatgatactagaggggtatttgcatgctctgagcaggagacagacatgttggcaaagagaggaagtggctttatctgtgaattctcttggcatgacaagactctttctaactgattcagactctctctgccaaaaaaaaaaaaaaaaaaaaaaaaaaaaaaaaaaaaaacactctgctagctttctggccaactcattctcctcagtacccttttttactatgaccaggtctagcttcaggcaaaagggtaaaatagatgaaaatttgtctttggctcccctctagttagtaacgtggaactggaaattcagaagttagccacgatgagatgagagttgaaaccacaggtaacaatactgagggatgaaagtgaaggacagaaccttaaagaacaaaccttcattgattatctcctaagacaagcactctgaatagtcccttggggtacaaaggtgcaccttaattgagagagcagaactaggaaggaaagtcaaagaaggaacattcagaaaggtaggaggagaacctgtagtctttcataacagagagctaaggaaagcacgtacatagtgcaaaaggccaatggcatcacacaagcagttaatgtctgaaggaagatatttgaatttagtagccaagtatataattcaagaaacaatttcagtaatttggaggggctggaaattaagtctcaggggtataaggagaaagtggtgttgatatcaagacagtaaagctgtcttttttcaataatactggtggtgttagggagggatgtaatgtggttaagaaggcagcaggatcaaaaggtgggaggagtgttttctgtttcatttttgtctgttagtaaataggattacctgaaaatgattttaagtgaataaaacagatcaatgattttcaaattatagcaagcattacaacaaactggaaggccacatgagtctcacgcctccacaatttctcatcccatacatctggggtggagcccgagaactggcatttctttttctttttcttttttattttttttattatactttaagttctagggtacacgtgcacaacgtgcaggtttgttacataggtatacatgtgccatgttggtttgctgcaccaatcaacacgtcatttacgttaggcattttttcctaatgctatccctcccccagccccccacccccgacaggccccagtgtgtggtgttcccccacctgtgaccatgtgttctcattgttcaactcccacctatgagtgagaacatgtggtgtttggttttctgtccttttgatagtttgctgagaatgatggcttccagcttcatccatgtccctgcaaaggacatgaactcatccttttttatggatgcatagtattccatggtgtatatgtgccacattttcttaatccagtctatcattgatggacatttgggttggttccaagtctttgctattgtgaatagtgccgcaataaacatacatgtgcatgtgtctttatagtagcatgacttataatcctttagatacatacccagtaatgggatcactgggtcaaatggtatttctagttctatattcttgaagaattgccacactgtcttccacgatggttgaactaatttacactcccaacaacagtgtaaaagcgttcctatttctccacatcctctccagcatctgttgtttcctgactttttaatgatcgccattctaactgtgtgagatggtatctcattgtggttttgatttgcatttctctgacgaccagtgatgatgagcattttttcatgtgtctgttgaactggcatttctaacaagttcccaggtgactcttttgctgctaatctaggacccatactttaagagccaccggaatagattagtggagaagggaaaaattaaagatgtaaaagagatagtagatagagctgggttttaagaagcgacagagaaatatagaatgcatggaataagttgatcaaatcttagaaagtgtcactttctgtgagatggaaacacacagaagaaatgtataaagatgctgcaatatgttgacaaagttgggggagggggaactgagatgatagagcttatatcaaatggcttccatcttctcagtaaagaaagaggcaagatcatctgcagagaggataggactgataaggattaggaactgggaaaagtttgaaataagcatcatccacagacacagaggagaatctacttttggggggatagatgggttaaattttagaaatgatgagtttgaaatggtggtgagcctccaaggtagatttgatcagtaggcagttggcttcaataaacccatgctttctgcaacttccactaggatgtaaaggatgtaggatgccctccatgcaggtaagtatttttgtctgttttgtctgtcttgttcactgcttcattcctagcacctagaatagtgcttggcacagaataaagactcaaatttgcattggaatgaacctaagaggggttggctaaggttgataattgcatataaaagtagtgtatagtagaaacctgcaagtatctatggagttagaacattatgttcattaagcaactgggttctggaatctgaagaccagggttctaatcccagcctctctgtgctttagtttctccatctccaacatgggaatggtgattgtaccaatatcaaggttactgtgagaattaaatgacatagtaagtgtaatgtgcttagcaaagtgcctcatatagaataagcactcaataaatgttagctagctgtttatcatctgcagttccctttcaactaattaaggagtattcctcaactggtttatcatatgtaattcaaaggagtaaaatttcatttctttgaaaatatactctatatcagacttccctacctctgccctttggtaggggtattgaggcattactgttctgaacatagaaaaaaaatgatcaaaacttgtgttttcacttcatatatgatataccatccaaaagcctttccttagtcagaaggatttttctttgtgtgcattttaaggcctggcttcagactatgacttactactgttggaaaggaacaattacagaaaacaaaagaaataaatgtagaaaatcctagtgcctattttcaagggattaatataaaaaacattgcctgcctttgcctaagttaattgtgcagtgcactactgacatttattttattgattcaatccatgtgagtgctacactgatattatcactagaaaatatagcttactacataaattgtgttctgacaactgttttacccttgttattgcccaggcaaaattctttcatgtttgcatatgtcatatacagtaatcaacaacttattttttaggcatctacagtttctttagtttagaatctgttgcagtgatacatacaaaaatagaagattgagtctctgccttcaaaaaacctgttttaaaagatatgctttcaaaaaaattcaagaataacataagacagcaaacacctaagaattaaactgctgtggccctgtgtggcacctcatggtgtagagtgaagcagatataagaagtataggatattatgcctgctccacaagaattttcagtcaagtgagggagataagacataagaacacgaaaattaaaataagaaaacgagagttaaatagtgacatgtcacaaggcagtacaagttgtattataaggtagcaaaaacacactattaggaaaagaaagcagagtcggttgctctaagccaatgtgtctcagaagacaaaaggccagcaccctttctttaatttaccatcaagttaaagcactttagaacccactgaatgctaccacttttctaacctaagcattgataattcaattggttgtaaagatttaggacttgatattttcaccaaagaagtatattaagcgacaaataactgattaaagactgtctctaaaagtcatatatgttttcttttttttcttttttttcagagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaaggtttgtttttgtggcatactcaatgcctcattgcattttatggtcatactccattcatgtacatatggtattcatccatctcaactccagatttttttcatttaacattccatcaaatgacagattatcatcaagccattgtgtttgcttatgtccatgaagtgagtgtgtcattggtgttgctttgaatgtctttcatgcatttctatggtattgtatatacattaaaacaaacatttgaactctggataaaggcaacattgccactaatattaatattattcagataaagtaaatactaaatcttcatcagatcaaacagacatggtttcctaattaattgtactgaagtgttttctcatttctaaagagattggatccagacaaaatttaaaagaacatagaactcttctttaaatccctcctaccttctcctttcaatgccctccctttttcattttgctctcagactgcctacaactatccattatagtatcccacccaagttttctagttaaaactataaaacttctcaaagaaaacataggagaatatctgttttaccttggtttggacaaagtgctcttagataagacacaaaaagcacaatccattaaaaatttgataaactggacttcatcaaaattcaaaaccttgcatttaaaaagacgtattaagaaaatgaaaaaaaaacccgactgggagaaaacattagtaaatcatgtgtctgataaaggacttgcatccagaatatataacacctcttacaactcaataaaaagaagacaatccaattttttaatggacaaaagatttgaatggacatttccccaaagaagatatataaatggctaataagcacaacaaaagatactcaacattgttggccattagggaaatgcaaattaaaaccacaatgagatgcttccatacatcctctagaatggctgcaatcaaaaagataggcaataccaagtgctgatgacaatgtagaacaactggaactttcatccactagtagtgggaatgcaaaatgctacagccacattggaaaatagcttggcagtttcttatcaagtaagataaatacttaaaatataacacagcaattctattcttagctatttacctaagagaaaggaaaacatattcacacaaaaagttatacacaaatgttcatagtaactttataatattaaaaaagtagaaacaacccaaatgtctatcaactcgtgaataaataaacaaaatattttatatctatatagtggaatactattcaccaattaaaaagaacagactactgacacatctataacatggatgaaccttaaaaatgttatgctgggccgggcgcggtgattcatgcctgttatcccagcactttgggaggccaaggcaggtggatcacctgaggtcaggatttcaagaccagcctggccaacatggtgaaaccccgtctctactaaaaatacaaaaaattagctgggcatggtggtgggcacttgtaatcccagctacatgagaggctgaggcagcagaatcacttgaacctgggaggcggagattgcagtgagccgaggttgcgccattgcactccagcctgggcaacaagagcaaaactcagtctcaaaaaaaaaaaaaaaaagttatgctaagtgaaataagccagatgcaaaaggccacatatcatgccatttgaatcccatttattgaatatctcatattgtatgattctatttgtccagaataggcagtctacagagacagaaagtacgttagttgttgccaagggcttgcagggagcagagaggggataatcagggccagtatcagggtgaggcaagtgagcctgagtaaagcaagtacagggatcacatccaagctttatttaaaattttgatattatgcattaattttttaaatattggactaaaattctatttatcttgattaatgagattttgatgcccctttaaactttgcgtgtggggaagttgcctcacttgcctcatcctagtcctaggcctgccaggattaactgcaaatgagcatgaaggaactttttagggtgataaaaatgctctaaaattggatcgtgatgatagttgcacaactctacgtttactaaaatcactgatcgtacacttgtattggtgaattttatggtatgcaaattttatctaagaaaagcaaaatattgaacatgaatgtcctgagcctcacaaacttagtctaaacctaaacaaatatggcggtgaattcttaatcataatacattgtaggtgactgtaacatctttatattttgagacaaaaaagctgtaggttttggtaaacttgaacattaatccagatactgaccagagtcaattatacaaacacattagggattttcatgtgaaatataaagactcagaagagtcctaccatgtttttacagcatacttcattttgagattatccacttggaccataaaacatttaaaaagaagctttgcagcataactaattggtaaccatattcagcagctttttaaaatagtctgtatggggtatgcctcatttatcgaagtcacactttttttggcttttctcaatctgcttgattacattctccaaattatttcactccctgttccttttgtgcttagaatgtatgtcattttttgtattatctgggagtttattttgctagtttctttattttttgaaatgttcacttcaagagactatggtttctgaatgatcctataattaaatgatttttaacatggctggtaatctatgttgagacaatactaaagagtcattaaggctcaagattttattggtttctgtaagtgaattttcagaactaagtttgtggtatccccattggagtgctgcatactactctgcatactcaaaaagcactcttctcatttttagaagaatttatatatatattgattcattaagtaataacttaaagattatggcctgaaaatgacaagttgaacaggtttgttaatgtcttatagtagaatgtaagctgtggctcttctttggcactgagatatatcaaatgctttttttcaaagtatgtattttattatactaaactagacactgtcataaagagcaatggctttcaaaattttttttaccatgacccacagtaagaagtaaattttccatcacaactcagtatacacatatgtatataaccaaaggttcaccatactttacccttacaatgtgcaatgcactccgatattttctattgtgtcattttttttttaattctggttacaattcaacccagaaatagggcacacaacctacagaataacactagcctagagtaacaaatattattcttactatacttttaagtaataaattattgcctttatgagctctatgttttccaccatatgggtgatccctcctccaatattgtcttttgtgtgtctttcgaaataaattatacctttaagcattttaataaaatgttatgcttcttagcatatttctgatatatactagtgaagaggaaacatgtttctccttgtcttgagagctctattcattatatgtttgtgctcaattgtataacagcaatcactgtgatgtttctagaactattaacagatttagaaatttctgataataacacagttgttactctaagatttgtggttgccttgactacaaacaccagcagtatactttatttctgtttaatggccacagttggaatgcaaactcttcagaaagcccagaatgtgagcatgcattatacactctgacttttctcaaaattgaagcaattcaagaaattatgagaccacattttaaagtagaatttaagtattagagcaggagaaaatgtcagacataaattagcccaactgcttccatttactgggggcagagggacaacaaccaccttccctcagctcccactgtgtataggcactttacctccattatcaggtggattttaatcctcaaaacaccactgcagcgtgggcattatacttatttttaagttgaagaaggtgatagtcagattaaataatttgcccagccacacagctaatggcagagcctgagtacaaaccaagctccaattccaaaacatgctctttccacttcatgctgctttttccaatatcacagacaagggaacagcacccgaaggatgatgtgatgaaatccaaggtcatggaggttttcagaggcaacagtatgattatttccactactgcacactgcctcctactaccaacctgaagttgcactgtttgttccattcctctcctcatgctcaggcataagagctgttttccattctttcaacctctaaagaaactctaccttttttctggtttgcaatgaaagaaggcagtgagcatttaaaatattatcgagagtgtgtatgctcaaagtaagagactgggaaatcagaaacaagacatcatgagaaaaactgatggcatcattacatttccaccaaattattcacagctacctagaagcttaaagagtctatgtcaatattaggtttgaactaccataattgttcagagtgaataagtttgttctacatgaagctggaggctgagctaactctagagaaggtaatcaatataataacctgaggttttgtccacatacaaactgatttattaggaggagtcggtggaaggtacgaggagattcaattcaacctttttccccctgagtggggaaggagaagacaggcaatgggtacaggcagatggaagaagcatagtggttaagcacgtgggcactggagttagcctcactagattcacaatctgcttagcagttgtgtaacctggggcaaatcactaaaccttgctaagcctcagttcttcatctgtgaaataaaaagcacagtgcctagcatgtaagttctcaataaataatagctattgtcattattaaattggctgcacataatcatgctagtttcacaaatactaacagctaatataacatttgcattttagttcctaaaactccttgggaatacagttgaaataccagttagtatcaaagagctgacctctgatgagaaataaccagcaacactccttcttgaacttgcttttgttaaagattacaactcttgcaaatatttttattgtattattctactatgtcttactgatattggctggaagttgtaactttatttttaatacgaaatttatttcctttgtaaaacttggatagaaccactaagcagtccagagtccaagtccttccagacaaatgctccccctgctgactttctgtgcagctgcagggacatctgagggctagacaaattgaagacatgagagttgggggaattattacagagaaaatggaaagaacagatgaacttgaacctgattactgtgtatagatgtttccaaaggtgttactctcctgttaagttttcaagatatgaagtactttgttgaagagggcagggggtctgtccagattagttgacacgtagatcctcctttaaaatgtaaagtatgtgcagaataataaaagacatgaagggtataaaataaatgagatcaaagacaataggatttttggctatattttaagcataccctttcctctgctgatgtatgaccactgtctttatcttactgcaaattcacttcaaagtagtagtgatgtaataataaattaatgaggtaatagcagaatttttattacaactacttcatggcttttctggctaaaagctgtagttttcagtctttgggacatggttacttattcccatcagagaagactgtaagaaccaaagattgattctgcacattttttaaaaatctgccacagacatggcattaaatggagtatagaaatgatgcatactttggaagaaagaagagaaaaaaaggaatgataaagagtttgtacaatagagaagcagttttcagtcccagctcttcatcttgtaaagctagtaaagtgaagattataaaatttacttacaagatgaaggttatagcacatagctcacttttattatcatttcaaaggtcataaaatatattttattattaactcagaaaatctagttctttattattacagataacaagagcattgtatattatttgatgtacgtattttgcagtgctttttatatgtctgttttcctcttgttgctaatttactttcattaacttcacgcctcctcttacatttcctcaaaaggtatgatacgcttcttataatgcacttttataaacactaaatgtgcagcattttacagccatttcattacgctaaccttgaaatctgtcttgtgcaacaaaactatttgaaatgaatgttaaacattttgtagctgcattaatggagggaaagatactggaaaatgacaggtctttttaactcaactataaagtcttgtcttattttaatagatcctttataaaatgtgatgggattgacccatcagtcactttttatataacctccatgtgaaatgtgagtttaagtggctatagtttccctaatgagaaaaggtaaatgtaaaaatgcctatggagcttcttccctgtaggttccactgcactttttctcagtgaaaggattgaggcgcttatgctaaacaagggaataaagtggtggaaattccatcaaatcttttgtctaagctactactgttttgaggcgagaatgttgaatgcaagcttgtgcattccacactgattccactgaagctccttttctatctctgctgaggtatgcaggtactgttatagcatttttatgtgggtaatcacccaaattctccatgatcataggtatatcatgacattaaccacaaaattgccaaagtcaataaccatgtagacaagaggccatgaaaatgaccattttgcatttagatttattttcagtcatgtcaacaaccaacagctgagtcattcagatcaaccacatgatgatctgagtcagtactaaagtggccaaaataaccagattatgatgtgcaggcttgattttagatcagactgacacagccacagtccattagcctcaatacaatggcacagtgtaatttccataaattactgtatttttctccacattgtcaagtagacaatgcataaactaccattagtattcacagcagcaaaatatacctctttccatatcaaactgtgattctggaattactccaaagtcagttttctccttggtctggcaaaacctcatcattccaaataaaaatgacagtcacagttctgtcccaaatgaacaacagataataaacaataattatacaaatatgtttggttttcatgccactatatttctcagtgtttggagaaaatttgtaccttctataacttgcacaccattttggattttcttatacaaaatacgggtattttatactacaaaaatgtgggtatttctctcctagtgtataagtttaaatgttttattttctattctgcctctctgtgcctcagtttctttatctgtaaaatacctctgtttgcttatctttaaaatagtacctaaccatagggatagagaattaaaatagttggcacaggtaaagcaattagaacagagtctggcacacaagaagtgctcaataagtattagctataattgttatcatttttcttcctctattactatggatgtttctttggaatgttaatcttttatatagcaaaattatttctagagtcagatcagttcagaataaattaaatgtatgtggcaacaatgaagaaagactctgaaaggtctaaatgcataatcaaaacaccctgtatacttttagcattcagaagtgtgccacattcttttctgactcatccagatgtttttacttctgattaaaagagaaatgttcccagatgaaatcctgagatagtgtaactgttagaaaaatctactgcaaagcagattttcaaattcaaaaagctaaaagtgatcatgttcaggaaataaatacgggttgtctcaggaatccagggacgaacaggaactacagatttaaaaaaaatcaagtcagtttgttatagttaaccaataataaatatttatcaaaatacctgccaaaattattcagagtgtagcatctaaaacaactgagttttccagaggccagaaaaaggttaccttgggacacaggaatttaaatttgctttaaagtggtgaaatgctggtacagacagagaagagcttgatttgccggctctcagcccagaactaccctcttcccacagagcctggagatatgccaggctcctacgcctattcttgactttatgacagagtgggttctcttcctgtgagtttttctgggcatgggagaacatagcgtaactaggatggagctctgccacacagcagaattatcctaaggatgatgtggcaatgttttataaaacctagggagcagattttcatttctgcagacagagccagccttcagcaacactgtgaaggagatgaagtttcctgagtacaagccattacccatcactgagcattcaattccctcacactgtccaataacttcttatggtccctgtctctgaggaacactcatgatgcaggaccaaacttgcaaccctgtctgcaccttgagagttttataaagtgctgctgcttagtcccaacccccagggttatgatttaattggtcttgaagcctaggcaaggttttttgtctttttgtgttgacgtgttttgactgaagctccctagatgatattgatatgcaggcagaactgagaatcactgatgtagaagaacaatgtttctcagtttggtctgcagaccacttgcagcagaatcacctgtgatgcttaagaagtgcagattcttgggcattcagctattctgaatctgcattttaacaaacacctcaggtaatgctgatgcacagtaacatttaagaacaaaaatttccccttattaaaacttacccatcttctttcccattccctactaactgaataaacagtgggtgctgttgaagtaatgtgttacattttgatcaagcctcctgaaaacaacacagagcgtgattccaatagaatttctccatcagaccaggaggatgattttgttttcgttttctgtgtgtgggggtggaagggggtgtggaggaagcaagccttttgatgcctctaatcccactatacaggtagtttcctacttcacttggagtctgccctgagtggttaaggcttagttgtcaaaggagaaagtttctaatctcctgggccccaaaagctatttatatgaagatgatgagaaatattatcatctagctccttgccttatggatgaccaactccacaaaatagcaatgtctttgttaaatttattaaactcaaagtgaatagtgctcattttccagcacctacccatttatcttcaagtgagaagaggtttttgactatgtttctctcatgacattaccttgtagcagtggttttcaaccttggttgcactttgtaatcacctggtgagctttaaaaaatttaaatgtctgcgtcctacctcccaagttctgatttaattggtgggcctgggcatgagtttttttttaagatcctaggtgattttaatgtggagccaaggctgaaaaccatttgcttctacaggtgtgcccagcaaacttcacaggaagagaactcaataagttaaattattacctgtggaagcaggagatggtaaaaaaaatatatattttttcctgtaattaaaaggaaaaatcctgctaggagtgcacttgtagtcccagctattcaggaggctgaagctggaagatagctagagcccaggagttcaagtccagtctgggcaacatagagagacctgacctcattttttaaaaagaaaatcctgctttgaaacgtgtataggcctgacaagtattatgcatgcaccatcatagtatgccatcatgacatggggtattgttgttaacatgtgacctttgtttaatgttttaattccctcacatcatctatttccctccttcatcagctatactgaaaccactcctctttccagaaataaagaaaaggatttcttaaacttagatctggcccctctgggtctggatttgtttttgttttgttttatagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagagtaagtgctctgcagttaattgagcctgctgatatttattttatcatcttctcacaaaggcaagttcacagtgcttttaagggagagttgggaaagagtgggaatgttatcaaaggagagcatcttaaatactgggctgcttggttggtgatctacttcattgtcgtttagaaccaagacttgagtaagacataacaagctgcatgtcaagggcactgagtttggactcccaggtttgaatcccaaccctgccacaaagtgattgtttgtccttgggcaagccatttaacttctaccagcttcagtcccctcacttgaataatgaggggattgaactaaataatatatattctgctttctagcttttacaaaagcagtgcttttatgtctcagaggttcacagaagttaggcaattgactctaagactgatgagtaatggactataagaaattacatattctattttaaatgttagttgtctattgagatgtattacaattgtatcaagtatttgtgtacatggtgataatttcattttcaggacagctgataattgttttaatttcttgggtagacgtattccctcagctcctcataggcaaaatcttattgaggaaacagtaaattgttcattagcaaaagttaataaagctatgtaaagtctgtcaagaggaaagatgaaaggagattgaagcaggaaatgatagaaggataatatgagggacaaaccactttcacataaaccatcaagatctttattctgtggtaactggactattaaggaagaatactagtagagtttttaagaactaaaatgttttttcagttaccccaacaagaaaaatatgctaatttagattagaaaatggacacattctataatattactactgcctgctactgtaaccacagtaactagttgtagcaatgatccagaagccacttgggtagtaggtggagtagttagtcactctctccaaccaataatcaagttattggatgacagatataattgctgatttttcctcaaaggcccagagtaaacagatggtggttctaaacctcctttttaaataatcaataagaaatacatttctacatgtattatcatgagatttgtccaattacttcacagtaaaccaggaagagtacatttcttgacattacagcaattaactacaaacagttttcactccctgaaagagaatgtattagtcctgggaccctttcaagaattctcattgattcaagatatccatatctcacctataccacctgtttactgaccagatcataatccccaactgggaggaggggtccaatgttggtccaatgaagaccctctggaactaatctggccttgaccctcactactatggcagtcccagaagcttatttagaaacaattttctgcccccatgaaatcactcacatttatcggggctagaagccagggatttccatctgatgagtagtcaacacataaccagctccatggaaatctggtttgatatcaaccttcaacagagcttatgataaccatcccaataggcatgaagtttctatatgaagtaattaaccacttaggatatcaagacaccagaagcttctatatgaagtaattaaccacttaggatatcaagacaccagacttgaaccctcagataagagatacttgttccactggaaagcatttttctttcaaaaacaattagaggttagaaagttgtgctttaaatggtaatcaataaacggcatcaattcccattaggctttcaaaggccattcatccatattgcaggcaaaaggaggctctctggaaagatgaagagatttattagcccagaggcagaaagtgtgaccaaatattcattgccctcatgcccagaccccatctcccacttattctgtgtctttctcaaaaactaggaaagcatctactaaatcattcaatcatgatttcattaaagggcatcatattaccagagctgatttgaatcaacatttaattctgagcaaagctattgccacattctgattggtttgtggtttctaatgctcatcaattcctagccaatgagtaattcatatggaaattgagctgttttgaaaatctgattacacagggagctggatatttctaagtataaggaagtacaaatcattttctagttctggcatgccactttttctgtttccccaaatggtcactggtggcatcattaaggacttggtggggtggttcttcagggcagcacacgaatgttgattatctaaaagtggaactataaaagcagcatagaaaaaccaactcctttaacctgcttatactgaaaatgttatctagacccaacaaagactatctttgatattcgtgcaatacagggttgtggggccggcagccaattggtctccaagccatttaaatccaatggggcaaagaaggcagccagcaagagcacatcatcctttatttagggacttgactgccacagtcatgtcacttccccttcattcttcagtgatgtcaagtcataaaggcaattttaaaaactaactcctggccaggtgtagtggctcacacctgtagtcccagcactttgggaggccgaggcaggcagatcacgagctcaggagattgagaccagcctggtcaacacggtaaaaccctgtctctactaaaaatacaaaaattagctgagtgtggtggtgcatgcctgtaattccagctactcgggaggctgaggcaggagaatcgcttgaaccagggattcagaggttgcagtgagctgagatcttgccacaacactacagcctggcaatagagtgagactctgtctcaaaaacaaaaacaaaacaaaacaaaacaaaaaacagtaactcacatacacacacacacacacacacacacacacacattggggatctctgatagcatgccttatgaacttcagaggatgaaacaagatcacatgcaacatttacaaacataatatgaactcatttcttcccgtgctcactctatactaatactacagggaccaaattgtaataacataagacagcctagggccagccctctagtccttccactaagagataggaataaataaaataaaattcttttctaattgccctgcagacatttttacttgtcctgagtaaagctgccattaaaatgatggtatttttaaatgattcatttgtttctctcattttctgagctttccctagctgtcatcttacaatcccatgatcagtggaacagagggacctgttccgtcaggaaaggcagggagcagaatgcatgctgctagaagagacacctggaatattactatcaactctcttgatttgaaaactgatttccttagacagcagctccaaaactatatatcccaaccagacgtagaagcacatatgccaaaaaaacaagtggacggctttattgttgttgcccagagaaatgctacaatgatttggaaagctgcactgaaatgaccattctccactaggttttggaaatttaacctgatacagattcatgttaaaaggtggcactggaagaaaaagtaattccaaagttctctctgcctgcagacctttaaaagtattagaaaataaccaggatgctggatttctttttttgtgaaaattgatattaatattttattaagatgcattcaaataattatttatacatttatatgcataaacacccaaaacattttatacatggaatcatataacatagtattctcttgccattatttgtttgttttttaaaactcaaataagtatagatttacttttttttttacttcatagtatttaactttacttcaactctattatttcctttatcaatttcctcttgataaatgtttaaccttttgaaaatattttggtgttaacagtggttcaataaacattattttccattgatgtaatagaattattttaaaatgtttttaaatatttgcccttcagttagatcccttaaagcacttagcctgtgatgtgacataagccatgtaatgcccagctgcagacaaagctggcttcacaaagttacagaatgtagtaggcacctggctaaggaaaactctaccccacaaaatatttagcccccagtaggcactttaacaggaatcacattttttcccctttttacattaaatgtctgatggtggaagaaggggacatgtttgttctaaagttaatcctaatggaaaagttaatggtccaatattttatttataccataatggacaatttttctctttctcatttgctgaactttatgcaaggctcttgtgtttatttgggcacaactccagaggccttcattcttattctcacctgactggatggcccagccaggtcatgtataacctgtgatatgcctgtgcatatacctgtgtgcgtaggctgctgaggccctggtatttggtttagtttgttgcttactttgccgttgcttggtttcctgattctctaaaagaatataaggcagaaaaatcccagagagatgtttcagagtttcagaacagtaccgttgaagatactagtcacactgaagtttacaaaagttacatataagagaacaaagacttctttcatcatttagacagagttggtttgacaaaggttttcagcaaatcacatcaccaaataagaaactaaacttgctgacttagcctattgcactaaccactaaactcagcttcctcccttagctacacagggaagaaacacaggggggaaaaatgccaccctttttgaaacaagcaaacttttggaaaatggccaggtctggaggctgacttgtatagtgcatcattttatgagatgtataccacacccagaaaccttgcagaaatcatcatgacagagatgagataatctcaaaactttctgattttatgtggcgatcatttgccatgctggtagaaggttttatgagaacttaaatgctctcttctggaaataggcagtaattctagaatcccagaaaatttaaatccatgtcaatttgatatgtttggacagttgacagggaaatagtactgttttaattccatgtatatagggcataaagacacatattaaaataagaaataaggaccagatcagaatgaagcaccataatgttaatgaaagcaataagttcaagggataattttataaaactgtcattagagtatttgccaaagagagagttgcattatctctatcatatctctcatttcactataccagagcctgcataactgcagtgattattttaggacttaagacaaatactttatttattctaagaacacattgatatacaacttatatatcacatataagaagtcaattgtctctttttgtattagttttgatcagttagctgatgaagtctttgagtcttaccccaatgccggatgccagatttcttttccagatacttggccatatccccattacagaaagtttgggggataaaaggaattcttttttaaaaatgaaatgtttaacattaatttaaacctctttaagaaagtaaatataaaagaagaggagtagagagagtggtgacttgctccagtgccctaggcaaggcagaagaattgaactttattaggagaccactaaggggactgtcctgcctcgtgagttacaggtattgtaagccctgtgaagcacagctgaattactcatgaagaatgttttgtctcaacacaagactctgattattgtcttggtcattatagtttttcattttttttaagcacaggcagcgaaaggaggggttctgccatgctgatttgaaaaggagtccctgctaatagcatttcgattctgcttacacattcacaaccacacacatacacaaagcattttcaactgggtctacatttcttcaatatttattggctatctataacagggcttttgaagtatatgcaggaagggagaaaaatctttccacaagcgcacctatgcagggtatgctgacattttgacataatccagaaaatcaaccattaatctttaagctttattataattgagctatgtacacaacagacctccctgacaccttaatccatccccttgccttaggaaacacatcaaaatgtaaaaatcttttgttaaaaatttttctcaccaaacaccatggtgaatttaagatcttaacagacaatatacctggaaagctgcagccaaattttatttgtttgaagacacatataatgtgaccaaatgtttgaggatacatccaaaccatgcactaggggaacacataacagcaacagcaacagatgagttgacactaagggtagtaggtcagggacatctgctgtacatactacttggcagtttaaaaaaaagaaaactgtctttcaattttgacatggctgttttgatgctgtcttatttttttttaagtcttactttcctatgttatataatacacagcaagagccatagaccttataggtcaagactggagacagagcaacagccacaggtgaggatgctgaggcctggccaaaaaggcctctggaaaagggaaagatgcagtaagaccaccgttggcttttcccatccttcagcagctaggaatctgtggctccatagctcttcctttcaggcaagtctcaggctggctggaaaggacaatctccaagaaagtagaggttgacctgacaactatgcacgcaactgaaaacacatctaatatctgcctccaagagaaaggaaagcatttagcaataaagacaagctaataatatgcctgatattccattatttattcagcagtctttcagtaacttttgagccaagcttcatgctaagcactgacgatcatacatcttataaacaaaattaaattcctatcttttgccaaattacctgaaaatacctagacaggctttttcaccatatttggagacagattaacttaaaatataggtatctcacataactagatgactttccctccagggaagctggtggtgtttatttctatggagctacttcccagcatgggccaatctctgggtatgctccatggtgacttagcagcagggttaatgattccctgtaacctcagtaggaagatcagctagtttatgaatgaaacagaaatggcctctaccctcttggagctcacaatctagtggaccattaattttcaacacacattcacatacattactacacaatccacacaacaatcctggggcagccagaacaagtatcattacacctgtttcatagaggagacaaatgaggtacatgacattgtgatttgctgaatgtcactcagctcaatggagaaaagctggcactaggatcctgatgctctgagtctctaatgcagcacatgttaaggcatctgtatcatctcccggttgatctatgtttttattccccttgatagatcaattagaaaaggaaatctatgcctacttttaaaagacacttcccatgctctgacaacttcaaagggttccaagataagaaggcaaagaaaggcatctataaagctagagtgaatgccataaatggagcaaacctctattattacatggcttgttatagtttctgacgtgctaagggttatgtcatgtgtgtagatgaaactagaaagaacaagagaaagatgaattgtttctagttccacatccactgatgactttcttatttttctttgggtaaagaatatttggtctcagtttcttcatttatcagggagaatattccttgctctactgtccttatggggttggtgagaggctaatatcacaaaagctctttaaaagtatgaaggtgtctacaagtcccaagaaacattaggaaaagggcccagcaatagagcaattaaaacctaaagactcagggggagggagagcatcaggataaatagctaatgtatgcagggtataatacttaggtgatgggttgataggtgcagcaaaccaccatggcacaagtttacctatgttataaacctgcacgtcctgcacatgtatcctggaacttaaataaaataaaataaacctaaagactctccagacacagttctgtagagatgtgaggggtacttcacaaaaataaaataagataatctctctgctttcttgatggaagagatgtgggtttgttttttgtttttgtttgtttgtttgtttgtttttctggctttgggaagagaaagaaagctcattcaatattttccccatcctcttgatcccacttctacccttaaatataaaatattactattgtgctcatctcctagttgattcatctttagctattcctttgtggcctgcagattcaacaacttcaatatgcacaatttagagctgcccttgaagaccatctagaaactttaggtgcttccaaggtggcctgccggccatctgcccaaagtaaccaaccatatggattttattaaactatctccattagtcctccaaggtaacctacttgtttatgagagcgtttcacagcccagaaagcctaagggggttaagtctccattctttctgaggctgccaactctcacagacagcatcagggtaattaacatcacacaggacccccagatctttgtgagaactctgaaactctgtttcctagaagaactcatctaaggatctcactttcttttcttatctgacacagtcaaatcatctaatagccttccagttaaaggaatgaggcccatctcttcaattagactttacttgagttcacctggcaagcctgtgtaggttaattatttacagtcctccttcatgcagaagcctaaaaacttgaccgtaaggatcaagtaaaattcgacttacgaaaactcaactaacaaggacaattaactggaatgcttggttgcactccacttttgaaaggaaaaggcaacttagacacacaaaaccttgataagaattttttccccaaaagcctactagatgatgtcctgcagtcagattcattctagtcttcaacatcattcacactttggtcagagagtaaatgtattgaatgtttatcatagcaatttaggcaccaggtatacagtacaggaaacattgacagaacccttaccttcaaggagcttgcattctgttggaaggagacaaaccataaacacataaaaaatagatgtatagaataattccaggtacggataggtgctccaggatgctataataaagaatgacttagggttagaaaaatattttaaactgggagcttgggttggatggagggtttagggaaagactcattaaggaggtaacattttattagagacttaaatgataagaagaggcagctatgtgaaaatctgatggaaaagtattccaaacagaagtcatgcgaagtacaaaggtcctggggcagaaacaatcctggaatgtttaaaggaaggaagaaaaccactgtggctgaagaatagtagcctacattagaattatagtgatggagactgtgtgaaggaatcagatttatgattcattttcgaggtagagtcacagaatttgctgatggattggataacatttatgagcaaaaggaaagagccaaggatgactctcagattttgggcctacatcccttttcagtaatcacttatgaaatctatagtcacaagggctgaaaaggtatactaggactggttaagaaattttccaaagcgttggagaacgttagctgtctgaagggaagattgccgttgttataactgttttacacacatctattgagatataattcatatatcacacaattcatccatttaaagggtataatggttttgttatatcacattattagtttttttaagttgtgataaaatatatttaacaaaacttgccattttaaccacttttaagcacacaattcagtggcactaattgcatccacaatgttatgcaaccatcattactaattccaaaatattttcatcacttcaaatagaaactctataaccattaatcaacttctcattccctcttctcccaggtcctggaaacttctaatctatttcctgtctctatgaatccacctatctaagtacctcatataaatggaacaatatgtccttttgtgtctggcatatttcacttagcataatgtcttcaagcttcatacatgttatagagcttcattcctttttaaaggctgaataatattccactgtatgtatatgccacattttgcttatctattcatctgttgatgaatacgtgactatttgtgaataatgctgctataaacattggcatacaaacatctgttcaaatccctgctttcaattctttggatatacacctaggagtaaaattgctggatcatatgtcaattctatgtttatctgctataacttttttttttccaagatggagtcttgctctgtcacccaggctggagtgcagtggcacaatctcagctcactgaaacctctgcctcctgggttcaagcaattatcctgcctcagcctcccaagtagctgggattacaggcgcatgccaccacgcccaactaatttttgtatttttagtagagatgtgtttttaccatgttggcccctgacctcgtgatctgcctgcctcagcctcccaaagtgctgggattacaggcgtgagccaccgcacccgatctgctataactttctaaaagtctattttgaaataaaatagatgagggcatcttctgttctgttttcttctcattcctgtttaaacaatctcagtcttgaggcaatagatgtttctgcttcagtaggaagagggatgctggataactggtgttgggggcagatctgtagttaatatcacaaagtttcatcttgatatcatgaatgaagttgaggaggaggtatatgtatgtatgcatgtgtcaaaaaagatctaaagccttgtctacaccacacatttatacaaagccttggacattttagttagtggccccgacttttagcaaaaacttaggggagcatgcttcccttttctgtgtttgggttgcaactctggtgcctcagcaggattgcactagcatgcaggcaaaggatgataaaaatggaactcattgtcctccctctgttttaaatggtttagaatgttacctgttggaagagaggggcttggatagagataatctattgcatttctctccagtcctgattgcatgaatctatctataagctgccctcaaaactgatcttctatctgtatactctgtggtgacctaatgaagatgtccctgaacgtggttaacttctatgcctagagaaatctgaattccagaactgagtcttaattcccagttttatcaaaattcttatgtgtttatagcctgatttatttgactctcaactttacttcctttgagtctggtctgggttacagactattatttttatgagaaatattttattttgtttttttttttaattaaggtatgttacaaataaaacttacatatcctgtcattcttggcaatatgaattcaccttgagggcattatgctaagagaaataagtcaggtattgaatgaattatctaatacctaaatccaataagcaaaaatagtctgttagttatctctctgttaggggtatgcttgttacactcaactcatattcttgttcttttttttttatttattttcattttaggtttgtgaaggtttgttatataggtaaatttgtgtcaaaggggtttgttgtatagattatttcatcacccaggtattaagtccagtacccaatagttatcttttctcctctcctctccctcttccaacctttcatcctcaagtagaccccaatgcctgttgttcccttctatgtgttcatgtgtgctgatcatttagctgccacttataagtgggaacacatggtatgtggttttctgttcctgcatcagtttgctaaggataatagcctccagctccatccatgttcccacaaaagacatgatctcgttcttttttatggctgcatagtattccatcgtgtatctgtaccacattttctttatccaattggtcattgacgggcatttaagttgattccatgcctttgctattgtgaatagtgctgcagtaaacattcatgttcatgtgtctttatggtagaatgatttatattcctctgggtatacacccagtaatgggattgtggagtcaaatggtagttttgcttttagctctttgaggaattgctacactgctttccacaatggttgaactaatttacactcccaacaacagtgtataagtgttcccgtttctctgcaacctcaccagcatctactattttttgactttttaataacagtcattctgactggtgtgagatggtatctcattgtggttttgatttgcatttctctaattatcagtgatgttgagctttctttcatatgcttgttggccgcatatatgtcttctttcgaaaagtgtcttttcatggcctttgcccactttttaatagggttatttttctcttataaatttgtttaactgccttatagatgctgggttaatacctttgccagatgaatactttagaaatattttcttccattctgtaggttgtctgtttgttgacagtttcttttgctgtgcagaaactctttaagtttaattagatcccatttgtcaatttttgcttttgttgtgattgcttctggtgtgtttgtcacaaaatctttgcctgttcctatgtccaggatggtattgcctaggttgtctatcagggtttttatagttttgggtttcacatttaacagactatttcttgtatcagtcagtaacattgattttccaacccactgggtaaagaagtctgtcctggacactctgggaataaaggaaatgccattcatactgagcccagtatgcagaaaataaagaagacaggtgatttcatcaggaacagtttctaaaaaagagggcaatttaaaattatttggagggagaaaagaattcaaaaatagttcaagggggatgtgagaatatttttgtggccaagaaagaaaaacaatgaacaataagaccatggctttatatcacattaaaccatggccactattgactaaggtagttagttttctctagtgttcacattaagatttgtttgtgagaaatagcatatgtatataaatttgggggagaaggatttaggagagataaaaacaattagtttctgagaaagaaattattgctttggaacaactgtatcatagtagaaatcaatatatagactgccaagggtaaactgggaatcattcctagagatcaaggtgctctggacatggtcttatttctaattttaaaacttacattttgcatgtgaaggtgaggttcattaaaaatgtgctctccaaagaatactttgctttcctttaaatgagcttcgggaatcaatgttgaaaagcaaaatccatctacacttttggcatacaatatcaaatgaaagaggattttatagcaaatctttcatatttaaaagcaacctcattacattagacattgtttcaaataaaataaacagcccctttcctgaacatgctagtatgaataagataatcataaaaagagtcaaattaaagcccctttgccaagaagtttgaagtttgatttccaaatgtttgtattcgccaccttcctctgaacacacacacacacacacacacacaattaagtacttatgattagcatattattgaagtttattatatatgaaagtcagagagaataaactgccccaccagccagattcttaaaaacacttttgctccattttcttggcctgggatttcagccaactgtacaaacaggaaggttgggaacaccatggtcaataaccaaggaaaaatataaataaattcaaggagacttggataaattcatacaatacggatacgtggaaagttgttaaagttaagggacaggtacttgaaggacactttcacgaaggacactttcacttttagagttgacatccagaagacaaccatggcttcccatagtccatagtcctgtcttaaaacattcttatctggaactgcccaaagagcagacctatagggactagcctataattttttacaagattgtttacaaacacagttgtttctcagttcgcaagaattgagactatttagcctgaagaagatatgtagcagcagaatatattagaattgtcttcaaaaatttgaagggtagacattttaaagatcgactggactgttccgtggggccccaagggacagaacaaagatcaaagagtggatattacagggatagagattttagatcaatgtaagaagaacattctaatatagcaatccatagataaaatgagctatattcatagatagtgaggtgttcatcattgaagggactcaagaataggccacttatcagagatgttgaatagaggactcagtaatctgatgaatgactgtactcgaccagtgttttccaacactgtgtatataaaatcatttggggcactattttaaaacatagactactgggtctcatgccccacctcaagatgctaattccatgcatctgtgtttttccaataatctgtgtttttgaagcagcatcctaaatgattacaacacaggtaaccaagagccactctttgatgaatatttgacgattttctgctttgcttttttttttttttccctatgcaaaggatgcagcggggaggctggaagttgggcctgtggtgtagagagaagcctgagtagaagtagctggggcctgtctgacatgaagtggtgtcttgagagtgatcacagctgactggctgaggtcaagccacccgctctctgtgttcctgtcagggattgagaaaaaggaaaaacctttcctctaatcaacagggaccagtgggagataattgtttcaggggctggaatctgaggtcgaattggcactgtcgcattgatgctttgccaaaggtttagggagccccaaatgaagatctctatagggaagctcaagtaatggtatctggctgaagactatgaacaataacacaccctgaaaactaaaagtaagagcaaaattaaactgcaaagagagaaatcatggccaaaagccttgaaaggtttacaattttgatcttcttctcctctgatccagataatgcccttccttttccactgcccatttactgggtgagtcttgagtgaccaggactgttgtatttatgtctttatggatctttcagagagccccctgattcctatcctagaggactgcaggtggccaggtccaagtgctggttatcagtggagatcttcaattagtatgacctaggtaaaggctgtgggtaaaaggaacttcttagaaaaatatggagcagatgacaaatatatatcaggagcctggaaactcctgccctttggagagaagctctctcctactttcctttacccgacccttacttccttttctctttccttcctttacctgctgggtcttgggtattcaggactgttatgttagtgtctgtacagaggcttcagggaaactccccacaagcactcctacctgaaagaatttagatgaatagccatagatattagtcagcatgggaaaataagagccacagaacctggaaagaagtagggacataagcaacttcataaaaagaaagaagaaaatggagtagaggagcagactggtcaggagcttggcaacttatgccaacctaaagaagctgtcccactggccctttctgagacctaagggtctcaggtggtgaggacttctatgttggtgtttttacagaggttttaggatggacaaaaagaagagctacccttcacaaaggaaagttcattaaaatatggttggaagctatgggcaagagaaaggtccttaaaaatgaaaagggacagaatgagagattgcaccaagagctttgaacccttaacctttagccaaagatctctcctactatcatgttatccctcctccccctccctccttctttgtccttacacttgccttttatgatgaggcagctctactatgtgactgcattttggaggcttcagagagcctcatgcctccaagttcccaatctagaggactgtagctgggtagacataaacctggttaccaagaagagctcaaaattaggaggatgtaaatgttatcaggaaaagaaacagattttaaaactgatacagaaggaaaagaaccaggagccaggaaattcctgccctgtagccagaagcacaaccctaatgcacaactccttattccttactccctttctctttgcctatttgacctgctgggtgtgggcattgggtaatcaatgcagttgcattcatttacaaaggcactgaggagaccaggggtccaaccttccccacacagaagacttgtgggtggacagccccaagtgactgaatggcagggtgaagcctcctgagagtaagtggaggtgatctgtgaggagaatatgagctgcataccctcctttagtatctttaccagcgagagttagtgagggcacatctttaagaaaagagtggtatggtagatagtacccagactgaagtgctagctcttaggcctaaaagaaagaagtaggatttctgtaatcctttctccctccctctcttcttccctcccttttgttaattctacattgccattgccattttaacctgctatgggtattaggcaaacagaagtgtgatcatattcaaaggcacctatccatggagtgggcataaggtatcttttgaatacaggcaccggggtggcgataggagagttccaattctcaagcaggagagaaatgttttccagcccagagggcagattgcccagcctttatctacatcagcagttgggcacagttgatcaattttcgaatcagtgcaggctttgctgattaaggctatattatggacattgctcagcttcatatgtggttaagctggacctgttaacaaggtacatagagtatttccaccacaaattatttggatatctgatggatatttaagaggagccatcccttctttctaactttctttggagtgccatcatctcccaaacatacggatcctggcttctgcagaaaagagaactctgcccttcccctccctggaaagtaatactccgccttttatgaagaccagatcagtttttataaggctagggttcaatattttttcactcttttctactaggacccttgctattaccatggatacctattttgccccttgacactttggagatgcagtacagtatccattgtaccaggatctcccaccttgaagctctttttactggttttttgttgttgttgtttgcttgtttgtttgttttgtcttccaggcaatttccaggcttgcctatcttccagaccaaagattaccaaaagctagttaaaaatatttgttatctttaaggctttccctttcttccaaaatctttgactatacaacacagcaggaccctgccttaagtaatccattaatcagacaattcacaactgatgaaagcaataaatagtaattactcacattggaaacataatcttccctagaaaacagagatcccttagtgcatttagtgcatttgggtgctaacagatcattaactacttgtcagagaaacctaggaggagggctttcagaaataaacataaaacaacctatgcatcaatagaaaaataaaatttgattttcaaaaacgaatctaatttatggcacagcttttttctaggaattcccctgttatataacggaagacatactattttctaggcaaagcagcacaaatcagggaaaggaacatttaaaagtgttggaaaacttacttgcctatgttgagccaatctatgtaggtatggttacatcattctagaagtctggtagtcaatctcggagtctcctttacacacactggtcattttttcaatacttttggatccatgtcttcctaatgctgggctaaatattcagcatgtgccatgttgctaaaacagaaacaatgagaaacctaaatgttctgcattccttgattttgagtttaaatttgtaacgttattaatattgcattaataacctattttgcatatctgtttgattgtaccatcttaaacattcatttaaacctggggaggtcagcatgactcctacctgcttctcactaataacatgcttttcagcgagtagataatgagtgacctggatagaaatcagtggaaatgcagattgccttcaggtggagaaacaggcaggaaatccactttctccacaacactgacaagcagttttgaggctgaaggtagagaaagtaagcctcaaagagagatgactgtttaggaaggctcttaatcaaatattctgttgtctttacatgtggtagtatgaaggaaaagtcatcctaatggaaattaaatcttgcaagtgactttaaaaatcttgggttaatagaaataagtgatttaattatggagagaaaaacagataactcttggctactgattatcctaatgggttacaggcctgaataagcattccttagttcgttgaattaactactgttagtggcacacaggtaaggataggggtgggaagtagtgggcagtcaaaggtctgccattgattgatcagagctgggatagaaggcaatcaggtgagtcttaaaggagaaccacataattttttttaagtattaatggcccactccacttttctggaataacaaaatatattaataataatgcccttgctcaagatatagagggcctgtttttcaagttactgtatttctttggtaataacgtactggcacagaaacagggacttatgtgaaatgtatttcaaaccaatgtctgctaataaattatcccacaggccataggtttcacaggtattagaaaatgcatgagatttgggccggatgcagtggctcatgcctgtaatcccagcattttgggaggccaaggctggcagatcacttgaggttaggagtttgagaccagcctggccaacatggtgaaatcccatctctactacaaatacaaaaattagccgggcatggtggtgcacacctgtaattccagctgtctcaaaaacaaaacaaaacaaaaaaaaacacaacaaacaaaaaataatacatgagatttggaaatgcaacctgggctttcagtttctctcttctaagttctttacgattcaacatggcttccttctgcagtttgactatttatcttcactgaataaaggtgatagctgtatcagaaactcaagtcaaaccaaataatggtgtgatttgtttactttggagggttttcagactttggttttgtttctgttcgacggtggtaataaaaacataggtctgaatataaaacaacctagttttctacttgattcttgaaaaagaaaaaaaactttgcttcagctcatgagtctgtttcttattttttgttttctaatggagtttgacttgcaaatctgcaatttggcagcatttatttctgtttggggcttttggtatagcttggctcaagtccctggttactgtatgacagcaaccaagccaaatggctgtaacattcaatctgcccaattaaaaagcgttggttccatgccccctttggtgactcagatcaggcaaatttactgttgttttaatcttgattgtactcaattattcaacccatctctcagagctgatacagataactattttttaaaaaccttggggaattgtgagtgttgtcacctggctgctcactccttttggaattcttcccttggaaataagagtcagagagagtaggtctaaacaacttaatgtagcaactcacagagccagaaaaagataatcaggctacgtagaaacttaaggagtgcaccttttgttttttccacaaatattttcttctatctgctctttttgaaataaagtatggttcttaaataagaacagcaagaatattcttccatggaatacctagactcaggagttcatttattttcaattttacacaattaggataaatgtaaaggaaacagtttctgcacgtgcctaaggaattcttgcccatacaaataacacagcttacctttctctagagaggcttccatgagcacaggctgggggagctattccagagctacatactagctctgaatagagcagaagttaattccccaacctacccccctgtctctcaacccagatgatagccagccctccaaatggtgcaggcaggatgtccatttgatgtagtcatcacctccataatcagagtaaactagaaaaatattataaaatagggaaagtggttcttggtgctgttttctgccttttagttcctctctgcttttccttaagctgtagacctatactgtccaatatggtacccactagccacgtgtaactatttaaattgaaaataactaaaattaaaagtaaatttaaaattcagtatttcggtagcactagccacatttcaagtgctcaatagacatgtgtggctagaagctaccatattggagagcagagatatagaacatttcagaaagttctatgagatgttgcttccaactattagttcttttagcttcttgagcataaggaacatgttttccacatctccattccttacagcaggtaccacaattcctgatacaactatggaattggggagaaactaagtgcttactatgttgtcgtgagctatgtcaaattcattataagcaatctctcatttcattacctcaagaacactataaggtgggtcctattaccatccccatttttcagaggaggaaactgagtctcagtgaggttgaattatttgcccaaagtcacacagttaataagtacctaaaccaggtctttataacttcaggacctatactcttaacaactgctgtgtacaccaaaagaaaactgcacataactacaaatttcaacatgggacagacaggccccttccagagcattggtgactaggtggcttctccacagcactcatgctggccaaggcagaataaagacaatttgagatcagggcctgagcatgaagattggggacttaaataagtgtgctgatttgtgtttgcatatggctatcagattaagtggctatctgactacttctctaatgaaatagcagcaaattagtagttttatctgccattttgcatatggagaccattgccttgaccccaatggtaaagattagtggaacctaatcatttcatgaagtcaacctcacttgctgcacttatcagaagcttctgtaacttgagcttccatggcgtgcagtttatgccaggacacgcaaatgccagaaaatcaattttcctgcagctttcacagtcagtgtgtttgccagacaaaactgcagccagccaccttttttaaatcagcatagcacctttagaaataatacttaccagaacgctcctaacacagcaaggaggaaaagacttaaatctaaacccaactgttcaaaatcgagagccacaggagaaggtgaaatatgaatatattgaaagtgaacattttagtggccccatttggcactgtaaagtattctctgccaagcatctgttgagttaactttaattctaatctgtgccacagtaggactgaaaacacttaatatgataccatacttcctgtcacccacatgtgcccaggccctcacgtgcccctgacatatcggggtggcactccacattgcctgcctgccccaagacctatcttgattcttcttcctctggtattcttctggcacacattctcaaataaaccaaaccacacaaaggcagtggatgtggggtcatgttaccttcccatttgccatgagtgcataatctactttattgaagacttactacttgccaagaactgttatgggtgctttacatgaattatctcatttagtagtctatctccatttcagagataattattagagtcttagagaaatttaagtaacttgaccaagtcaaacagaaggcatgatctctaatggtagcatttagggcctgtgacaagctagtgagttatcatattggtgccttttacctcggagcatcttgcacaggtttcaaagctgaaccaagaaagaagatcaaggttatataaaatcatgtcaaaacaacaggtcaaagaagtaaacttcactcaattcactagttttggtcaatgtagctactaacgatctttccactgggaggcagtgcagagtagtagaaaaaaacaacacaggtttttgaaagccagcacacctggatttgaatactaattctgtccccctgcatctatgcaaacttggaattataactttacctctctaaactctggaagagagaagaaggagaatatagactttggtgtcaaatgagctgggtttaaatctcagctacgcatttattcattcagttaatatttattaagtacatgctatatgacagccattgttgtaagggctcaaaaccaaagtccttgtaatcactgtagtgggtgagacaaaattaaacaaattctgtaaataacatatatgtttctgttggtgttaagtgcaatgaagacaaaaagctggtgaagagacaaaatgttggtgtggaggtgctatttcatcttggctgattgtggaaggcctttctgacatttgatcagacaccctgaatgaaaggaaggagcaggccatgaaagtatgaggtggagttgcgtggagagaaaagcattccagatggaatagcgttagcaaaggccctgacatgggaatacacttggtaggtttgaggaagaaggtccatgtgctagagtgaagtaagtgagggaaagagtggtaagagatgagagcagtgaagaagacaaaccgtggtaaaaattctggattatattctgtttgacagaaagtcacttagccgactttgagcagaggaatgacatgatctaatctatgtgtaaaaggatcaatcagactgctatgtcagggcaaaagttgagaagcagggagacagaccacttaagaagtgattgtaggccgggcatggtggcttatgccaataattccagcactttgggaggccaaggcatgaggaacacttgagcccagaagttcaagaccagcctcagcaaaatagtgagatctccatctctacaaagaaatttttaaaaaattagctggatgaggtggcacatgcttgtagtaccagttactcaagaggctgaggtgggaggatccctgagcctaggaattcgaagctgcagtaagctaggatcacacaagtgcacgccagcctggacaacagagagagactctgtctctaaaaaaaaaaaaaaaaaaaaaaaaaaaaaaaaaaattaattcaatttaaaaaagaagcaattgcaatatttcaggtgaacaatgattagcttgaattaggaggagggtagggagaagtggttgcattttgaatatagattgagctgacaaggtgtggaatgtgaggccaaagagaggagtcaaggatgactaaaaggattttgacctgagcaactggacaaattggaaggtgctgccattttctctgatggagaaccctagaggagtagcaagcaggggtgggggagaatcaagagatccattttggccatgctaagttggagatacctatgagatatctaagtggagatatcagttaggtagatggataaatgaatctaaactttagtgaggtcagagctaaaaatttaaccagctgtatcaccttggagaagtaaaataacttctataagtattagttaacttctcagtaaaatggagataatattggtttcacaaggttgttttaagaattagcaatcatgtatataatgcacgaagcaccattcctgttgcatgtaagtgcttaataaatggtagccctctcattgtcagtatttatgcactaattggtagctagttgttgcagctgtaggaccattgttgattattctaaacacatcgttgaatattagaatcacttaggaagcattatttacaatgttggccccgcctcaggccaattaaaccagaatcacagaagcagtcatcagtagcttcccaggtacatagtatttcctgctgacaagctggctttaacagaacttctcttcagattagttccagctcaccttttaggaaactaacactccccccccaaaaaaaaaaaactctaaatggaaaatttgggctcttttggataaccccaagcaaattgcttcttcttttcttcattgcttttttctccccttagtaagaaaataattctccagggacctggaagtaacagccacagtggaaacaaaacattgcaatttcaggatagatttttcttcttaatagaagaacattttcccgctcatttcctaggacctgtattgtcaggtttggcctccacactacaattaattgattcaagaataacaatagtattgaacttctcttttgaatatcttagtaatagaaaataaaaatacatttaatccaattggtcaatggtaattggctttggattgctggagatgccgtttcattgaaaaatagaactctagaaggctgagggaagtgaccttggagtgttcaatagtgatagcagtcctagaagcaatccttgattgagagtcagggaatttgaggctttgctctagttagtagtgaaagggtgtggcagacacactttctttgtgacccattctctgtcttgaaaataggttctgcaacttttacactgttggtgggactgtaactagttcaaccattgtggaagaagtcagtgtggcgattcctcaaggatctagaactagaaataccatttgagccagccatcccattactgggtatatacccaaaggattataaatcatgctgctataaagacacatgcacatgtatgtttattgcgacactattcacaatagcaaagacttggaaccaacccaaatgtccatcaatgatagactggattaagaaaatgtggcacatatacaccatggaatactacgcagccataaaaaaggatgagttcatgtcctttgtagggacatggttgaagctggaaaccatcattctgagcaaactatcaaaaggacagaaaaccaaacaccacatgttctcactcatagatgggaattgaacaaagagaacacttggacacaggaaggggaacatcacacaccggggcctgtcgtggggtggggggagaggggagggatagcattaggagatatacctaatgtaaatgatgagttaatgggtgcagcacaccaacatggcacatgtatacatatgtaacaaacctgcacgttgtgcacatgtaccctagaactgaaagtataataaaaaataaaaaataataaaaaaagaaaataggttctgcaatctaaaggtgaaggtacatagcaaagtcaggttttcaacacacacacacacacacacacacacacacaaacttctcctccatacccaattaatgtgtccaccattaggctatcattcctttagctgtggtttgatcctgtgaggagatcacacttttgtatattgttcatcatttctacctcagtgtgaatgtttccaattcttttctgagcacaggatggggtggggagggcatcttttacctgataaggcaaatgaaagagaggtggtactacccacgcaggggagtggaaaatgaggagcatctgtgaaaataaaagttgactcacagtcttggcttataacagccatataagttcaatacataacgttatactccttatatattttcattctcaaaataaggagaaaaaaataatttgtcaacttctggtttaaaaggtagggttttcatgtggactaagggtaagacactttagtctccaatcctacatttcagggagggaataatagaaatatcatgccccttgaaatgatgctaaagtataagcatcatttcaatcagaaagcagaatttctgtgaagtcatcccaaccctaccacatggcttaacctatctaggaatagtgtactgtttgagagcagactctggagcctgaatgagttcccagatccaccacataccagctgtgtggcattaagcaaactacttaactcctctgtgcctctgtttctgcatgtttaaatggggtaatatataatagtataatctatttcatagagttgttgtgagaattacatgagttaacacatgtaaaacccttgaaatggacctggaacaaaaagtatgtattcaattaaatgttagttatgatgggttttcttacttaaagatggcttaatcaaagtccatatagcagagtttctcaaccttagcaccattgacatttggggccggataattactggtggtgggggctgtcctgtgcattgtaagacatttaacagctccgctggcttctacccactagataccagtagcactcctctccccaagttgtgacaatgaaaagttgttgccaaacgtctcctgagaggcaaagttgttgcttactgagagacacaggggtagagggtactgtttcccttcctccattctcccagaatagagcaatggtaccttagaaacattttctgaaagaatgtgttgactctagctttcaaagtcacatggccactggcactattttcaacccattggaatatgcttagtctgactcagcaagagaagcagaagattaatcagaacagtaatctgactttgcataccagagagggacactagaaaggtctcaggaaacttagctgattgtcacctgcacctttggaaaggagacatcagaaatagcccttcttgaagtggaaggaaacatgtccctggacttgtgaacacagtttgaaactgttaagcaaagtcatttacatttgagggcaaaacttaatgtctaggcgaaaggtgacctccaactccaatgaagttatctaaaagcccagccctcaaaataactcagtcaggctcataacacacaagtagaaaaactaagaatagaaaccagaatttctttcccttcctttcccctgtgttcaccaatacacagtctcatgacagctgctgattgtctgaagcaaaaggacacagacaagcagtacttctctgaatgttaaaaatgtgcaaacctaagtgaaggaagaaagtgaaattggggttttggccatgcttagaaatgatatcatttgttgtgtgccttgctccaaatcaaaatggaaactatttcctttactttagggggaaaactgtaaaaatcaatgattcctttttccaaatgcaccttattagagctattgacttcttcaaaacataagtggaagaaaaaaatgtgtccgatgcatttggcaacccagatgtatttttcttcttttgcctcaaattgctctgatcactttacatggtgaagtatggacactaagggcctatagcagggttacaatgagtgacaagaatgttcactaattccagtgccttagtgagaggggatttggagttaatttacaatttaccccaacttcaaaaaaagcttggacaagaagcaaaaaatgtttttggaggtgagttgccctctttcatcaaaaaggatattgtcagtgctaaagcaagcaaaagaggctggggttatcacggggaaagatctatctgaaacctttctagttgacttggatagtgtcccagccttgttcctcattagctgtgtgacctaagataagtagttgagtcaatggcaaatctttgaatttctgtattggagactcttcaaggtggagttctggttaggccttatttggaaactgcttagcaagcacacagcttttttcaggcttgatttatactgagggggtagattcatggaaatgagtgagtaggctaaagcccactatggcacctcttggcattgccactgcacttaccctcccttaccctcagttccatcttttataaaatgggaattcattctttcattcaatatatatttatggggcactactgggcacacacactgttctcagtgctggggagtaagcagtgaaaaaacaatagctactgcacccacctcacagggctgctgtggggtttaaatgagatggtgtgtgttaaatcaccctggcacccagaaagctttatggaaatataaagtttaaagatattcagctatctcctgcttctagtcatgacaaatctaaggcctctctgaataagggagtatttgaaaagttgtatggcaggtaattctcaccacaaaaatctcctcttcatgagtctaaaccaagtgcttgagatttccacagttggagtcttaacttaaagaacttaatttctgtagacctgagacttgtgactacattaaagaacttcagaatgggcccaccccagccacaccttacccctcccttatagtcctaccccacccaccctagtaggacatgcaagcacattgtcctcttccaatcccatcaaacattagaagaggcaaagaagaaaggaggaaaagagggggaggtcaggagctctccagagctgtggcatcattggccttctttccttctagcaccttgccttgtaaggatcacctatgcatatcctagtattggtcaattctgtgaggcaacatttgctcctgaatgttagagaaggcacacaaggcacacaggggtcctgtaagtgttccgttcaggcagatggaggcccaaagccacccttttgaatttttaccacctagacacctgagcctttaataaaagcagaaattacagaggacgctaaataattcagaagaaaaagcagattgtagtttataattatattatcttaaagatacaatctaaagaaaaaatggaccaaattgtcaagcaagaagtagtccacaataaacttagagacagcaaaatgagtgaggaaaagtcatttttgtttgaaactcttgccatatttccctttcttagtgtctcatacacaaggcagccttctccagcccttgaaaggcaccttttataatgccaagaagcccactctcctttttggggtacgaatcccctattcaaatcaaaatgaccccttgctcaggggtaacagaagccattatactgttagtgaacacctctatgaggaccatgactgctgataccagaaaaggggtacaagttatatctctgagggaggcagacagtgaaacagggagaaagtggtagaagatgagcaccccaaagtcaaatctagcccctttgacatgtatgtacaaggctagtcctgtacatacaatgatggaaatggacaacataggcatggtggcaacagtgttcaaaaaaataattacatgcataaagctggcccattttcctttgaggaacactggaatacaaagtgcctaaaagtatcttccccgacctctccttcattacatgttggggaatagagatgttacaaacaccaatactgtctttacaaattatgtaatactttgtctgcattctgacagtaaattaatagcataaatgaatagcatattatgcttctgttgataaacatgcttccaatttattagtccattttggtaattcagttaattctgcactatcaacatatgggaaagtggatgttgaaccctgtcaaattgaggaattgtgctcatgtcaagaccacgagaagagatggttccattgtcctttatgttaatgtcactatatcaagcatattgtgctcaatttgggaggccacattttaggagggactttaaaaaaatgaaaaggtatctagaagattgtgaccagaaaaggtgagttgaatggaatttgtgtcataaaagtaacaaatgaaggcccttaaaatgtttagcctgcaaacaaggcaattaacaagtgacactgtggcagtagattccaggctgtacatcgtgtcgggaagagagcatactgattctctattgctacaaagagaaaaattaggaccagtaggtgacacttcaattttaatattcactcattccaccgacacatagtgagagtttactgtgtgccaggcatcatgctacacacccgtggtgcggtgacaaaaaaagacatgatccctactctcaaggggctcagatttggctggggataaccattgcaaagcaaaataatcagtactccctacaatggagaaatggaaacagagaggacgtactgcccaattcaagcaggagacagaagtaggattggagaggagaggctttcattaagaatatcagccaaaccaaaggaactttctatcaacttgaattgtcccaccatggaataagctacttcctatgcctcctctgagctagggagtgcctcttcaccagaagcatttaagcaagaagctatcacttcaccgggtgagaggctcaacaaaatggtttttaaggcgccttctagctctaaaattctgttattctactgactccaagtggatatactattgaccaagtggatatcctattttatctcacaggaaagcagaaaattttattcaccaagtttccccagtagcagtgttctggttaatgaggattttaatgtataagcctcaacttaactgcaaaacataaatgtaaaaggaaaagttgccatcctgcccattctcctacaccaacaaaatttttaaaatccaatttcaaatgatagtaatttttgttgatggcagaccctggtcattcaccaggcatatgtctggagatccaaatatacaaataatacttaagcatgtgatttctcccataaaatgaagtaatgattccgtaaatatggcactgaagtaatttataataccattaaaataaattctgtcagtaaaacaaattatactttctttattataaagatatataatgtttttcccacttcctgtgtttcagggattcttctaagtatgtattaacccatttaatttctcccaataaacctttgaagtatacacttaaaaaatcatcccattttatgggtgaggaaattgagacacatagatgctagataatttatgtacttagcaagtgtgattcaaacccaagcagtctgactacatgttcttaagcactgcactatatagttactttgaacttacataaagaatagttttatcactagagagctactatatgcacaatgactaggagtgaacaacaccgttgcaaagagacacaaggtctaagtggtaggcttctgtgtaccagactcacagggcccaagattcaaatcttcacatcaacaaaaagacagatttcttcatatatttgaccttcatgatgtattacgaatagttagagctacaactgttgaatccattaatgctaaggctctaccatatctgctatttgggattaatctgttccttctccatttatgtatttctcctttggattttggttgctaattatctagcagtgcttgagaatttcttatggcctttctttataaccattgtttgttcctttttaggtacaaaatggtgctctgtgggatgaatgaaatgaatggtggtgggttggagaaaaatgaacttgttattacacatcctgcccataaattgtttaacttctcccagatgacagagctaagattcagtcccttttattgccttctttatttcatccaaaataagacagaatgcaaaaaaaaaaaggaaagaaaaaaagaggaaatgctagttttctttcttctttatggtctgaatgttatactgacacttaaatactagttggaaagataaacgtttcagcttaatttctcctacttatgagtcatttcttttcccccttctaatctttttgagaattcagtcatcaaaaagagtccaatcatttctgccactaactgacttgtcatttaatgcattcattaatatctgccacatgtacaccatgtgcatttaaagggcctgcttcaagcactgctatttattctcctagaaatgcatcattacctaaaggaataaaccttttaacctgtatcagcaatcaaagagctcaagtaaatgatgaagtaaatgagtccaaattatagtgcacttggatcagaattcatggacccctttgcccttggcttataaatttatctttggaagcaatggcctgtttgcaaatagtgtaaaagacaaatatgtctgaagtctccccttcctggacccccactttgtattcaggtctggttgggccaagatgaagaacacaaaacagctctttataaatgcacaaaaatgcatacccactacagggttttctataatgccaaaaataatggaaattatctaagagcccttcaaaaggggttgggtaaataaaacatagtgtgttcgtagattgaagagctatgcagccattataaaggaaatatgcttattctagtaaaagtataaaaaggtgcaagggaatagtaaaggctaaattcagtatcgtggttacttttggcgagtagagaagaatatgtatttagggaggggtagataagcagactttaactaacttcataatgtttaatttgttaagctttatggcaggtacacaggtgtttttacattatttttatatctttctgtgtatcgaattattgattattttttaattccttgggtaactaactaggaaatgtctactgaaataaagtccttgacaatgtatttcattacaatgcttaaaaattgtcttatgtgtcaaaagaggataatgtaatatggaatgagcataaatgactatgggtgagattttaatcttagaaggccttgattgttagggattatttggggggaagttattgatgtgggcatcaaaggcagactaagtagcatttaaaaagaggattgaaaagcatatatccaaattggtttagcaaggtactcagtgatttttagaaaaatttcagctctagaattctacagtgctataaagatagtgctggtagccatttttacctgaacttctgatatctttgaccagcaatctggtcgtcaccatggtcaagcctaagcttcagttattaagaaaacttatctttagtctgtcatgtatagagtaatttgctggctgccaagagggctagcaaaattaataaggtatggactttgtcctcaagaaacactcaagtaacaggggaagacagacacatagtcaactcaccctactgcaattaagctctatagcaaaggtatgagcaaatggctttgggaggacacccaaagaagcacttcgtgggggcaggaaagggttaggaaagacttcacagaagacatgacatctgctctggatcttgtagatgaataaggtaatttaagcagaagcaaaagcataaccaaaggcataagacatggaagtggcttatttcagtgaccagtgaatagcccagcatgacctaatcacaggagagtgtaaccaagatcataagcactcttgaatatcatacataagagtttggatttttttttcctgtaggtattagggaactagccgaggattttaaagaatgaagtaacttgattaagtttgcattttggaagaatcactagaggataaattgaagagagagatgaagcagggagactagttaggaagcaagatagtctagacaaaacaacgatggagcctgaccaagggagggcaatggtaatgagaatgaaaagaagatgagaggacagattttaaagtcattactatattagaaaaaacatggcagaatgagggagtgagggaaaagtaaaaccaaaccctttagcttggaggttaggtggtttactgatagaatgtagaaggaaacccaggctttacaaggtatataatatagatttagttgggaaaagtttaatctgaaaatgtctacaggaccatcaggtggagatgtccatcatcagggcttgtttgctatcttcccaaaacacatctggaatccagccttttctttctacctccattgctcccaccctagtccaagccacagtcatctctcctctggaatatcagaatagcctcctaactaatttccctttcttccactctgacccaactcatagtctattctccatatggcagtgagagtaatctttaaaaatttaagtaagatcttatcacacccctcctcaaaatcttccaatagtctcctataacaggtagaataaatccaaactttttaccatgacctacagggccctacaagatctggcctctgattatccacctaagctcatttcctacgactctccctttttctcatttaatttcagccacagtggcttcctttgctataatttgtgcaaaccaaatgtgttcccatctcagtgaagagtttcactgactctgtgagggcttccatgagggtctgattgccataaacacaatgcttaatgtccctggtgatccagctgggcgaggtggctcaggccggtaatcccagcactttgccaggtgaaggtgggaggattgcttgaggccagcaatttgagtccatggtgatagttctggaagttccagccccccctggaattatttgggcaggtccaagcaggccccaagaaagatgcaacacagccggccaaagtctagagaagagcaactaaataaataatcaagaaagttggggtgggggccaggaaaccccacaaaaagacatttgaaaacatggtatatgtttatggtttctgccatgctatctcgacctctggtcaagtatcaccttagaatttttttctaggattttcattcctaaggacctagctcccaagtcaattggaagtttttgagtcattgagtctacaattcttttatagtctccagaatgactaacatagggctagaggcacagtaagcatttaatatatgttctagggaccacctgaattgaaatgaaatttaatgggattatatgcaaaattcaaaaaggtaaagatgaaggagacttgacttggcagaaagaactaagttttggtttgacctcaacctgagttgatggaaagactctattgactctattatattcttccagtgcttctcaataaaaaaaaattttgttgaaaggatagaggaatgactaaatatattaatgcaaattcaaacagcattggtagaaaataatgctccaggtcaggtgctcacgcctgtaatcccaacactttgggaggctgaggagggagattcacttgagcccaggagtttgagaccagcctaggaaacatagtgagacctcgtctctacaaaaaaataaacaaaattagctgggcttggtggtgcacacttgtagtcccaggtattcaggaggctgatgcaggaggatcacttgagcctgggaggtcaaggctgcagtgaactaagatcacagcactgcactccagtctgggtgacagagtgagacgaaagaagcgaaggaaggaaggaaggaaggaaggaagggagggagggagggagggagggagggagggagggaaagaaagaaagaaagaaagaaagaaagaaagaaagaaagaaagaaagaaagaaagaaagaaagaaagaaagagagagaaagaaagaagaaagaaagaaagaaagaaagagaaagaagagagagaaagaaagaaaaagagagaaagaaagaagagaaagaaagaaaaagaaagagaaagaaagaagaaagagagagaaagaaaaagaaagagaaagaaagaaagaaagagagaaaccaaacagaaaagaatgctctaaaataagaagcaaaagtttgttgttgttgttttttcattctgttctggtcatttatttggggtaccgtgtctatttctatacactctaaatagagacagacattaccaactacaatgtgcctacgagtggaaaaccaaagttgtgagagttctggaaacaatatcagtcagagtttcacctgatgaagagatgagaaggggacataataaaggcctttcaataattaaagaaccgttgtacattaaaaaaaagaaccgttgtaaaaagggacagaattattttacatagctctaggggatagtaccgggggtgggggtgtggattaaaatactacctattgaatacaatattcacaaactaggtggcaggatccgtactccataccttagcatcacacaatattcctatgtaacacatctgcaaatgtaccccctgtgtctaaaataaaagttgaaattgtaaaaaggaatgggagttatagaaaaacaaagatcatctcagaataaggaggtactttcttacaataattgatatctcatgctggactgggctgactaaaatagctgtacactaccttataatggtctttgattaggcatatcctgctacgattagataaacatagcaggatattgtagaggagattttttcattgagaggaaggttgaactaacaaagtgtttttcaaataagattgcaaccaattagtggggccatgaaatccatttagtgggtcctgagcaacattatttaaaatgaattagaatagaatagaaaatatcagagagcatcacacatagcaaggatgagtgtggttttgagaacttgttttggaaacaatgtttacgtatgtatgaacgtgcctactaggttgcagtgtaacgtgttttttattactgtggattgcaattaaaaaaaaaaaactactgcactaaccctcctccagactgaatatctggcagctctaagaattcttatctctttggtgcagagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaaggtgggtggaataatataacaatatccgtgttgttatagtattccacctaccctgatgcattttgttgtcattttctttcttgtggattttgaggtaacttttaaaagtttaaaatctacaatattccatggagttaaataagacggtaaattatggtttcatctatttaatgcatccattttttttaatgttctctctctgtgttgtcctctctgactgtttgttgctgttttaattttacagttcaacggctttttcaatttaaatggtaaaagccaagttatggtgccatatgtgacgaatgttaattgcatggatgtggtgttcttgttactttttttctcaaagacaatttccccatcccgcacacttcagttttgagcaaatgttatcctccatgccaccttccaatatttaaccctgtatttgctgtacagacatttttatagctccacgttctgtgaaatttagccaatttgtcctcttgtgctcctttttatacgttaacgatttcctaagcatttgtgcattttcttacaagttatgttttatcgtttcaagaaatgctgttaacctggcagtattaaaactgaatgagcaaggcctcttggacaaattgaaaaacaaatggtggtacgacaaaggagagtgcggcagcgggggcggtgactccaaggtcagcctcaatgtcaccacaaccgggtacccttagtgacgagtaatcggcaagactgttatcttattattgaggagagagcacaagactcacacataaagtggaatgaccaggttattcccctgcctggcagctttgggaaccaaaaagactttagggcactgcccacatttttgatctaacttgggtcccttcttcaactcccagacagaggctccaaccacaccctttcccttcctttacccaccagtttggttgccttatgaaagccatgatgtgggtttcaatgccctaggctttcaagagtccaaggctttcctgtgagactgtccccgcctgcctcagttgagtggtatgaaaaatcagatccatctactgaaaaatcagggcatagccttttgttttctaggttgtgatggttgctcacagaggttggttggttgagtaagggtggcttcttcaattatgtgtctgagtgatgagatgttgttctctatatgtgatagcccatttaagcaggccccacttaacttgaaagccaaataacaagctcggtttcaagttaaatggggtctttcttcaataggccaccccatatagagactttgcagagacattttgtgtatttaagcaagtgcgtcgcctaactgtgatactatatgtgtgtatgaatccctgatttagcttctccttagccatgttcttggttcaggtaggtctaattgttatccaggctgccatcatgagaaaacccatcttacttggcattcctttgacttctaatgctctttggagctagaatgaatgaatagccatcatccaagcaacaagaaataggggcaagctcagaagccgcgatacaaagtcatggaaacacacttcgggtaagtacaggagaggacctgaaaatagaatcctccttggcccaaggggcatgagaattatattgaagcatgtaaactcacctcttgtacgaccaagatcccatgggcatcttaaggtgaagaacagtgtttcccaaccacagaccaacagacaggcaagccaaaacttttcttcttcagagacaatggttgcacttctgctcctctctttccctctctatccctcaggatcctgatggaaaagttagtttgccagtctgcaaatataatatgggtttggaaacactgatccagaacactttcaaagaaatcaattttaaaagaactttcttcagcaaataatcttaccaggcattggcatggccttttatcgtaaaaccttgattaaccagaactcacctaaccagtaccccaactaactgaattgccccttcagtacttcacattgatgagaaagcagcaatagtattccaaaaaagaagactgcaaggaattgatttttttaaaaaatacttaccaagagatgacctatggttgggtcacattcggctctttctcctctatcttctctccatctggattgaccctcaaacgttagaggctgcttccctgaggcgagaaagtagatagaagcattttaagaaaaactgttattagccaacaatgaacaaaatggttgttcttattgaaaattccattcatcccttatggattccaattaatcaaggttttactatgtgtcaaaaagcagtaactttctttcccaccaatgtgaactgatgacactgacaatttagccaagcttttggctcatttcatatttacaatggccaacttgatggccaaagtatttagcacctgtctttttctcatgttatttgcacggagaacctaattgtatcattgaagtgagttgcagaatgaaaattgagctggattggatgcattgctctcacgaattcatcattcatactcatcatggttaaaaaggagccatggactgtaacaagatgactctaaaacatccacatgatgccaagtgcccagaagttttcagataaccagacgtttgatgttatataaacaaacaaaaaaatctgcacatatttggctgactttttacttttcacccagatgttttggtacatgaagaccccaaaactttagaccagctattttttcattacaaccagcaatcaagctttttttccctcagctagtactgctgcaaagttttttatcaagtaactttattgacagctcacgatttccagattatctgaattttgatatgcaaatagaaaaatatttcagtagatcctaaatgttttcaacttctctaaccatagtgctacctgccaggcatctttcaaatcgctttccttggtcattcctacagccagtcttttgaaataagtcaacccttttctcaactatggataatagtatgatcgatcagtgctgcatacccaacgattgcttattccatttctggattaccaagaagcttgcctttgtcttcttccttcttgctacctgctgttttctgagagtgagcaagagaaggggcaagagatgaacgtgaatctggttaccactacgtattagtgatgcaaaaaaaaaaaatcaatggagaaggaggtagaaatagcagtaaaacctcattaatttgaagccctctaattaataatttgtgataaactagacagggaccagtctacaagttaactttatattatcaggcatgaggacaagaaaggtttgttaagcaaatgaagagtttagactggaatgtcagttgaattttttcttaagagaacaaacccttttcaaatgttagaagcacttattagatataatcatattcgttacatatctataggctaaagtagctctcacgaggatctccactaaggcaatgttttatagtcagtttgaattacaaaatagacttaaagtaataaaattgtcattctttaaacctattttgtaatgcaggacttgctttactcattcagacaatcctttccctctgttcctccaaatcagtgaggttttactgtattagcaaaatggcttgagatttacatctcttcattgtgtcccatctcgttaacatgaaaattgactgttgaatataccatcatttcacagagaaagtgcgatccagagatggtgatgactttgagaaggtcacacagctaatgctgtcataaatctctgctgactttcagagtcacctcttgtgataatattgcagatggcaatttagcactaccacctatccaatgagcaatgtgaatctgattgcaagcgatatgtttccataagaatcaggttcattcgcaactaccttggttactaggcaaaaggcatatttaagctgttccagccctcagtactgattactaaaaatgacaataatcacaacgcctgacatttataagtgcttttactttttcaaaaacactttcagacctattatctctgaaaccagaagagggagaaatacctgtatcacttatctttctgtctctctctctctctccaacctttaactaatgataaatgggcaattatattaagtcattgactttttcttccctggcatgagacattacacattctgagattagtctagaaaagttaccatactatggaaagaaacagcaaattttcaggctgtcgtaaatgtgcatgagcttaaactaataaaactaatgttttattattttattttatttttatggatacagggaattaaaaacaaggtcagtctctgaggcagcccctgaaccatacctacaagctgaaaccagaatactccttggctttcccaatttcccaaacctgagctaataggacctaaacaaaacagacttgatcatttcttgatgaactgtaaatgcacatgcaaggatcatgtaaattagaactgtgctttgggaatttttaacctgcaaatcacccttttgtgttcatgctttattacaatgtgtgtgcagatgcagtaattaagagccagtaggttgtttcagtgataaacccagatcaccagggatttgtgacatagccagtgaaagtctatcattgtaaatcacagcagaatggaggatttatgtacagaactaccacataggcacatcagcctccttctgcagctgcctgtcccctcaaaagtttatgttcttatccaccctacttcattcccttaatcttgggtaaagggcaccagcttcgctttcccatctagccttaccttacaagatagggtagggtcagtgaaacgagctatttgtgactgaggtggaaagttattaacaaaccctacccaacctcaccacagaattataccagactttagtcctctctagggattaaaatagactcccagtttccatatattccaagatgaaaatcagcacatgtgtgctcttgggaacattgtaacaatatttaaagggaccattctgagccccttgactgcaatgataattgtaggataggtgggtgccttaacttgagaggcatataaggaaatgagggaggaggatgggatgtgcaattgaacctccattatttaaataaatggtaagatgctcattatgacttatagaatattgatagagaaatgcagttttactatatcttcaaaaatatataggaactagaataaactgaccaatgtgatgctaggaaaaaacatagggaatttgtttaaatcgtttcaaaaaatgcctgcaattaaaatcagtggtgtttcctttcacatgggtgctcttaaggtacctaaaaagagtttgttctctgaagaaattaaaacatgttcctcctccctatcactagctatctttgtttttttaaatcccatgcatttgcttagcaagtcttctcttcaaagatagtaaaaagttacactctcggacagcccatttccaaaatccctcagcttcatatttggtggcacatagatgaatgaggttatactgtatttcccattggtatacatgagatcttcagttttgtgtgtatttcttcttcttccatgtatgtctacaattctcctctcctatgccaccgtctcttaaccacttctcttccacacccagaattctttgactttcttgggccgtgggtaatggatatgaatctgcatctgcctttgcctgcaacaaaatggaccttttattggcaggagccatccctaaaggttgacatttcggatactcagggttaagatggatcccaatgactctttattgacactgttatgtgtgtaggcaagaatcattacagatcgatggcacttcctgggtcttagcagaagttcctgtgaatcctcaagactctggtttgggatcgaggagtagggtgagtatattgtgctcttcgttggtttgcatgattctatgctggtactgcctcctggaagtatgaagaacctgacagttttctttcctggtagtcactaaatttgctccttgaacttactcaggtcttcctcccaagagcaaatcctcactttctctcaagtgactgcttcaagcaagggacctgttgccttaagaactgaaccagtccaatggctgccaaaaccattgattttgccaaatgatattaaagaataaattctaccaccggaaaaaaatgtaatccagaaagaaaacacttttaaaaaataattccattctaatgattttttaaaaaatgaactatggccttaacatggtttctatgattaggacattattatttgcctttggtgttatcctgataacatgaatgtgtttcttattgacaaataatgaccaaatgtccaacaccagagctacagaaagagccacaggaatgaaaagcctgaaggtaagaatgctgttatacaattgccaagaggaaagatgccattgcagtggcagacagtgaaatggtgtatgtttattccctttctgccctttgaagaccaaatcatttggtttcctttcatttgaagagaaggttatacacaatctctgaaaggtaggacagccatggaaaagaaacatgaaaaatttgatgcaattgaaatatatttggtgagggtgggagttggggttggtggaacagggtgggggcaaatttcttttacgaacaattgaattccattctcttttgactttctagagagcggtatagcattcggcccttggcacatgaggctgatccccattgatcagaagtggcaaaagtgtagtccaagtgctggattcacctnnnnnnnnnnnnnnnnnnnntgctaatagagggtggtatatgccctggcatggcaaacagatctgatttcagatctgatatatagacttcacttgttgcaatctagctaaaactgattatttttctatgagtcatggtcaagggatggctattggagaataaagaggatgttggcacccatcagattgaactctcaatgcatattttgtctaggatcaggggaatgagttaaatgtcttcagaaacatacatcatgtgagtttctggtaccgatctgtttctctcttctcattctatgcttctctaggtgccattggaatgaactaaagaaaacacacttatatatgataaaacccaataaaatttgatagtttgatctttcaaaggatcttaaaccagagttttcaagtgaatcatgccaattatgtatttgagaaagtgtctatggccatattttgttcaaaacttagcattttccctgagccccttctctctgtcagggataaattgagtaagaggtcttcccagactattgggttcaactactagatggagaagttgaacagaggtccagtttggcagtttagtagaaatctatcagtgaaatacacaacctatggaatcaaggggtctactgctctgtatttgagaggttgtaatttagaaatgtcactggctttacccatgtgtgtaagagttgcttctggggctgctgctgcagcatagatgctcatcaataggtttcaatcactagcattgttaggcccttagtgaaatgactcacagctttcaactcttaatgttatatgcacgcattattgaattttctctttgcacttatattaaattattatcccaatagcaaggagttaaataggtttgagctatatttgtgaactacatgaatataaatactctctcagagatggtttctagcagctaagcactgcataactgcaaatcattgtagctgcccttgttaaatgaggattatttaggttgccagagttcagtaatgccagcagccatatatgcacatgctcccacgttgtacagaaagcccaggctgatccaaggatagaaggattgaaataaaatcctcattttcctggaatcctacattcaggaacccctgtgaaaacaaagggatagagatttgttttaaaggacttcagacactggtgtactcaagggcatattctgaactgccatggccttaaacagctgctatatggagagataaatcccttcattatacatatcccaggttaatctacagaaaagaatgtaaagtaccacatagtaaattctttaatacagcaaatattcttcttttgcttgatcatcaattggcttcagctaaataaagcaagaccaacctgggcagagatgtctgtgactgcctgcctgtacatgcctgttatgtcctgggtgatgctggggcttttccagagaatgctagagaagcaagtgagtgattgggaaagatgctttgccatcatgaaaacctgaaacatcttcagtaaaagagttagcaaaagagaggatggctgttctccctccattgggccaaagacatttctaaaaagttgttcccaaaagatcactagataccaagaagcaggtgttagtaacttagagcaagggtttggttaagggatagggtgagggaggggcttccagcttaggccgtgataagtttccattctcgtcatccagataatgtgttatcagagcagatttctaattgactatgcaaatgcaccacccttgctcatacatttcttttacttctctgtgatctctttgtctttctccataacctacatatttacacatatatctatctctcctaagggcaccattgaggatcttctggaataattaattaaacagacatttgctctttaggtgtccctgctctgaaaggagaagtgaagccatttatagtagtatatatcccatagtatttcaggggactaaatcatactacaacctgggttctgatatttttcaggcccagaaccatattgacagtatagattcctctctttacccttccaggatcaccagattatttcacagaatcaacttggtaattaattgacaagacccaattttccttcttttcccctaagctcagcaccctcatatcactctcttcaccatttctttgttcatgataaggaatccaacctggttctaagctactatttgctatttactattttaggtatttcctgaaattaaaactttaaaataaattaagcagttcttttgaaatacatcaaaagttttatttattttgttttttaaaaaaattaagttttggctgggcgtggtggctcacacctgtaatcccagcactttgggaggctgaggtgggcggatcacaaggtcaagagattgagaccatcctggccaacatggtgaaaccccatctctacgaaaaatataaaaaattagctggacatggtggcatgtgcctgtagtctcagctacttgggaggctgaggcaggaggatcacttgaacccgggaggcggaggttgcagtgagccgagatcatgccactgcactccagcctggcaacagagcgagactctgtctcaaaaataaataattaataaaaatttaaaaaaaaaataagtttctactttcacagaaaaaaaaatcaatggcattcttatcctaaagctgtctccatatgtaaggttggccatcactaagataacattgattctttaaaatggctggttggtacaacccaggaactgagcctggaatccaggagaccaccagctggcaggtggaggccttggattgtgagcagtcttagtagctgagttagtggcaggtgtggatggtagagataagcagaaatttttataatccaataatgttttcttcaaaaaatgaactcattatcaaagtattatgaattacattactatcctccatataaaaaacagacagatgtaattccatgactgttccccacactcaggaatcatcactgagacacaattcagcattaacttcacatacttttaaatgactatctaattcccatttctctcactctctccatctgatcagcaatccatatgcatttttatgacttacatgccacaaaatgttttcttaggggaaccttacactcttccaccccacctcaaacatttttttagacaaaatagaacaaagagttgtagtttataaatatttactctttgtttcatttcccatttctcagaaggatttgtattttaacaaatcatgtcacttgaagatgtgaaattctcacagtggaatttcagctgccagtgagataaatatttttggatggagggatgttcccagtccccatgaaattatgtcacaaagcactcctgttttttccctaagcctgctgactcatgtctttgtcttaagacggctctactcagcaaaaagttcatagcaagcccttcagaggggagagtgcctgactaatttccacgataggaatctgacctactttgtttaattctttctgttctctattgaggtgagtacaataaatatttctgacttataattctcttaggtaccagttaagggcctgcagtaattgctgtgaaacattacactggagacattgctgcaccacagtaaaaggccccagctgcaaaatacacccttgctagattgatagttatttggagtatgggggtccctaaaggaaaataaagtcatcacaaatatctaagcttgaagagcaaaaataaagagggatgctacccttttgtgtattccattggagaatgtacagaacacagctcaatgtatattaattggcctcttgacccaccccataagttgctgcacaggtttgtgcaaattgcttaacctatctgtgcctcaatttctttttgtattaaatagacaccataaatctaccttcttagggtgatcattaaacctgaacaataattataatcataataataagtatgtaaatatactagattgaaaaacaaaatactaaaagagttattgatttgacaagtatttattaagaaaaatatcctaaatggagatacaaatacatgagccatattccctgcccttgagaagcacacagtgtagtgggagacataagacataggcataaataataaggcaaggtagaagtcatggaagagacagaaaacattgaagagcaaaaatggcttcatggagaaaatgacattcaaaatgatcaaatgcccacctatttccacttccttcaaaatacctatgtgtaagagtgtgtgtgtgtgttggggagagggtgtcaataccttcagttggttaggattgggctaggtaacacatctaataaggtacagtaagaaagaaaactatgtggacaaaagcagttttcctctgccgtctcagaaatttagtctaccccacagcaacatagagttctaggagatttggattttaaagtactttcttttcttggcatctattgtaaccttgttaagtggtattatctgtgatttctgattacagcttttatgtttgttggctgtgctgctgcttgaaatgtttgtttttctccctcatttttatttagaagttcccaaaagcacattggttccctgccaggtttcataaaccctgtgattatttttccgatccaaggctaaacttctaagagtaggtcatttgtcaaaattctctaaagtcctgtggtatctcacaggaggtctggatactcaaaggcagcatttgttgcctgtagcatctcccggccccgacccaggtgtgacaacaaaaaatgactccagacattgccaaatgtcccctggaggacaaaatggcctctggttgaaaactattgctctaaagtaacctacactgtaatggtttaagccatgggagtgaaaagcagttactagccagttcgtggaagccactagatggcctaaggcagggataagccattgttcagaagtaggatgctaagtcaccgatgtactgagcctgggttttggcaagagtggacagtggcagcccagcatggacccctagcacaagaatagccttccctcctccaaaacctgtttctgaaatgctttgtcccaggacttctctacattcttaaaaatgattaagaatcccaaatagattttctttatgtgtgttacatctattcatatttaccacatcagaaattaaaactgaaaaattgttcatgtattcattgattcattttaaaaaataataaacccaatatatgctaacataaataatatactttcatgaaaaataactatttttctaaaacaataaaaagaatagtgagaagaatggcactgtctatatttctgtaaatctctttggtatctggtataatacagagaatgagattctcatttctgcttcttcaatcaatctattgtaatttcacccatcatatggcctccaggaaactccactgtatatcaagaaggaataatagtgagaagggcacttagtattattataaaaatagttttgacctcacagatcttttgatgaaagggtttcagggatcctccgggggtccctggaccacactttgagaacaactgctctaaactgacatgccacacttttatgaatgtagttcacttaagggttgataaatttcttttgaaactaggatctctaggagcagtgaaatctccctattagaccttagtgtgagtacctttaatcagactgctctgttcctaagatctggtgagcagcagtactgaagaaactgaatgacgtaatttgaagaacatattaccgggagggaggacaggaccgggtaagggcttagtcaggtagcagtgtgaggacactgggccctttgcaataagaaaagaggaagcacagaaaggaggaagaatttgctttgtagtttctcctgtggtcctgatgagcccagtcactcatatgccattggaaagcatcttcccctgtatcctgagctaattgccacattgctgagcctggtgccactgcctgacttaaggcatagcattgcaggagaagtggtagtgatgagacaacaacagggaagaggaagagagagaagagcatcagacggtggagaatagaggagaagacagtgccaacactaaactcagggccatcgatggcctgtctgtcatttgaaagcctgacttaactttcactgccagtaatatcttaaagaggctcaaagttttatttgagtatatttttgttgctttgcattccaagcaactggttagcatttgagaagcctggggttccgagcattggttgaaggaacttgtttaaagtataaaaggatctcaatttcctagtgagatacaaaatccaaatattctggctgccaggtcctacgctaaccaagaaagttacctccctgatattaaagatttatagttattcaaaccgcaagtactctgaaattgcattatttttaaatgattatatctttctcagactatctgaagataagatagcccctctgttttaaacagcaaatgagggaagaaaggaaataggttttgggactttgtatgatagagaccagatctctgtgactatagcaagtcttattagtgactggatatgttagtgggtccaacttatccaaaataggctaagaaatttttacagcatgttcacagttccataaatttttctgctgtcctctttttaagttagtgacattcagaccaacatgcactaatatttggcaatattgctcccatgaatgtgaacagacagtttattgcctcagaattatgccaccctctctacatggtgcattttttatcccaagtcattaaagattcttcatttaaaatctaatagctctagaaagaagacaggataaaggtcattattcccattttacagctgaagaaatttataagggagaaaatctttatcctagaaccagtagggtttcgggcacttgcccagtggctctgaatgcagtccttatgttttaagcagtgaaggactaaggagcagtggcctggcctcctggggatatgtactagcctcttagttgaggaagtcttatcttactagaacaattaaactatttctctacagcgttacccaacagtggcagagtcattttgctggtttaggccctgccatattaataatccattttgaaacaatctggtttgccctctggtgatctaagttgaccacagacatatggccatatcagaaggacagccaatcagtaactcaaaaacaatccatagaccagtttttacattgttgaaaatactccccttatccaaaacagaggtccacaatatacctttaatactaagaccagtatgtgcataagaatttcgactacatgtttgtggagtaagaacatgtacgtggtacagttctttctgagatcattttcagctgggcaacagacttgtgtgataaaggacaattaattagaaggcatgttatttatgtagaatctattttcaattctgttcggatttatccatttgtctcggtccacaatatggaaacacttccccttctgggtctgtccttttcccgactcctccataaaatttgctttctgtctggaagtacaacaagacacccagttagatcaaacttaacacatctccttcacaaagctactgcaagctgccgccgacgattgtcacctgaggggagaccctcctcaccacacacaacctatctgaggagtgcctttttttctatcctcattatttaacagtgtgtgccgattactcaaagcgatatgggcaggccctggtaaatatagcgttgctgtagtgttaactttttataaggtaatgctcaggttgcctgcagtgtctaaaattactctgtggccagggccccctgctttatcgctttctatagttttaaagtagtttgaagcttgaataacataaaataacataatataatgttatttatgttatttcccacgtgaagaacgcctgtaaaccttgcagtattgaaactcagtgaacaaggcatcttagacaagctgaaaaacaaatggtggtacgataagggggaatgtggagccaaggactccgggagtaaggtcagtcgctgaaggtctttttgtactgattagcaatcacattttgacccactgtttattttctaccctaaaacggctttccttcccaacacacactccctgacacagtgggacccctttataacaacagtgctaaaggaataagacaaatgccagcctcagaggcctgccacatgacatcaattgttgactctatagaacagttatgatgattaggaaactcaatctggcctactgcatttccaaagttataaaataatgagctgtgttataagggggttttactgtatttcacatttcaaaagttcaaagagaaaatataataacaataacaacaacaacaaccaaaaaaaagaaagatttatttgtgacagtactttctcttaacctcttacagtgtcagagactttgtagttataaatgcatttggttattaatatattatgtcaatcccatctgaaaacagtcaaacgaataaataacaaagactggtctctgtaagcagaatgattagcctcctgccagctgctgttgtattgagttcagcattaatttggatctcgaatctcattaagtctgtcacacttctctcttccaaaggtgtcatttgaatctctgtacgtaatacttttaaaatttagtcgcatgctccttaaaggtatacatcgttaggataacatcacattgataagcatgaaacactcttccccgcctccttcctgccccccttcgctcccctaagaaagttcttttttagtttcaatttttgcctttcctttttttggactaatatcgtggtatcagttaattcatttcatgaaatgccactcattttccccgtgcaatgaaccattttgctactggttttctacatcccacatcagggaattctataactcttgtgaaacttaaataatacatggaacttgaaactgttcttcttgtcacagcttacatgggttatgtcaaaggacctctccccccattaaatatcatatacatataaaagtctaatggcagaggaagggttaccagaaattggtctatttcccaatggactgtggaacatccttgcagatagcctcaccagtctccttaaagagataatccaatatttcatatgtgacagaaattattactacttgtctagctgtcattcatcctaaaagagtgactatttgcaaggttgttgtgaatatgaggcattcccacaccccgtttctgaatgcaattcaatttcaattggaccttttattaaagtaaacaagtataggactggcttctatgaaaatgggataagaaggacacggccatattgtctttacttttaattatttaaatgataccaagaccagctgaactagagtgttaagtgtcagcaatggccatcatctgtcactgtgttgtcacttaaataagatgctcaaaattcactggcttaacaatttgggtattccattcaattacattcagcagcaaaatggttacataccctctaaaaagactacaaaatgctattttattttatttctttttcaaagaaagactcctggcccttggtgtgtcctacctcaaggtagggctcaagacaccaacttttttctttccattgttcagcagttcagactttgctttttcatacaggcagatagcttagtcagatttgcacagtttgacctgaaagtcactgaccggcttcctcaatttttcccccttgttacaaagaaagcaaataagtgtaatttttaaaaattattctctacattccctggagtaaaagttaaaaatgagctggatttttaaaaaaatcatcagcctcctggaaaagctttctgatttgtatggagccaatctaggacccgatggatcctctgacactctccttaaactctcaggaaaatggaacggagccaattctttgtgctgtgcccttgttccagcaacacaaagacttgctgccctgattttaactaggatgaagatttagcagccaatctccaaagggagcattttctcagccactaggggaaagaggagagttaaccctttttaagcaaacccttgcaaaataactcctcagagaaaaatagcaggaacctctaatattatcatgtcgtatcttaaagactagtcgttcacaaagtttgtcacagggagagcaagggagaaaggggtgttgcggggcagagaggggaaagagtgcttcaagttcccaaatgaaaagagtgttacatttatagagattatgtcaccgctcaactctggccaatggtgtttatcaaggctggcagaggaataaattatgcttgtgtttactcttttgttcccatggccaagtgctgttttattaattgttgaacaccattttgaggcactaaggaacgtaaggagtcaagatgaaaggacatttaggtgaggatcaagactgttaacagaggcacaatctaccgtcttgctggtcattgcaaaacattagccagttgccagaattgagtcataacacttacatcaatgtttagttattttacaatttagaactcccctgtactgttgtaatatattataatgttccattgcctttgttttccccaagatctaatcacgttgttcatttctcttaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctaggggtacggttaaggtctagtaaactaatcagctttactttactgtatgtcaatctctttttttcttctttttttttttttttagtttggtttattgttcaaagcattgtctctttgcaaccatttgattctttgaaaacaatggttgtgctttcttgtcaggcagtggtgcttttctaatagaatggttgtaattaaattgtggtctgtgacccaaaaggaaatacaattctccagaacatcattgttcaatagaaaatatatgcaagccacatacatgagccacgtgtgcaattttaaatgttctagtagtcatatgttaaaaagtaaaacaagtgaaattaattttaatgatacattttatttaacccaatatatccaaaatatgatcctttcaacatgttatcaatacaaaaaaaagaatgacaaattttacattcttcacgctaatcttgcaaatctggggtatattttatgcttatggtacatcttgactcatactagttacatatcaaatgttcagtagtcacacatggccagtggttattgtattggacaatgcatctctagagaaagcagctgctctggaacagatattaaaattaggggccgggcacggtggctcacgcctgtaatcccagcactttgggaggctgaggcgggtggatcacgcagtcaggagatcgagaccatcttggctaacacggtgaaaccctgtctctactaaaaatacaaaaaattaggcgggcatagtggcaggcgcctgtagtcccagctactcgggaggctgaggcaggagaatggcgtgaacctgggaggtggagcttgcagtgagccgagatagtgccactgcactccagcctgggtgacagtgtgagactccatctcaaaaaaaaaaaattaggtacacaggtgaaacactgccacctcaagtaatacagcacttccatagggagaggtggttcttttaagtaaacagtgtataagtctgagataattcacttaagctttgagttcttttgttgtcccttccttggaactggtgcacaggtaagtgtctatcaaaggatagtctaggctcccagctgctagccaagccctaattcatacttcagtgaacctgagtgttgccaccttgactctggcaactacaaacaccaccaataattcagaatgttcaaatgcaagctcgaattagaataatgtctccattctggacgtgtttaaaagaatatagtcttgttactttaaagtgcatctgtcatcactaaaatgcctatctgaagtggaacagaacaataagcaacttcataccccttattttaggcaattttgacctcatgagtaaatgtcaatatgctgggatttctacaagtgcatttgtgttttgttgttgttgttgttgttgttttgttttggggtttttttggggggtgttctgttttgttttgtttttgaggcggaatttcactctatcgcccaggctggagtgcagtgacgcgatctcagctcattgcaacctccacatcccgggttcaagcgattctcccgcctcaccctcccaagtagctgggattacaggcacttgccaccatgcccagctaatttttttctatttttagtagagacagagtttcaccatgttggccaggctggtctccaactcttgacttcaagtgatccgcctgcgtcagcctcccaaagtgctgggattacaggcgtgagccaccatgcccggctgcatttgtgttttggccttcttatagttcacactgtggatttacatttagccaatttttaaataatatttcattcaaataaatcatttgtcttggtcatggaaaacataattttgtccagtgaagttgctggttgttccttcttcctgccttttgccacaacatattcagcacactgcaccaatccgctgacagtgttcccattgcattggtggatgtacaatacatggattcatctgtaattgcattgtttgcatgcaagca

SEQ ID NO: 14589 - DNA, 302604 bp, Human; identical to SEQ ID NO: 14588
  misc_feature (1)...(302604): n = A,T,C or G

SEQ ID NO: 14590 - DNA, 29615 bp, Human
catttcacatcttgactgtgtgtgtatatgtgtgtttgtgtatgtatatacacacatatataactgaaccaaatttaaatataatatccttgctatttctgatttacctagtattttctgttctatttaggaaaatgattatacttaattttaccacaccctaattggtctccacctacaatgtgaaaaatactgtcttaagttgcctcagatgctgactgtctataaacaagtttctggagtgtccaattatttagaaaaataattataagttttacaataaatgcattgctacaatgaaaatgaaatggaaaatacaaaatatttcgtcttgtaaaattaaattatggctttttttgcagtatgtttctattaggtgcatacatgtacatacatgtgcatacatatatgcatgaatatttttagatgttctgcaaaactgttgattccgctgctctgtaagtttgcactttatcactccaaaataactccattaagatcgcggccgagatctcgccactgcactccagcctgggcgacagagcgagactccgtctcaaaaaaaaaaaaaaaaaagatcgcggccgggcgcggttgctcacgcctgtaatcccagcactttgggaggccgaggtgggcggatcacgaggtcaggaaatggagaccatactggccaacatggtgaaaccctgtctctactaaaaatacaaaaattagctgggcgtggtggtgtgagcctgtagtcccagctacttgggaggctgaggcaggagaatcgcttgaacctgggaggcagaggttgcaatgagcctagatagcgccactgcactccaacctgggcgacagagcaagactccgtctcaaaaaaaaaaaaaaaaaaaaaaaccgcctgatccaggccgggcctggtagcccacgcctgttaatcccagcattttgggaggctgaggctgacggatcacctgaggttaggagttccagaccagcctagcgaaatcccctctccactaaaaatacaaagattagatggacgtggtggcacgcgcctgtaatccctgtaatcccagctacctgggaggctgaggcagcagaatcatttgaactggaaaggcagaggttgctgtgagccgagattgtgccactgcattccatcctgggtgacagacccagactccgtctcaaaagtaaaaaacaggcagggtgcggtggcttacgcctgtaatcccagcactttgggaggttgaggagggcggatcacgaggtcaggagtttgagactatcctggccaacatggtgaaaccctatctctactaaaaatacaaaaattagctgggcatggtggtgcgcgcctgcagtcccagctactcgggaggctgaggcaggagaatcgcttgaactcctggaggcggagcttgcagtgagccgggatcgtgccactgcactccagcctggagacagagcaagactccgtctcaaaataaataaataaataaagtaaaaaaaaaaaaaggaacacttgatccctgagaacaaagtcatcttcatttatttctctttccaatcacaggaaaaataagtcacaaaaccttgtactttattacaatgccacattgttctgtttttgaagtcctggaagaggtaataacagaaccccgtatctgagccacttcgcctaggttagacccactcagcaactcccgtgctgaagacaggagaccgagcggcttgggcccccggccagaattctcaagacgctctcgcgagagccttccaaccgccgcgagctctcgtgaacactagttctcttcaatctcagcacctccaagggtcagcacctcccctccggctccctccgctaccgcgggccggaacttttgtcgataggaacgggtttgcacagttgagtgttgtcggccggcgtgaaggagactagggggccatcctcttcctttcgccgtcgccgccgcggagcggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactagtaagcgatcttccgtcttctcacctggggccggtttttgggggagctgtgaggacggggcctgtgactcccctgggcctggatcccagctcagttccgagtgccggggtcctcacgggagaccgcagcggccagaatcaagatgcgcttttctgaggcgactcccctccccgcccccagccccagtttcggggagggaaggatctgtgagggggaggggtgggagagagtttcgtctcccgggaaggaacgtttcggagtttaatttcggattcttggtttagctaggccgcggggggtcggatagagtgggcacaggtacgggaagtgtgactcagctcaagactgtgaggctacctgttcaggacagttgtggcgtgcttttacctggggtttcttcgggtgatcggcgtcgtggtcttttgtcattcactgtatatcttgagtggatttaatattatgaggagaggagagagtctggcttgtttctgcctactaaccgcttcttgcgcgtactttatgtctagatggagttttatattgataaggtatagggcaggtgccctctaaatttatccatttcattagcctgtgctttatattttgttttaaaggcctatttttccagtgactttgtttacctgtttctttaacctttttcatgaataagttcttgtttctgtcagtgaccatgtgagagctagaataatattaaaaacatttatccctaaatacatttgtttaagcaggcaggaaggtgcgttatggggtaaattgaacatttgagtaggctttccactgtatagttgaaagatgaacagaatttgacaaggtatcttggtataattttttatgctaagaaagcattagtaagtaatttaaatttcgattctgtgaataggatctgttcctgatgttcattttttagccctttgcaaagagaaaaaaagaaacaatgaactcagtaacctatttaaggaaaagcaggttttcctcttgctataaagtgattctgtggagatgacatgttaaagaagctttaccactgatcatatgtgtgtgtgtgtgtatatatatgtgtgtgtgtgtatgtatatatatatgtgtgtgtatatatgttgcattgttttcacacactgaaatattgcttgggcaaaattaaagtatcgaaagtttaggtattggagttagagctcctgaaaaaaaaagtttaggtagtggagaagagatattctgataaactctgaaagaagctgagagaattgacaagtagctgactgttgatttttcagtttttcaacttaaaaaaaaaagatcctgccttattttcaatagtgttctcattatgctttcatttattcatagcattctaaaaatatgttttcacttttcaaatataaaattattataaagttaagtgtacttctttgaaactattcttttctcccaattcaaatagtcctaaaagaagggaccactttgccttgctcaaatcccttgagcagtcatggagtttcttatctggaaaaggtaacgagtgtggaagacaagacaattctggaaaaacaaacgaaaagattatgaaaggccattgtcttaggtgaatttggtgaaagagggcaattgatattaaatatgctatatttcatgcttctaagatgcacgttttcacactttaacatctttgaaatcagcatggcagttgctttcatagcatatgaaataatgatgaatcctagatgtaatcttaaatttgatgaaatgcagtatttataaagttttttagtttattctccatacagagttctgtgaggaaaactcataaaatgtttgtgaaatttatctttttaaaaacataaaatgactctgtggggatgaaattaattagcaaaccacagtgtagttgaggtagaacaaaacacagtctgtgaccaaaatgaactagaagggcactaagtatttgctggttaattgaatgcattaatgaacaagtaacaaaaataaaaactacaaaactaactgtggatactttattggtatccacaggaaactgaaaatacagttacttactatctagaaaataacatcataatagtaccatatatggaatgtaaccaaagcttgaatgtattagaaaatcaatatcctgaataattgagagataatagaaatattctatttaataatattaagaaggaaacatgaaataaacctaaagaaacagacttaaaatagataacgatgctaatatattaaaaggaaaaaaattataaaagctaattcttagagtaaataaaaacagtagaccaaactactgctagttaaatcaggggaaaaaggaatgatacaaaaatacaaaattaggaatgagaaaagtaaacccaggggtacttttgggttatctccagggttttaaatttgaaagccaaagcaagttaagagtattacccaagagctatgtgttatttcatgggtaaatactttccatctttcaagagaatctccttttgaaattgttccatttcatacagaaagaagaaaagctttctaattctctttatgaagccatgataacacagaaaaatctagcaaagggaacactaaaaacagtctcacttttgaatattaatgcaaacattgtaaatgaattattaccaaatgcagtctaacattacattgaaagtataaaacatgacattggattttattatagaaatatagtcaatattaagaaatcaagcagtaaaggtattaaaaaactaatacaattcaacatttatccttgactaaagctcttactaaaacagaaataggatgcttccttaacatgaaaaacataaagcatcagcagtggtgaaacattgagataattagggtgcctatttaagattttaccaatatgctagtcaatacagttgatacaaaggagatatagaaagaatgacaaaacagggacaaaattatcaatacgtggaaataaaattaatgagaaaactcagttaattgagaagttattagaaataataaaggtttaggaaggtgaccagttataaaatgcaaaaataaaagctttttaaaaatggatagagaagtataatttacattagcaacagaaaatatacagagggaaaaatataaagaaatatacagaacctgtaggaagaaaactttaaaagtccatagtggcacatacagattttaatagagtttgaattcttggtaagatgtcatttctccccatattgatctttaaatgtaatgtaatcacaaaatttgaatggatattcttttttaggactcgacataatgcttctaaagtttaggtcttagaataattgtgatagaatagtcagaaattttcagaagaatagaagggagtatttttcatatcacctattaattacttaattttctgtgttttaaagtagcacagcatatgaagaagaaaaaaataggaaattataaagaagatccaagtataatgatagaattataaatcaggaaataccttagcacatttggataagcatttgacaacatatttagctggatccctgctttatactctgtaccaaaataaattccagatggatcataaattgaaggaaaaaagctcttaagggtattagaaaatatgggtgaattgttttttatcgttttgaatcaggaaaggccttgctatgcctgacaaacatgaaagtaaaaggtagatttaagtaagtgattcagatttctgtattacaaataaatactgagagatatttaaacttgggagaaattttgcacttatttgacaaacaaatgatttattatttatactatacaaattttagatcagaagaatctcttaatcattaaaaaaatcggtaatcccattagaaaaatggtcatattagaattaacattgtacaaaagaagaactgtatttgaccaataaagacatggaaagatgtttaacctcaaaagtaaactacagggaaaagaaacagtgacatactactttgcctttaagttacaaagtatttaaaagtggcagtaacccataggaattttttttttttttttttttttgacagagtctcactctgtaccccaggctggagtgcagtggtatgatctcaactcagtgcaacttccacctcccgggttcaagcagttctcctgtctccgcctcccaggtagctgggactacaggcgcacgccaccacgtccagctaatttttgtaattttagtagagatggagtttcaccatattggtcaggctggtctcaaactcctgacctcaggtgatccacccacctcggcctcccagagtgctaaaattacaggcatgagccaccgcgcccggccaggattaaatattataagattcactcatgaactgttaatacaaatggaaattggtataatgtttttggagggtaaactgacaatgtgtatcaataagttaccagcaacactaacccattaatcctacttctgggaagttatttcaaatatattattaatcaaatatgcaaggagaattacaaagatattcattaagaagaatatcattcaggaaaatagtaggaagagagtttttttttataccagctattaattacttaattttctgtgtctaaaatagcacagcatgtgaacaagaaaaaaataggaaattataaagaagatccaagtataatgatagaattataaattaggaaatacctccatgcatttggataagcatttgacaaaattttagctggatccctactttgtaccaaaataaattccagatggatcataaattgaaggaaaaaagcccttaagggtatcagaaaatatgggtgaaaaatgacgacctgtatttccatcagtagagattggctaaataatgatccatccataaagctgtataaaagaatgctgaataacaagttcattgacataagacttcaaatacatattgaatgacaaacacaggttcaagatagttttttctttgagtcatgtcaatttcatatctggttaaaaatagcacacttgactaggcaagaggaggaggctatcagtgtaacacattctgaggcagtttttaatataattagatttgtgaagtaaggaaattaaatgccatagttacccatgaacagctggaaaactatatacttcctcaaatctaagccaccatcaattggtgccaaataattccaccattatcttatatcactaagaaagaataaacatgctgccaattaaaacacgaaggcatcacagattgtaagacatatcttgatatcagagccagaatcaatgaaatacaagctagtaacagactaaggaggaagaaggaaaagattagagcagaattttttcaggacgtatttacatttattagtgagataattcttattagtcacgtttcaagaaatgtgagaaataattgtctttaaggttactttttgcactttgtacttctcagaatatgaacaatgtgttcaatcttagagtgtttcctctgaccttgcttgttgattttctgtaacatgtcttttctagtttgcaatggattttggataaacaagatctgttgaaggagcgccaaaaggatttaaagtttctctcagaggaagaatattggaagttacaaatattttttacaaatggtaaacttttttaaaaattggttcaaattgtatagttggttacctctgaataaaaatgtttttgtgtggtaatttgtgaactgttttagtgcatacctaacatttttgcttatacaggtattctttttacaacatattcatttatctttctttttagtgatccaaataaagtttttttgtgtgaattttacatatcacaggcactcaagacaatttgaaagtgttacctaatctccctaagactttataataattattagacccagttcaaggttggctaaagcaaagtactttgaggataaatgattctttggattgacatcctatagtggtcgtttctcttagaactttgctttgaagggaagaagatgtagggatagatctttactctgacatgtagtaggtttgtcacataatttttttaactttcggttcactattttgtaaacttatcttttttttgaggattcattatggatttttatgtattatttatttattttggtgagctgtataaagctaagtgtggtggctcacacctgtaatcttaggactttgggaggcagaggtgggcagatcacttgaggccaggaatttgagatgagcctggccaacatggtgaaattccctctctactaaaaatacaaaaattagctgggcgtggtgaggcacaagaatcacttgaacctgggaggtggagattacagtgagccaagatcgtgctactgcattccagcctgggcgacagaacgagactctgtctcaaaacaacaaaaaaagtggtagtattaacaagtttcataggtgtctaatattttctttttatatttattataaagatactatgaaaagcattaaaaatatttagaagatagaggggaaatatttattcaacttccttaatggatgaataattttttcctgtggggcaatttctgttttgttgttgttttgttgttgtttatgcatacctatatatttcttaacacatttgcaaatcctagaattagaccactgtgactcacatagagcatgtgtaggttttttcctttgttaaaaatgaacataattatgatttaaccacatggaagttactgttcaatgttaatattataatgataccagaagatacatttaaaatttcattatttgccttttagttatccaagcattaggtgaacatcttaaattaagacaacaagttattgccactgctacggtatatttcaagagattctatgccaggtaggattgtttttattttatttatttgaactcttatctaatgttgatgaaccttagcacagtgtaaatgaatcatgtgtctaccatagagttatcttgatttttttcccagtgtgttttctgtatgaatgatatttaactttgttttatcatattttaggtattctctgaaaagtatagatcctgtattaatggctcctacatgtgtgtttttggcatccaaagtagaggtataaaacaattttctgttcttcatcaaagtgtagtcaatgtatgttggttaatctgccccagttttcacatggcctatgtaaaattaataaatggtaatttatgcaaaatactaaaattgtacaaaatcaaagaaatatatacatatccttatatattcacttaacagacacatacagcacttactgtgtaccaactgacttaatctttgtaacaaactggaatacatagtagtagtattcccattttataaatgaggaaactgagacagagatgaagaacttgcttaagatgatatagctagtaagtgtgagagcccgtgtttgaaccatgggagtctcgttaccaatcctgtgttcttaactactttcctctgctgcctttgagacatctattgtttggcactgagtagtattcagtaagtaccacagcttgcctaccataacctgagaatgtcccttatgcttctcacccatatgcttatcttctcctgtcttccctcccatcatcctgatgattggctgcctaccaagccagaaggaaggcaaggattaggggaagctatagctatatagagtctaacaagtaaaagttgaggttgtgagcgtagagaaattaggtaagggagagaagatagataggaacttgcggcagagactgaatttctgttcaactgttttacctttgtagtatttttgaaagagctcagctaaagtccagaaaataatagcagatattggctgtttttcataaataatgtagtctttggtggtgtgaaatctttgcattatgtttctatttttggataatgtcttagagttgtattcttagagttgtattcttgaatattgaatgtgatttttacctagtaagtttacattccttttggcacccactttgatttagttttgttttagccatgatttaaggttatccatgacatctttcccaactgttacctaaataatgacaattgactctgttagaaataatattaagacaagctttctagaagtttatgttttctaattgtgagtggtagtttaagaaggcagaatcagttaaggtccttattatggattgagttttctaattctaataattctatgtaatatttgattttatttaaatattaccatgtaataatttaaagtctcttaagcacaggcagtatggaggaccaagacaaaaaatctttataaacatttaatcttgtagattaatttgaggattttaatctatcttacttgttaaatattgttatgtgatttactgagtagaactctgtgatgtgatttactgaatgaaagttttccctttgagttttggataaagaattattcctaggccgggtgtagtggctcacacctgtaatcccagcactttgggaggctcaggcgggtggatcacctgaggtcaggagtttgagaccagcctaaccaacatggcaaaaccccgtctctactaaaaatacaaaaattagccggatgtggtggcagatgcctgtaatcccagctactagggaggccgaagcatgagaattgcttgaacccatgaggtggaggttgcagtgagccaagactatgccactgtactccagcctgggtgacagagcaagattgcatctcaaaaaaaaaaaaaaaaagaattattcctgagaaagagaatgtagtctttcagatttggtcgtagcattattattttttttttttatctctgtgaccaaatctttctgtattttctctagttttatggaaattgtatggaaagctcatttaagaacatgtctcaggcttttactttttcttttcagttattatagttggaggtttaaatgtaaaacaaatatattagtacacatacatttcccctacacaggataaggatgtaggctgaaggtatttaaatagatttttagtttagctccttttgttggataagaaaccaactcttgatttttttattttaaaatgaagtgaaggctttagaaatcttacgaggcaataaatgaaacagtatatataaggtggatcataataaattttagtattttcacaatggtggttgttcagttgaaagaggaaatgggaactgactttggaagtcttacgtaattcctgtctccctgttctaaaaaggatagtaactatttatatggtttttttttttttttagttcttttggtgattaattaaggtttatcttattcacaaattcgactgttttaccatagaatggcatgaagtatctgttaatacaggttgaattgaataggaaacatacttaatattcttgcaattaagtatagaatgtaaacaatcttcttggaaactaatttaaatggaaaaactgacactgtaaccttaaggcttggtttctaatttggtaccttttattgttattaaattataaaattattttaaaatatgtcttaagttgtagcaatttgggggagaggtaatacaggcagaatatccgtaatctgaaaatcctaaatgctccaaaatttgaaacgttttgagggccaacatgacattcaaaggaatgctcattggaacattttgcatttcagatttttagattagggatgctcaaccagtgtaatgcaaaatattcctaaatcagaaaaatctctgatcctaagcatgtcagataaggggtaatcagcctgtacatttaggagtgtaagtacttcacacctcaagtagttagaaggtgaacagattgtaaacaggagcaaggaaatcctgttttgaatagagttcagatacccttagattcattgggttaacatgtacctgcttttctttctttaggaatttggagtagtttcaaatacaagattgattgctgctgctacttctgtatgtaagtgcaaaaagtatatctgctttaaggatgtaattctaaagaaagctccagagtacatagatttttttttttttagtttatgagacatatgagattggttggctttattaaatttcctgaggatacctttatatctagtgtatctggcaaaaaaatcaagctaaaaggtttttttttaaaaagatataaagatattacttttaatgttaaaatggatagtaattatcaatccaaaaacatcaactcagtggcttttaatcttgtaagagtaaagaaaaaattctgtttccgaattttattgtattttattgttttctaatgactattatgtcattcttatgggtagatattaatatctatgtgcaaacccgttcctgtgttgttgggttgttatgaggaccaaatgagttaatataagcttttagaacagtgccttgcttagtatgttactttgctgaggctgccataacaaaatgccacagaacaggtggcttaaacaacagaagcgtattttctcacagttttagagcatggaaatccaagatcaaggtgtctggctattcttacatggacctttctgtgagcacacacactcctggtttgctgtcttcttcatgtgaggacaatagtcttacagaattaggccccactcttatgtcctcatttaatcttttttttttctttctttctttttttttttttttttgagacagagtctcgctctgtcgcccaggctggagtgctcacttcaacttccgcctcctgggttcaagtgattctcctgcctcagcctcctgagtacctgggactacaggcatgtgccaccatgcccagctcatttttgtattttttagtagagacggggtttcaccatgttggccagactagtctcaaactcctgatctcgtgatccgctagcctcggcctcccaacgtgctgggattataggtgtgagccaccatgtctggcctgtcctcatttaatcttatccctttaaagaccctctctccaaatacagtcacattctgaggtactaggagttagggcttcaacatacgaattttggagggggacatatattggtccacaatacttggtaaactttaggggctatcatcatcatcatcatcttcaatgacaacaacatcattatcactggaaaacactgtgccaatgcagtggcattggtaccaaggtaaaatacaaggaatttaaggacaaaaaaagaagacagaaacataaaaatattaatacagaaggaaataaatagtataagagagttacagagaatgctgtgaatgttttgggtgggaaaagattgtttcatgaatccagaaaggattaagtagaacttggtgaaggaagttgaactggggaaatgcaagagatagacagtctaagaacactgaatagtttagtcaaatagggaaagctcatgagttagattaactgaatggtgagtaaggaaatagtggggaaaactccttacctaatttcagctaatagagggccttcgatgctaaatgaaggaatctgcactttgttctattgacagtaatgaaagttagttatttgagatggagtctcgctcagccgcccaggctggagtgcagtggcacgatcttggctcactgcaacctctgcctcccaggttcaagcgattctcctgcctcatcctccctggtagctgggattacaggtgtgtgccaccacgccgggctaatttttgtatttttagtagagatggggtttcaacattttggccaggctggttttaaactcctcacctcaggcctcccaaagtgctgagattacaggcgtgagccactgcacctggccagttttatttatttttacacatgagggtaatgccagcattgtgcattaggaaggtaaatctgacccacctcagcctcccaaagtgctgagattacaggcgtgagccactgtgcctggccagttttatttattttcacacatgagggtaatgctagcattgtgcattaggaaggtaaatctgacagaattatgtaagatgaattggaggagagggcaggtagaattagacaaattttgaagttatttacatcccacaacatggatgaaccttgaggacattatggtaagtgaaataagccagtaacaaagacaaatattgtgtgattacacttacatggaatacttagtcaaattaataaagatagaaagtagaatggtagggctggaggaagggtggtatagggagtgattaatggatacagagtttcagttttgcaaaaattttatatatcttaacacaatttaaaaacaaaaaccttctgaaatacagtaaaactgcaaactgtattgagtgctgtcacttaccacagggtgctatgagaaataaaacctaacaagtttaaagtggaaaaaataatttttaagttgctgaagtcatcccagtgaacactaatgaaggcttaaacgaatattggcagccagcaagaacaaacaagccagatttgagcgatagagtcagcagttcttataaaaagaagggatttaagaagagtcagaaatgtgttttgaggtttttttgcctgggggttggggagctgaagctggtactgaaaaagagaataagtgagttctgaaaagaattaaatttaatctttgacattctaagtataaatatgttagtagaacatcctcttaaaaatgtgaggccagcagtagaaatttggaatttgataacatttaagagttgcacaggccaggtatggtggttcctgcttataatccgaacactttgggaggctggagcaggaggattgctttagaacaggagttcaagaccagcctggacaacatagcaagattccagctctgcaaaaaattaaagaaaaactaactgggcatggtggcacacacctgtagtcctagctactcaactaggctgaagtgggagggttgcctaagcccaggagttcaaggttgcagtaaactgtgattatgccactgcactccagcctgggcaatggagtaagactctgtccctaaaaattaaaaaaaaaagagttgcacaatgtcttatgctgcatagaaaaagatgtgaaccaaagaaaaaaacatctttgagagagaacatagtgtcattaacaatgtgggggtggaggtagaagccagattgcaaggaattaagaagcaagtaggtgctgagaaaggaatagtctaactatattaaaaatatatgaaacaacttcagtgaagggaattgggggaaaggtgttgacataagtagctttggaaatgattaagagtgtaagagtaaaggcaaaaggaactacacataagcactgtactctagttgataaagttattacccatgggtgtacaagttaacaattctgataatgctatacatgtatatgggaattaaacaattacgtaaatcaatagcaaatgtttgagagccgggtttctcgttgttggagcgggaatttacagataagcaaagggctggaaacagcatgaactcgtgtaccttaatacaatatagatggttagttacatatagaaatatttatagataagtgtatatacatgggttagtgtgtgtatttcttggctttctcagctgaaagggtctataagcaatgacatcccagtagcaatgagctcacctagtacccatatcttggtttctaatatcattctccaataaaaggtaccagggctccttggagaaatggttgattctaggactggggcaagaaatacacaagatggacctggaccatctcttaatgccagtaataaagaagtattcaaaacaaacaagaaaaacaaaaacgtctattgatgaggatatgtcaaaaggatataggagctaactaagagagctcccactgaccaaagctgaaagaatttgagcatcaaaattttaaaaatagcattggataataactcaaagtataaactaaatatccatgagtccatactgatataaataaatgagggagaagagacatgtcttccatgctgaagaattccaaataatatatgtaactattctgccctcaagtagagggagcataactccccactcctaaggtgctggctatacatgttaacttcctgctagtgtgtacatatggaaagggaggaaaaaggtaactttacagtggggaaacctgagaaatactgccttagccaggcgatcaaggtcagtagcaacagtgataaatcacattaatatcatgtatcattgatgtgatatgatgaagatggtactttatctcggtggtcttcctgtcaaaaacccattttctctagtctaatgagaaaaacatcagacaaattccagtagaggggcatttgacaaaatacttgactggtactcctaaaaactgtcaaagtcatcaaaaacaaggaaaggctagaaaactgtcacagccaaacagtctaaggaaacatgacaaataaatataatgtggtatcctagataagaccctaggatagaaaaaggacattggtacaaactaaggagatctgaaaaaagtacagtttagttaataataacatttcaatattgggtcagtaattgtaacaaatgcgccatactaatgtaagatgttaatagtaggggaagctgggtgaaggcatgtcttagtccacttgggctaatataagaaagtaccatagactgggtggctttcacaacagacatttatttctcacagttctggaggctgggaagtcaataacggtgggtataagagaactgtgcatgatctcagtgtttgagtctacaaaaataaaaggcagaggaatataattaggtagagtttgttttgcttttttcaagggaaatttgagcatattagtatgtgatggaagatttactgaaggaggaaggttaaagatgaaaaaaatagcaggagttatcaattgaatagatgataataagtgtataagtggtaagacaaacaatagagaggagggatgtatttttctccaagttggaggaaaaggattaaaagacagaaaaaaatgcagagcagttttagcatggagtaacagacatgtgacagtatcaggtaaatatattctcaatagaggtgttaggtgtcaaggtccaggggatggggatgtagatttgttttatatacagagataattttactttgttgattgtctaccattatataagaacctgttgtgctggtatactttacatcacaaggatttgtaaaactcagaaaccttaataggtacgtcttaaatttaaataaaggagagaagaaaggaaagattataaatttactaatgtcaagtttaaattattctaggtttcaaatcctggcagatattacacatctaaattagctgtagggcactgaatttgcaaaacaaatctttttgaaaacatagtgcatagaagaaatggaatttctttcttttttttttttgagatggagtctcactgtcacccaggctggagtgcagtggtgtgttctcagctcactgcaccctctgcctcccgggttcaagggattctcctgcctcggcctcccgagtagccgggactacaggtgcatgccactacactcgcctaatttttgtatttttagtagagatggggtttcaccatgttgtccaggaggtctcgaactcctgacctcaggtgatccacccaccttggcctcccaaagtgctgggattacaggcatgagccactgtgcctggccagaaatggaatttcttttaatttcagtgaaatcacttgggctttgtacaaatggaagctgacactaaacattttttaggacctgtcagtagttacttggttgaattaaatgtgtcataatggcttgaatacagtttctcaaatagtacttacgtgtatatgctcacaccattttaaggagatgggggattgatggttaacatttttttttcatttgtactttatttagtgactaaccaataaagtaatagataatagagtactaactttatgtgttactactactactttatgagtaactcgagacctttgcatatatattaatgcttttattaaaatatatattttgataaatacctggtcattgtaaaaagtttagaaagtgcagattagtaaaaagttcttaaatctcacaaataaccactgttaacatttttttggtgtactatcctcccaatattttatatgtatattttttaccaattgtatatattgtaaacacatatgtaacccctgtgttccttctaagctcagtcactggaaaacagaagaataccattctgtagctgaaaagattttagaaatgataaaagccagtgatttttttttcctgatctttttcttttttaaacatcagaatcctttcttaaggtagtaaatataaaattgaagctgtgtagagtgtcctgccccccagtctttccccttccctgaaagtaaataaaaatctgcgtccgtaagtgttgccaagaattcctactgaaaataattttgctctaccctctaatattctgctctgttaaaggaattttgagttaatttatttcccattttctcagtttaaattttttttttattttctgcagtaaaaactagattttcatatgcctttccaaaggaatttccttataggatgaatcatgtaagtatatgatataaaatggaacaattatcaaagctatatataaactagctctattttatattagactaaatttaatagtttcctagaaatggcagtttcaaatattacataaatacagacattattctaaattaaagctaaatagcttttaccatttaaaaaaaatacttcatagtggcgattatcaaccctggctgctcattaaatcaccttgggaacttgtaaataatactgatgttggatcctttccagaacaacaaaatcagaattttcagccttggggctcccaacattggtactgtgtaaaaggtcccaggtgatactactatttagctgggattaaaaactaatggaacaatatgaaatataaggtgaatttctattgacattttaataggtatgtcctttttccaccttgcaagggatttgtttattctctttaagttacattttttaaattaagtagaaataattgtatttttgcatttgctgagtagaaagtatactggaaaatctgatggttttacaggatattttaaataaaagtgagtaataagaatgattgtgagaagctggcttttccttacaaggattaaaatccttataatcataattgcatttctaatagtaattttttattgcagatatttattttaatataaactatgtttattgtctggatttttaaaactttttagtaaaaatttttgataaattactataatgtctgtaatttatgttagattaagtggacttatctaatttggtttcatattgacatttcattgataatctttgttttaaacagatattagaatgtgaattctatctgttagaactaatggtaagtaaatcttctgtgattaatagattaaaacatttttaaattaaatgaagttggaaattatttaaagaaatgattttagagaggtacattttaaaaccatccacctaatatgtgatggtgaaatcatggtagcctatttatattagcacctagagtctctctgaagcctgtaaaataatttgtatatcctacttaggatgggaaaatttttctgttctatagtaagtaactataatgaaaggattacaaacagacaagtcaggacattaaaccaccataaattatgtgcacaatttgtgtgtgcgtgcagtgttatttaaagatagattatgtctttggcagaattctgctcctccagttgggaattatgaatttataggctaataagaggtttcagtgtgttgcagatgtgacactttgagtctctaagggaatgaatggatgctgactgactgccaaccgatttatcaaggtatattccagagagagcactgccttcactattacggtagagtttagggctgtcatactgctagcttaagagaataaaagggaagcaagcatgagttagtgaaattcactttgaaatacacaattacaaatcagttgggtaatgataacatttttgtgttgtaataaatctgttttttatacatacacattttttaaactgtttctaggattgttgcttgatagtgtatcatccttatagacctttgctccagtatgtgcaggacatgggccaagaagacatgttgcttccccttgcatggtaattagaacagaagttattaatagtgtaacatgttattagataggaaggttgacaattaaatatgaagttaagtatttttaaagtcattaaactattgccccaagatattttatgttgagcaaaataccacttgttgaattttaataactatagtggtgtaaatgccaaaatgaaaacaatcctaaattatctgttccataaatatacctattaaaatttaattttatacaaaacacagactgttaacataaaaattaagactgaagttatctttaaagtaatcagaatactttttggtagtctgcaacatacatataaatttactgtataatttctggttttttaatttgatttttctgatttttaaaaaattagaaaaatgtgtttataatttgttatgagattttgaaatttaaaatatatttagctgtaattttattcattgatatgtgcttatttgttgtcacattcatgtatccatccttttgccttgatgttttcacttttatagctgtgcttcagtagtataaaaggaaataaatgtgtgcaaagatgggaaatctggccctctctggaggaaatatacaatcagatgaggtagttctgctttcagtaataatatgatttacatttctataggaggatagtgaatgatacctacagaacggatctttgcctactgtatcctcctttcatgatagctttaggtatgtaagcatggtgtgcctttatgagttaaattgttataaacttatttaggtcatcctaaactaaatttcaccctattgtactttatgtttttatgttccatgaagtaatagactaatccttgcatgtgagctttcaataatatgaactgcaactgtcataaatcaggattattattcccccaccccctttttggtaagttttttttttttttttttgaaaccattcaaaatagttttaatcggtgtctgaatagaacatatttgtttgtttagagggaaaagttcagaattaagccagctaatattagttgtagcatgtaaaataattggggctttcatatcctgagcccaaacaaatactcagaggttgagtaaaggagcatctgtggtccataatgcttggctggaggaagacgttaagtacattcattctacagtctgtggaaagcagtgctgtaatgggtggagtcagatagtcctaggcttaaactttacctcctttacaattgtgggaaaattatctgacctttccgtgtttgtttccttaattgtaaaatggagagaatactaataattccactgagccgtttgaagaattaaatgagataggttgtagagcaccaaataatgcctgttatatattgggcacttgttaatttttgttccttttccttctattgattttttttttttttttttgagatggagtctcactctgtctcccaggctggagtgcagtggtgtgatcttggctcactgcaacctctgcctcctgggttcaagcgattctcctgcctacaggaggattataggtgtccaccaccatacctggctaatttttgtatttttagtagagacagggtttcgccatgttggccaggctggtcttgaactcctgacctcaggtgatccaccctccttggcctctcagagtgctgggattacaggcgtgagccactgcgccccagccccttctattgatttttataactccatcctcttgattttcccctcttattttccattggtttgtctttgttcagttgttcaattattccttaaatgttgatgtttcttggccttcttacatcagggctgacaaataggttatacttacacttctgtattactggcagttccctgaaaggactggatttgaaaggattttgagtggtgtcctacccagtgggtaggaatactgggatctgcataggtaggaaggaagggataacagaacatgtgtcacatctttgccatccctgctgtcttcttcttgggtactttaactgagattcatggcttctactatcacttacatgccgaaacatttaaatctctttatttagccaagatcttgccacttggcagttctttatatccatcttccttttacatagctccgcttggcatcccaccagcacctcagactcatgatgaggattgagcttatcactttgccccaaaatatgttcctccttttaatgtctttgccagtttggtgaatagcactagttatataccttagttggaaacccagcagttaggccctttcatctccctcaatacccacatgtagttgtttaccagtacattttgtgccttcctctcgattgttccttctgtaatctcatagtcatcttctcatttctatccatgttaccacagcagtctcctaactggcttattagcctccagcactcccatcctcagagagcctgtctatcttccaaactgttgagctaggctagtggtttcacctggggataattttgccccgaggggacatttggcaatgtttggttttagttgtcataactagggtagggtgctactagcatctagtgggtagaagccagggatgctgccaagcatcttgtagtattcaagacagtgtcaaagaattgttcaacctaagatgtcagtagtgccaagattgagaaacccggagctagccaaattcgtctcccaattgatatacatactattctcttctcccactctcattttttttttttgtaagacttggcttagatatcagctcttcagtgaccctcccccaccctttcagcatcacctcagtctgggtttaggatgcttcctcaatcttcagtgtactctatgcatgcccatgttaatagcattgtccactgtattttaatttcctgtttttatcatgtcagtcatttggttttttttaacctcttcttgacctaagccctactcatagctttgcttgacttagggcaaccagtgtgtcagttcacatttgagttgctatttgcctagaatgtcatccttagcaaagacatggataaccagaccacagagtataacttaagctggagtgggttaagggtatacaggctgctcagtagaaattgttttaggcaaaattatgatgtagattcctctcttttgttagtttatattgtatataacatatataactaatattgtatacagtatattacatttattttctaacctttatttgattacaacactgaattctgtaaggatgtgcccagctttcacataacttgatcatgtgctaataatgaaaaggaagaaaaaaggccaggcaacactgcttttaactgaaatgtggaaacatagtcaacattgttaaaacctagtatattaattaacatttttgtttgttttgttttgtcacactgacttctgggtgcagtttaacggctactttgtacactactcagggataacttcccttttctgctctcctcattggatgtttttcctctttaacgtgcctgactctcaaggcaactgcaccatgactagcacgcagtgaggaccagatgtcaagaacttgatgtaatctagtaattttttctgtctcggattacattgatgagatggtcagtggtaactctcatatgtagctgtttaatgttttttaaagagtgttggaaaatacacaggaaatagtgaaaaatctttgttagatcatatattctgtgtttgcagttaaacatggacagttgtctctcattttcatttcagcttgcctacatgtagcctgtgttgtacagcagaaagatgccaggcaatggtttgctgagctttctgtggatatggaaaaggtattcccttagttgtatgtaaacttggatgtttaaaaattaatgtcatatttacttatcatgagcctaaaatcttgtgatgtccaccaggctaagaagattattggttacaaaatattaagaaacatgggctgggcatggtggtttgtgtctgtaatcccagcactttgggaggcctaggtgggcggatcacctgaggtcaggagttcaagaccagcctgaccaatatggtgaaaccccgtctctactgaaaatacaaaaattagctgggtgtggtggcatgcacctgtactcccagctactcgggaggctgagacagaattgcttgaacctgggaggcagaggttgcagtgagccaagatcgtgccactgcacgcgagcctgggcaacagagcgagactccgtttaaaaaaaaaaaaagtttggtaggaagagttaatgctgattatttaagttatgtatctcttttcagtttaggattaaacagaatggtaaacttttggtttaattggttgcaaagtagcctctaattcccaggattattttaaaagctccctggtaaccactgaatactactgtgaacttctgtaacatagcctatctcctggcagaatggcttttgctgtgtttctagcttttctgctcaagtgttaaatgcattaaaattaatcctaaggttaggttctactcaggtgggaaaaaaatagctaatttgttaactagttgtttcaaatttgtagctgccagtttttgagcaccttaatgtatgtgtagtaacagagaatcaaaacatcttttgtgcactacccccgattaagttgtttaaaataatttatactagaggagtgtgctctatagtggtatattccctcatgattagaacctttattcttagtatgtttcagtttaaaagataccatcagatggaaggaaatcagctgcagagatagataagaatggacaatgcacacatgctgaaaaatgagatgctagaaggaaaatcctaaacagcactgtggtgaaaaatactgctttcaaatttatcaggatttaaggacagagactatttactgttttctgagggttgtgtagtgatgtatgctctttatataaaaaatgttgcttgtttttgccactgagaacttttcaaatattttcttctagattttggaaataatcagggttattttaaaactatatgagcagtggaagaatttcgatgagagaaaagagatggcaaccattcttagtaagatgccaaaaccaaaaccacctccaaacaggtactttgtagactttaattattgatgtcatttaatcatatatcatacttactatatttttcttagattatgttgttttgtagtttttaaaacatttcttccaaaacttcatgatccatgttaattttattttttaaatttgtgatttgattgagaatgtctcatttaaaaaaatcactaatctgattagtaacttttcctaatgcagtggaggtatattacaggtatctctcaacatatggtcatataccataaatttaaagctgacagaattaggtaagttcatctgaaattcagggcagaattcagaactatagtagtttcatgtcagtttgattctgtgccatcttttttttttttttttttcactgctggctattgtcctgttttataaatttcagtagcaattttcaaaaatttcaatgaatgatctgatattgtaaagataaagaattttggtttttaagtgaccctaaggtccatggcacataagaatatatttttgctaaaaatgaatcacctgtgctaagagggttttttttgttgttattggggtgtatgtgtgtgttttaagtaagatgtgttcatttagttcagtggttctcagccctcactgtgtatcagttcatttggggcagggagaaaaagtcagaagggaaataaagaaatgccatccatcttaattgtttctttagaaaaatgattgttatataacaagatagatttatggattgctactcataagttaatgttacaatttggaaaaagttaatactttattcaaggagctgtttaaggcagtcattcaaacagctacctttggatgcattttttgcagaaattccctgagtgattctccactagtggcagggcctgaagctgcaagatgatggtggacaagataaggcaataatcctattgccaaagttactggtattttcagttttagttatttttaagtattcagcatttttattttaagtattcagcattttccaggaaattaccatatttcttgctgacttataaaggtttgctgtatttatatatgattttattatgcctttggacaacagttttggttttttttttttgaagaacacttcttgtttttcataaatagtaggaataggattttatatgtaagatttaattttataggaaatttgtttagaagaagctgtaatctctatgttgagtgatacctgtaataacaatgaaatcccataccctaatttaaagtttttgagtatatatggacactaacttccagaatgcttgttatatgtgagggcacaaagttatataagaataaaaacataaaaccaatgtttgttagtcttctggattttaatttttcacgtgtcttataatgaggaatgtctttgttttgtatagttgtgccacagaataatgaatttaaaagtcagtaggcttatcagggtgtaaaaatggatcttttaattggtataaaatctctttcttccccatttgaacagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaaataagtttttctttaatatgattctagtacataattgattaaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaaaattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtacctatattgatttaaaagtgtattttattcagtagtttgaggatcttgccatggaagatactagcccagcctagcagaaaagtgcaatatgtatagcatactttgacattttaaacatgatagtccataaccattttgaaatgctgggcaaactacatgaagttatttataattaattcacagctaatcaggcattttgaaagcttaattggattcaaaaaccataatgttggaatttggtaaaattttaatgttgatttttactgtgaaaaggtttttataagatatacacaccctagtttaatgttgtgtcttggtgtggatttacagatttactacaggtattctgaaccaggaacacaatcaggtttcaggccagtttgatactggctgtccttaattctaatatgagagtaggacatcatactaaatgttatgtcagtgggactgtactgtctgtggaacttagcaaattaatcattttcttcagacttgaaggagagtgataaataaaatttggagtcataggatattgatgcacaatttaaggattaaacatttttaatcaattgtggatgatggcttattaaatgttgacttcctagtataaaactgcaagaataaaagtaacttctccagctgtatcgactagtgtcttgaatttatctttttgaatttgcctgatgttgttttttgagaattcttcttcctttagttaagtgttaaagccttttataggttgtcaagggggtaatttcaaatcattacaaacagattttaaatagaaaatttatttctgatggagcgtatcaaatgagctggaaagcgagactgtgtaaagtcagactgatgacatatataggtttcctgggcttaataagaaaaaaagctctcctcaggtctgaaggaattaatgttgggcttaggtaagacctatagtctttaagtgtttatttttaaaattaataccatgcctcatagttttgttttcagtctcttattgtggaagatttaaaacaacatatacaggagtaaagtaaggaacctccatgtacctatcatctagcttcagtagttatcaatttatggccaatttcatttcatctaaactcccacccactttccgtaagttgccatcccccatcttattttgaagcaaatcctagatatcatataattttatccataaatatttcagcatatattcctaagaaataatagctctttaaaaaaactaaaagtattattgtgcctcaaaaagaattagtaaaaataatatcagattttcagttatttcacaagtataaaaattgttagagttctagtcaggatctaaataaggatcacatattacaatttattgacaagtcttttgtcttgttattattttattttctttttttttttttagatggagtctcactctgtcgcccaggcaggagtgcagtggcgcaatcttgttcactgcaacctctgcctcctgggttcgagtgattctccagcctcagcctccagagtagctgtgtctacaggtgcatgccaccacgcctggctaattttttgtatttttattagagacagggcttcgccatgttagccaggctggtcaggaactcctgacctaagtgatctgtccacttcaggctcccaaagtgctgagattacgggcgtgcgccactgcacccagccatgtctttttaaattcatgaattccttcccagtcacatttttaaaattcctgtttttggtttgcttgtctactaagagtctctcaccatctggattttgctgattgcatccttgacatgccatttaatgtgttattttctcctctatattttctgtaaattggtaattgaatctacaggcttgatcagattcaggcttgcttgtttgcttgcttcctttttttctgtcttttttttttttttagtagaccactgtacaaattaagtagtggtctttaatcaggagacataaagtggctgggtttctctatgatttaatagcagccattgatgatatgtattgtttttaaaaat

SEQ ID NO: 14591 - DNA, 5199 bp, Human
tggacagcactgggcaagaccaaaactctttgaaggcaggaacttggtcttactcatcttttgccttggcaccatgttttgtgtacaacaggggctctataaatcatttgtcaattaagcaagatatcctacatgtggccagccccaatccacaccagaaatacttcatttgacatctcattctgctttttgagagcttaccgtgtttggttcttttctaggcctggggacagagtagtaagtgagacaaagtcctgcccacatggagtttcattctaactgaagatgccatattgaatgtgtgttataaatcagtgtaaggagctaggggcttggactgagaatgggtgtgctattttaggtattttaggtagggtgggaagggatggcctctccaagccacagagaactgaatgcagagagagggcggtccctgtggatgtttgagagaacatttcaaacagaggggactacatgtgcaaatgccctgagagggaaatgtttttggcgtattcagagcagagcaaggccagtgtggctgcatgtgagttggagtgggaggatgtgaggtaagccaggacctgattgggcacacccaaggagggcccggccaggacttgaggtttactttcaagtgtgatgaggagacacagggggtcaagaataggaaatgacagaagagatctagatttttgaaggaccacactggttgtcttgttgagaatagactgcggggcacggcacagaagcagaatcaaagagagcaggcaggaggctttggcaccagtcagcagtgacttattgagcatccaagggtgtatgcagcaggaaaataaaatgagatgtgttcagaatcccactgtgtattttactacaaattgaaaaagatccaggaaaagccatcttttaaaaaaatctctcttcccagtcaaaagcattatggcaagcccagaaaatgctcatgtggactgcctctgtgctcccagctgctgtcctgcactcagctgaaaaaccctcagaggaagtctttgagttataccaggaaataaaatcccctcaatacgcatttgttgactgtagaactaatctgagagcgttcttgtggaatcctttacttgaggtttgtaagtccctagcagattaactctgtttttagaaaacatacattttttttgattccatgcatttctgtagtgcaagtatattatagctctgtgtgtgcacagcaaccatttactgagcacttgctatggtgccttgcccctcaccaacctctttacatggctcatctcattttatcctagtaatgacctaacaagtagatgccactatcttcgttttctttctttcttttctttttgtctttttttttttttttttttttttttttagatggggtctcgatctgttgcacaggctggagtgcagtggtgtgatcttagctcactgcggcctcaaactcccaggctcaagggatcctcccgcctcagccttctgagtagctgggactactactaattttttaaattttttgtagatatggggtcttgttatgctgtccaggctagtcttgaactcctgacctcaagcagtcctcccacctcaggctcctaaagtgctgagattacaggcgtgagctaccacacctggcatcatcttcgttttcttgatgaagaaacaaaatgctccaagattatgcagatggtcagtgcagagaatggcttcaagtcagacacacctggattttaactctagccctgtacccactatctgtgtgacctcgcagcattttgtttctgtaccaataaaacaaaacatgtctcacttgaagccatgaggccagcgttttttaaagtgtggttcctaaaccacctacataagaatcaccagggttccttattaaaagtgcaaactgggctgggcgcattggttcatgcctgtaatcacagcactttgggaggccgaggtgggcagatcatgaggtcaagagattgagaccggagcagtgtgaagaagaggcgagaacgacccccggtccgaccaaagcccgcgcgccgctgcgtcccgcgtccagcacctatgtcccgctgccgtcgctgccgccaccatgcccaagagaaaggctgaaggggatgctaagggagataaagccaaggtgaaggacgaaccacagagaagatccgcgaggttgtctgctaaacctgctcctccaaagccagagcccacgcctaaaaggcccctgcaaagaagggagagaaggtacccaaagggaaaaagggaaaagctgatgctggcaaggagggaaataaccctgcaggaaatggagatgccaaaacagaccaggcgcagaaagctgaaggtgctggagatgccaagtgaagtgtgtgcatttttgataactgtgtacttctggtgactgtacagtttgaaatactattttttatcaagttttataaaaatgcagaattttgttttattttattttattttttttaaagctatgttgttagcacatagaacacttcattgttgtttttgggggaaggggcatatgtcgctaatagaatgtctccaaagctggattgatgtggagaaaacacctttcccttctagttttgagagacttcctcttggcttccaggaggagggattccctgactttgacacacatggccaccttggcacaaaagccttgtggtatagaaaaacaaatttgtttttatgtcctcgtctccctttccctctttcagcatagacttaactcccttaagcccagacatctgttgggacctgacccctagtcattggttaccagtgtgttaggcaatctggactttccagtgatgccactgagatggcacctgtcaaaagagcagtggttctgtttctagattatggatcttcagataaattctgccattttcatttaacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttgggaaaaaaaaaaaaaaaaagagattgagaccatcctggacaacatggtgaaaccccgtctctactaaaaatacaaaaattagctgggtgtggtggcgtgcgcttgtagtcccagctactcgggaggctgaggcaggagaatcgcttgaacctgggaggtggaggttgcagtgagctgagatcacgccactgccactgcaacctgggtgacagagtgagactccatctcaaaaaaaagtggaaatggggtgggatctgggagtttgtatttttaataatagtggatctaatcaatgataaatatttatctggcatctgcctgtagtgtcataactaggattaatatacttcaaaaaattggtcattttatatttacattacttttctgaggcatttggagcctcgtgaaattctgtgttttgaggtggtgtcttagtttggtttccccaaatggagcctgagacagggacttgtgtgcaggtggtttacttgagaggtgaacccagagcacaggtggaaggatcagagagactgagagaggaaaggaggaaaagcatataaagagtgtataacagaactgcttactgctaggaacaagagggactcaatcccacttggggaccctctaaggaaccatgtagaatgtgtcacagatggttcctccagaggacaattatccactgccttctgttgtcttttagttgagggttgattcctagttagttacttcccctgcacttcgaggctgagtctgtgtggggatgagaggtctttggagagagccctgaggcagaaaatcggagaccctaaggggatgcttggggtaaaatgttggtaatgtacacactactgtttacacagctacactgatatcaggggacaggtgatgtgtcaaaatacatctgctttaagcagaagttatcacacaactgctgtgtaattattacttgccacatttggggtaggggtgtgggaatgcagtctcccttggctggcactgaaccaacactatgttctccctcacacgtgccacaattttatgctgtaggggtgccaccaaaacaaatagtaggcattagattcttctcttttgctttcacattcttcatctttcaagatttcaaagaaaaagggcacaatatttgatgaatggtgcagaataaaaagcataagaaaggaaaaggaacaaaaacaccaacatcttagcttaagacagggaggaaaatattttttctgacttctttccaacacaaaatcatgttgcaaagaagggaagcagatagccctcctgggagttgggcatttgtgacagctagcctccaagatgcccctagcgatccacatcacctgggattcatacattaatgaattgtggctagcatgggtggcaacagaatgctgtagaagtgacagtgtgtgacttcccaggctaggtcaggaaaggcattgcagattttgccttagttactctttgatcactagcttggggttagggggtgctaacctttaatagtgaggacactcaagcagggtggagaggcccatttggggagaggctcatgtggagatgaaccaacttgccaggaccaacttggtagccaagtgagtaagcccccttgtaagtggatccttcagccttagataagtcttcacataatactaggcccccagcctttaatactgccagcaaagaccccaggtatcatgcggcagagacaagccatctcctctgcacactgtctaaattcctgacccagagaaaccatgaaataataaatggttattgttttaagccacggagttttggagtgatttgttatgcagcaatagagcacaagtacagcatttatttgctctgctatctcctttgattccacatggagaacttattcttgactgctcaatggacatggcagactaaatatcattctgtcatttcaaacatcactatgtaagggtaaaggaataaagaacaagaacaaagaaaactggagaggag

SEQ ID NO: 14592 - DNA, 23521 bp, Human
tagggatgctaagctaataaatgtaatgcagatattacaaaattcaaaaacatccaaaatctgaaacgcttctggtcccaagcattttggataaaggatactcagcctgtatgtaaaatgtttctccttcccgtaccccattaataagttccctgaatgctctgcatttagccttaaactagagggcatgggttacatccatatctaggtgccttaaaaaaaagtcgtctttaggtctgtttcaagatgtgtcataaaatacatgctactatagcttaagaatttaagccagcatttgttgagcaatgctgtatatgagtgcaaggtgctggagggtaaattgatgaataagactcagggtggaaggttgaaaaagcatgagtaaacacaggcaggtacatgccacatttatattcctttaggtactgccagctttttaaaactgtgacccacagtaggaaatacacgttaatttaaaagccagacacacacttatataggtatagtttcttgaaacatagttttaagaaataatacctacccatactacctggcttacccaacagctattttttataatattgttttctattttattttatttaaaaatgtttgttcttaacgacaaaattgatgtcatgatgtaattgatgcagttgttgtggatcaacagtttgaaaactgtttagctagtggtgtggtatgtctgaaatgtagagaacatggagtgatgcagtgagagatgacacttggtatttgctttggttccttaaagctgctctttttttttttttttggtctttcccctaaccctttataaatagattaatgctttctttcacttacttgattgcctttttatagtctgtcttcaacagatgaatcacttttatttattactaaatgtgagattcatttgaattcttgctagagtggcagttaatgagctttttaaatctttttggttgatttttgcaggttactaatatgccttatcacaggcattgattttagtgaaagaagtaagacttgcaggtttatttgtggagaccaatggtaatagaagatttgttttcaaaatcagaatgtcataattattatttagcaaacaggaaatttagtcatggtagtcagtaaatcaaaatcttctatatgttcttttgggaatttttttgaatgctatatacagatacttcagccagtcatcctcttctagtactgttccagcttttgattagttgtgaaagtttggagcttttcacatctaatgcttttccattggtcttctagcactattgttgatgaatctgctagaagaaaagcagccaccacagcaaaattcttaaccctgttttattaatgtagaaacatctatcagaaaagactttttttctgttgacagcaatgttaggaaggtttattaaacatccttttgctagtgacattatgccatatgttctatggaatgaaaaagtacaagaggtccctgcccttgaggatcttatcaactaacatgatttatagcaggacactcaataagtggattcttgggtgtttaccttttgtgtaatcagaatgtagatgatgaagaagatacttaacatgcattttatatctaggtaattagaaaatgtgaatagctgtttctcacttgtgttttctgcttgattgctcttctacttgcaaggcttaggtaataaggtcgagatacttatctggtttgatcttaaatgtttgaattcatataatttttaagaaatggctgctttaaagttggttgccagtaagtaataaaggatttattgtttgagtgaagaagaaataacatagttctcttaattttataattattttccagaattataaggaacagtatcaaatagtcatatgtatgggacactgtgcatacaaagcagggtttatagcacacttttccttaaaatcttttcctaaaaatacaatgagctgtatactaagtgttcacccttgatattccttccaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggttagtgaagttaatttgatactgactaaagtaaattacattttcaatttttgaagagcccttaagcccctatagggagcacataatttttaaaagttagagtaaaatatttattttagtattttggaacttacctcaaatttctgcttacatggaatgcactggaaatgctcttattttgctttgtctttacaaatgaatgtaattgactttatttgagaaatacatcttttataagtgactaatagtcaaaaatgattgtgggccgggtatagtgactcatgcctgtaatcccagcactttgggaggccaaagcaggagaattgtttgagcctaggagttcaagaccagcctgggcaacctggacaacatagtaagacccagtctttaaaaaaaaattaaaggccgggcacggtggctcatgtctgtaatcccagcactttgggaggccaaggcgggtggatcacgaggtcgggagatcgagaccatcctggctaacatggtgaaacccgtgtctctactaaaaaatacaaaaaaattagccaggcatggtggcgggctcctgtagtcccagctactcggaaggctgaggcaggagaatggcgtgaacccaggaggcagagcttgcagcgagccgagatcgcgccactgcactccagcctgtgtgacagagcgagattccatctcaaaaaaaattaaaaaattagctgggtgtggtagcatgtacctgtagtcctgctactcgggaggccatggcaggaggatcccttgaacctggaggttgaggctgcagtgaactgtgattgcaccactgtactctagcctgggtaacagcatgttaccctgtctcaaaaaaaaaaaaattgtggtgatgtattggcttaccacagtggtttgattaaaagttggatttaatttttgatttgtaggtttgatatttttattggacttgtattgtgcttacatttatgttctcatgactatataaatgaattacacatgcaaaataaaaattcttagttttgattacttattttaaaagtcaaagctaatggaatttccttttctttctctcctattaggatgttttgagcagtgacattataattctgacaataacacgatgcatagccatcctgtatatttacttccagttccagaatttacgtcaacttggatcaaaatatattttgggtaatagttttacatatttaacttctggtgtcatcagatttttgatttgctgtggaaataaacctgttcattcaaatcatgtatttggaaatatgtgtattgctgaaagtgtgctgcatgcattgaatagtttccttattattggcaattagacattctgaaatttgagaccttaataatttggagtaaactagtattatctcagaatgctgtgtgacactgttattatttgtgtagtaaaggataaagtttttttagtattgaacttttgtcattttaggtattgctggccttttcacaattttctcaagttttgtattcagtacagttgtcattcacttcttagacaaagaattgacaggcttgaagtaagtatttaaaacctaaatatactttctgtcaaaatacattttaaaaaacttttcttccccatgctgtaaaggtacattttcaaaagttaagaaaataaggggaaatttttttgtataattttactattagctaattttaataactattaacattttggcatatatccttttctactgtttttatacttaaagaaaatatctgatatcatatatattgttttataatttctttatgcttaataatagtttatcaacatctttccatgtcccttttttttttttttgagatggagtttcgctcttgtcacccaggctggagtgtaatggcacgatcctggctcactgcaacctccacttcccgggttcaagcagttctcctgcctcagcctcctgagtagctgggattacaggcacctgccaccatgcccatttaatttgtgtatttttggtagagactgtgtttcgccatgttggtcaggctggtgtcaaactcctgacctcaagtgatccgcctgccttggcctcccaaagtgctgggattataggcgtgagccactgtgcccggcctccatgtccttaatgttaaactaaattgtttgtaatggctatatgtattctcttctgtctaaacgtcttgtagtttattaatcatctaatgttggactgttaggttatgtaattttttttattaataacaacactgtgatgaatgtctttgtaacgaaatttttgttcatatttgtaatcattttcttaagatacattcctagaagtgagacagtggttttgctttttttagagctttgcttttttttttttaagagctttttagtgctattattgccaatttagtttacagaaagtttgtttagtttatccttccacaggtagtgatcaatgaaaatttttatatattccactttttttccctaatggtaatccaaggagatattttttactaaggatgatactttgatacaaaattatcaaaaggtgtttaaatgtaaatatacttacattttaacattaaaaatatttttaacaaatattttgagcaactactatgtttagctttgaggatgccaaagaaatatagggtatacttttttgtctgcagaaaggtacacatactacaggatcatacagtatggagggggaaaggttttgttctaaaaagaatttttttaaaatcatactttttcccgttaaatttatctgatcattttgttcttttccagtgaagctttgccctttttcctacttttgattgacctttccagagcaagcacattagcaaagtttgccctcagttccaactcacaggtaagtattatttataagataggaatgtgaatagtattccttttttcagtttacattaataggaaggattaatagcgtttcttcatagcacaagatttaagaattgcccaaagttttaagtttaattctcaagtcccaagactggtctccataagtgccccaggaacagtcccctgtatctaacaactcaattatgattctgtagctactggaatttggaattgcccccatttttctttttgaaagttttcagaacttatggtaataataatttttgggtaaataagagtattttcctagtgaaacacatcagagagcagaacaagatctaatggaagagaaacccagggtagattgattgattgattgatttgagatgtagtctcactctgtcacccaggctggagtgcagtggcgagatcttggctcaccacaaccttcgcctcctggtttcgagggattcttctgcctcagccacctgagtagctgggattacacatgtgcaccaccatccccggctaatttttgtgttttcagtagagacggagttttgccatgttggccagactggtctttaatttctgacctcaagtgatccacccgcctcagcctcccaaagtggtgggattataggtgtgagccactgcacctggccagatttatttttaaaccccttaaattaacactggcattatttcctattttaagtttcatcttaatgttcattagtcactttgaagaacctaaccattttaacaatattatatcagagtatcttgagtataaaatagcacacaattctgccctgattatttgttgatgaaagtgtgtgatcatttgaacatattaacaaggaaataagtttggttttattaatactaatatgatctcataaaatttgcaactaagcttctgtcatggtaggtaaaaatatagaatgttgtaggatttaattatgtgtgatttaaatgacagagttaatgcactacctcaaaggaatattcctaacaaatatcttattcagtggaaagggaatcagggcactatatgttcttttttaaaaatttggctgggcgcagtggctcacacctgtaattccagcacttcgggaggccgaggtgggcagatcacctgaggtcaggagctccagaccagcctggccaacctggtgaaacccagtctctactaaaaatacaaaaattagctgggcatggtggcgggtgcctgtaatcccagctactcgggaggctgaggcaggagaattgcttgaacccaggaggcagaggttgcagtgaaccaagatcacaccattgcacattgcactccagcctgggaaacaaagtgagactacatctcaaaaaaaaattttttaaaatcctttatattacaatcatactttgtatcttgaatacctgttagttttatcatattgtatattttactctttgaatagtaatttgatattaatataagccataggatgctctaacatttaaaaaagttgttctgtcccttgccttcattgatatgtttgatctgttttaggatgaagtaagggaaaatattgctcgtggaatggcaattttaggtcctacgtttaccctcgatgctcttgttgaatgtcttgtgattggagttggtaccatgtcaggtttgtaagcaatttttgccatattttaaaataggtatgtcgctaaagaggaaaaagaacatcttggatttgtattatttattgttaaattctgacttttaaattactcttaaaattttttattatattagtgtgtgggtatatctggcctgtttgctttggtggaaacttagcagcaggttactgatttatttttcactcctgccatcctctctttgtgttccactttgtgatatttttattcatttgatttcttttgtttgtttttttaaccaacattgcattccaaggttggtctggaaaacactttccagcccctgctgttacttagactcaattggtgacttggttctttgtgttttaattatcatgtagggagaaaagagtcaggaattggacagatctgagtaagattcacctaataaggtgattggaaatatttaatccgatagtaagcagtacatctcagcaagtacccagcattagcttcaacacatgtttcttcattcttaattggatagtagagaattagatattaatatcaaacataggacttcattatgtagaataaaaattacagactggcatggaaatttgccagaaggaatatattacgctgtgtgaaggtctcctaatcattaggattatattttatggctttcttataaagaccatacttggttaactactgtgtatttcctggtaccttagagccctcaatgagatgcctcattctttcagaagtaaattatctaacttttaagggggtaaattattgtcattagtttaggcctcttcagtagatagtatattaaaaatgtaatattgcttctaactttctgagagcaaattattatttatttattttattcaacaaagattttatttagcaaataaaatattttttaattttaaaaatttacttactttaaaatttacttttgggagtacaattttatgagttttgacaatgacatagtcttgtaaccaccactacactcaagaaaaaatgttgatcaggtgaaaatgtacttgtttgattttattcaagcaaaagaatatatgagaaggggattcgccaggaagtaatagttgggccatgaaaccatgggattattcattgaaataataatgatgtggaaagcagctgggcgatgagttttgtcatgatatggtcagagaagtagacaaaggaagtgattagatttgtggttggagaagacagtgagacatttacagctatacagaaatggtataattagagatttgggttacggtaaaaaaggacagatttaacacatattaacttggaagtaaccctttgaaaaagccagtacaaaaagaagaaagtcttagcttcttggatgtctgtggattggtgctgtttctttgtgtgtagagagacttatctggggacacagtaaggaagaatgcctggagagcatatggcaacaacatgagtgaatattgtgcagagagaaatagtagatagtcaagtcatgaaagcattggtcaagtatggttttaatggcctcaagtttgaaaagattatattcagctactatttaaaatgtagtttgatttataatgcttttgttattgtgattttgtagtctcttgaatttccacatttgagggtaatcgtggaattaaaaaaatacaatatatgcttgttctagtcagtcaaatgatatcttaaaatttaggtaataaaatacaactttgagtttttgtgagcagtttttataggacaatttaaatttatgtttcaaagcattgggaattaaaaaaatacaatatatgcttgttctagtcagtcaaattatatcttaaaatgtaggtaataaaataaaactttgagtttttgtgagcagtttttataggacaattcaaatttgtgtttcaaagcattgttatgtttgagcgacatcagaaatatgttttatattatactcaagtttatttgtaaagtgagggagaaggatttggtggtcatctaaggtctcttctagcctctataattctgttttctatttgagatcaccaaatgataccttaaacagttgtagtacaatatgtttgttaatttttagtcttaagttggcattttgtattatatcattttccaaacagatcaatgaaataaccaaaattataagaacttcagtaggcatcatagaggttatattgaaattagagtttgttggtacacaaaaaatattattttgaccttatatcaggactggcataactggcaggatattctacttatataaaaaatccttggttaattggcaaattgcttttctcctaacaagtgggattagatcaatagtgtcactggggttttgctctgttagagtagcctgtcctctccttatttaataataaggcactactgcttgacaaaaaggaattggaaacacatatgttttatcaattgtgtattaaacactaccattctgcctggcattgtgatatggggacatgagagaaggcaagagctttgctcttgagggacttagagttctgttgttattcctgctgtttcctaaggcttggcatcacctctaagttgctaattctatttccagtaagtggcaaggagcttaatgtactaatattttcatgttttgtccacctgcagggaagacaaatatatccttgtgatatatgcagcataaaaaataacgtagactttactagttgtatctttaatttttctctaaccaggggtacgtcagcttgaaattatgtgctgctttggctgcatgtcagttcttgccaactacttcgtgttcatgactttcttcccagcttgtgtgtccttggtattagaggtaagaccaattcttacatatggcactagtagaagagtaagatttctgcttacacagtttacctaaacagaatcaataccttctaatgtcacactgacttaatttgtagctttctcgggaaagccgcgagggtcgtccaatttggcagctcagccattttgcccgagttttagaagaagaagaaaataagccgaatcctgtaactcagagggtcaagatgattatggtaatgacatggttttcttcttcttttagtatcctcagttccaatctcattatttttaagatttctttttttctacaattttggcccattcaatgatattgcacccccttcttcctttttttcttaatgtgttcatttctttgaggctcctggtctttattagcccctctctcctaaacagactttttaagttcccccaccttatctctcgttgaaagcctgttctttggggtgttttcagtagttcagtggggtcactactttagttagttgcatagcaagcttggggctttttttttttcatggtaaggggaagctatgagagataatgtctggctgtccagttgctagggataagaaatttaagttctattgatatgcagaggatacattactttaaaaattttatttcagtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaagtaagttaattgaaatctactttgtgatatattaatcataacactctatgctaatgtaagtttagattgtgtcctttacatttctgaataagattttaatttgctttcttttatttagaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaaggtaacttgttattctcttcgctttcaatccttcattgctttgtcaaaaagtagtctgttttcaaaattatgtgccgtgttgtgagatttcttttgatttcttgaacagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagaggtgaggatgataacataaactccaatgtggcatttttcattacaaaggagctttttcaaggaagaaaaatctagtatctgctgaacactacagctaagttctgggcacggtgtaacatgactaacagatactatcttctttctttatttcacacaaccttgagaggtaggtacaattatctatttttcagatgagaacattgaggctccaatatgtttaatttcccaaagtagtacctctaggaaatgataaagctgatagcagggtccaagattttctgactccagagtcaaaactctttctagtttattactgtttatcatagagatgagtgactactgtattctcataggtgtgttgaggcctagaaagagtttaacacagagacaagtttcaaagatagaagaaagtttgtttttgttttgttttgtaagcttgatacccatgaggaagtttgcttttctttctgacatttgaacaggaccttctgcctacatgaccatatgaatctactcatgctttcatgcaaataatcatgttccatccatgtctgcttaatatggttctttcttttaaatatatgttaatacgtttattggtaaaatgcaattttttgccagctttattgaggtatacttgacaaaattttattttattattattattattattattattattattgttttggagacagagtgtcactctgtcacccaggctggagtacagtggcaccatcttggctcacagcaacctccacctcccaggttcaagcgattcttgtgtatcagcctcccgagtagctgggattacaggcatgcgccaccatgtctggctaatttttgtgtttttagcagagatgggatttcactatgttggccaggctggtctcaaactcctggcctcaagtggtctgcctgccttggcctcccaaagtgctgggattacaggtatgagccactgcatgcccggcctgcattcttcaatcatatgctttttagctaaacttagtcattgttctttaaatacagttcccaactctgggttcctattcttgtcatctgacatgtctccccctctccaggtgttcacacctttagggcaaatgctagcatctctatgaaacctacctcaattccgccaaacagaagtaacctttcttttctgaagcatccattatatagagactgtgcatttttaatggcagtcgtaccttgttgcttatatcacatttacatgaatatctccattattagacatcgggctcttagatggctaagtccatgtcttgagagggccttggatttcataggtgctcagtaaacttactaagagaatgaatgaatttgcattgataatacataaaccagctaatgtttatcttactattcttttgaaaaattaggctaatattagtgtttgcaaagaagatccttgaataaacccacaaaatggaattactggtaccagttttgtggagggtggtgattgtgagtgtgtgtgtgtgtatgtgtatgtatgtatatcaccaccacaagcagagtcaagagacagctaataaaccaagagaaaatattggcaatttatatttaaggctaaagggctaatctctaatatataaagagctcctacaaattgatgagactaaatttttatctaatttttaaaaagagcagataatcagtctattgtcaggaaaaaagtacatatggctcttaaaaatgtgaaaaggtgattaacttcatcctaagagaaatgcaaattaaaattgtacttgagatattttcactcatcagattggcaataatcccaaagtttaataacatactctattgaggttgtagggaaaggtcttttcttgtttttttgggtttttttttggtttggtttttttttttttgagaaggagttttgctattgttgcccaggctggagtgcaatggcatgatcttggctcaccgcaacctctgcctcctgggttcaattgattctcctgcctcagcctcccaagtagctgggattacaggcatgcgccaccattcctggctaattttgtatttttagtagagacggggtttctccatgtttgtcaggctggtctcaaactccggacctcaggtgatccgcccgccttggcctcccaaagtgctgggattataggcgtgagccactgcccccaggctggaaaggtcttttcttacattggtggtgagaaggcaattggaccgtgtttattcaaattaataaatttgtaaaaattataaaaatttataagattgtaaatgttcataccctttggcccaacacttgtgtgaatatatacccatatgtgtgcgtgtatatatatatatatgcatatttataatcatgcctaaaaacatctctggatggatacacagtgaaacagtggtacctatttatgtgtaggtagcaaagaactgggcagatggtagacagggatgggatgaagactttttgttatatctcttttaatatttagtttttaaaccatgtgaatatattgcctgttcaggatatcaaaaatagcaagtttactagagtttaaacaatagctgttatatctgacacacacttgaaaccttgctaaattcacatttatttttctttttatggtgtattagtgcaagcctgtctttgtattgtaaaatctaatgatacggtatttatattatttttgtttggcattttttgcattaaatgaattattttgcagaggtatcttttaattaaaaactacagtgatttaatttaaaaattacattattttagcttagcattgtttgtattaaatggtttataacatgaaatacagtccttcaagtcttctgtttcatctctctctctgaccacaatttcattttttttctccatttctttagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtatgttattttctcgattaagagagatttgctttgtatgtttttaatcttttttcttgattagtttcatatatgtacatagttttataaaacattttccttttaaatcattttatcctaattttttattctgcttatgatgtaggtcatagaaattaaaaatatatttcctgcttttatagtcattactcaaagattttagtattttaaacactttttaaaggtgaattaaacattttgtttaaaaagaatacatactaaaggattaagtttgaagatagttatactgacaagctgagataaaattttgtgcatttactatatagattttcatttggtgcctgactttaccttttaggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtgtaagttggcatttatatatttgccagtttaaaaatacatcataagtaaggcaatgagaagagttttaaggacaattagtgataccttttgggtcaagcatgagcatttttgggtaacatgtgcttgcttctctaacatatactgtgtagcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcaggtgtgtgagtggatttgtatgtacagttatatctatttgtttattttagaaccagtgtcattttctgtgattaccaaacataattgttaacatattacctgctaaagagcacataacagaatatcaactttaaagccattcatttaaaatgagtaatatttatgcttggttggggggaaaaaaagaatgttgattcaaatgaatagctccacagaggtaaattagtaagaaaaaaaaaaaagtgtgagctagtaattttgattagatgttactttgcctaggagagaactgtcttagaaaaaaagatttttcaaataggagagaaatattagtataataagacttacttcaaataaagaaaattaataaagtagcataatcaacacaaatgataaccatagtatagttcaagctaacacatttgtttttatgtgaactgtgtaagtttattaagaaataattgtgactgggcgcagtggctcacgcctgtaatcccaacactttggggaggccaacgcgggcagatcacttgaggccaggagttcgagaccagcctggccagcatggcgaaaccctgtctctactcaaaatacaaaaattggctgggcatggtggcccgcgcctgtaatcccagctactcgggaggctgaggctggagaatttcttgaacccgggaggtggatgttgcagtgagccaagatcaagccactgcactccagcctgggccacagagtgagactccgtctcaaaaaaaaacaaaaaacaaagaaataataataataaaagaataaaacacagtctttgcatcttttatttatagatttgcacgtctacagaaacttcatacaagtatagctggacgcaacctttatatccgtttccagtccaggtcaggggatgccatggggatgaacatgatttcaaaggtaagtgtaggcagagtatctgaaagtacttttattaaaatgaaagtacttttataaaaaacaaatcaggcatttgttgattggtattccttacatttgatagatttaatttagacttggcattacacatatcctgagtttacttaggactgggaacaatcttagtattgacatttcaaaactttatccagtcaagagaccacctttgaagctgacctcttcaagatttgtctttaagaacaccaatataatttcagtactttgggaggccaaggcaagaagattgcttggggtctggagtttaagaccagcctgggcaacacagtgagatgctatctctacaaacaataaaaaaaaatagttgtgcatagtggcacacacctgtggtcctcgctacacggtaggctggggcaggaagttagcttgagcctaggagcttgaggccagcttcggcaatgtagcaagaccctgactccattcatccatccgtctgtccgtccgtccgtctgtctgttttcaatttaggatattttctgcttatgtggggtttacagcctaataaacctatcaaaagtcaaggagcatctgtataagctttaaaattgccaataaacagtatggcagttcaacaacttaaacatgaaattaccatatgatccagcagttgcacttccgggcatatacccaaaagaactgaaagcagttctcagagagatatttgtacagctatgtttgtagcagcatttttcataatagccatgaattggaatcaaccttagtgttcgttgttggatgaatggacaacaaattagatgtatttgtatgtgtgtgtatgtatatgtctatataaaatggaatattattcagcattaaaaaggaaggaaattatagcacatgatacagcatggataaacattgatgacattatgctaaatgaaataaaccagtcacaaaaagacaaatactgtatcattccacttgaatgaggtgtctagaatagtcaaattcatagagacagaaagtagaatggtggttatcatgggtttggggaaggggaaaatgggtggttgttatttagtaagtacagagtttttgttttgtgagatgaaaagagttctgggagcaaagacatggaaccaacccaaatgcccatcaatgatagaccggataaagaaaatgtggcacatatacagcatgcaatactgtgcagccataaaaaaggaatgagatcatgtcctttgtagggacatggatgagcctggaaatatcattctcagcaaactaacacaggaacagaaaaccaaacaccacaccttttcacttgtaagtgggaattgaacaatgagaacacatggacacagggaggggaacaacacacaccgaggcatgtcggggggttgggggcaaggggaagagcattagggcaaatacctaatgcatgtggagcttaaaacctagatgacaggttgataggtgcagcagaccaccatggcacatgtatacctatgtaacaaacctgcatgttctgtacatatatcccagaacttaaaaaagagttctggggatttgttgcatggcagtgtgaatatacttaccactgtacacctaaaaatgggtaggatggtaaattttatgtgtttcaccacaataaaattatgtttttaattgccaataaatatgttttggattattgaggtatgagttgttaattgaattaatgccatttaattggaagtcattgggaagcttatttgtattttatgtaatataaagctcaacgacataagagtcgaatcacaagatcaactcttatgacccacttctctttacagacttcattacttggggttttaggtaacagctgaataactagaagatggaatttattactcattccccagtgacatataaatatgagtatttttattgaatatttttaacattatcatcttttatctacatctttttcaacaatgactacaaagaacttggttttcataccgagaaagaaacacattaggaatttatacctgaccaagaaagtaattgtgatggttaacaaaacagctgttacttttgtgctcagtttctttgaagtatagttattatacttagaaatatatcatagatacaaattcttctcataaggatgaaggatgaatatttcatgcagtttaatatgtgtgtgttttgggttcttgttaacagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtgagtgactggatggataatttatcttttttattttgtaatctttaattgtatttaaaaatgggggaaaggagtattaacattttaaataaagttaaatatatgggacagtgttttccatcaaagatgactgttgtaccttgcccatctgtctgtgtgtatcatccataggaacaaactttactgattttttttaattttttttattttttaatggaggacagggcttaaatggggccacatctaaactttgttttctggaggttcagaaagatagatttgggtaacattcccctgaaccttctggaggaacatctaaatgtacacagctctgttttgtaggtattaaagactaccacagaggctatgattgaggtcaacattaacaagaatttagtgggctctgccatggctgggagcataggaggctacaacgcccatgcagcaaacattgtcaccgccatctacattgcctgtggacaggtgagctctccagcctccacttctcttgtgttacgtctttctaagtgaaagaagtatattgtatattttttcttttcttgtttccaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcaggtatgatgtatcaggcatagagtccacaagcctagttctgactctctgggtttctctttctatctgagactatgtatcactcacctctattttaattggtcttttccaaactcttttgtcatatcagcctaatccattgtgtccaaataagcatgtttaagcttatgcttagataagaaagtagatgaagagagcaaatgaatgttcatctactgagttaagggtactgccagtcaggctgtgaatattatgttagctatggtattatgcactgtcaggtgtggctgtcaagtcttggaaagttagtgcttccagtggagtctagttctattctgatgccattacagttgccctgtttttagttgatttagtaagaaattggtcatgattttaagggtgaatcttgttgtgtctctccctggctacagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtaagactcaaagatatatttaacatgttccccctatacttcaaaaaatatgcagtgtaaaaacttactattcatctactgtagttccaagttaaaattctacactcctgatatttatatattgctactttgtcattttctaccataggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaaaatggatttttaaattatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagcattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgtttaaatataaatgtttgtctggattggctataacatgtctttcagcattaggcttttaagaaacacagggttttgtattctttactaaagatatcagagctcttaatgttgcttagatgagggtgactgtcaagtacaagcaagactgggaccttagaaatcattgtagaaacacagttttgaaagaaaaataccatgtctctaagccaactttaattgcttaaaagacatttttatttagttgaaaaatctagttttttttgtaaactgtatcaaatctgtatatgttgtaataaaacttatgctagtttattggaagtgttcaagaaataaaaatcaacttgtgtactgataaaatactctagcctgggccagagaagataatgttctttaatgttgtccaggaaaccctggcttgcttgccgagcctaatgaaagggaaagtcagctttcagagccagtgaaggagccacgtgaatggccctagaactgtgcctagttcctgtggccaggaggttggtgactgaaacattcacacagggctctttgatggacccacgaacgctcttagctttctcagggggtcagcagagttattgaatcttaattttttttaatgtacaagttttgtataaataataaagaactccttattttgtattacatctaatgcttcaagtgttgctcttggaaagctgatgatgtctcttgtagaagatggactctgaaaaacattccaggaaaccatggcagcatggagagcctcttagtgattgtgtctgcattgttattgtggaagatttaccttttctgttgtacgtaaagcttaaattgcttttgttgtgactttttagccagtgactttttctgagcttttcatggaagtggcagtgaaaaatatgttgagtgttcattttagtgactgtaattaatatcttgctggattaatgttttgtacaattactaaattgtatacattttgttatagaatacttttttctagtttcagtaaataatgaaaaggaagttaataccaataagtgtaagcagtaaccttttttctttggattaaccctagccctgaggtctggaagcttgtaaagtctggtcatagtagtaacctgtaattcatgctaggactcacatgaccatttattctcaaattctacaacattgattgatagcagtattctattacattaaaatgagctctcttagagggtttgattagttcagatttatcatctcaactagacatcttttggatagtgagagtgggagggctagttaaggagaagaggggcagccacaaccaaacagccattgcaagcatttaagctgtgtgagctgaattggagaggggaatttgtacagcttggtatagctgaggatggcctctttagaaattactgtgagtcagtaatttacagaaaattattgactacacttttgctgtaattagaggtaaaaaggtatgtgtgagcactaagaaagaaccaaggcccagatactagagaatcagtttgagtttttctctgaaatgacctgtggtcacctgtatgctcagccctctccagggtggaacaggctggacagaagagagtgaaggatctttaagcctgctctctgcctgggtgatctgctgagcaatgagatgcatgtggcaggacaggatgtttgatttcaggagacgatacaggattaaatctaaggggcacatctcacactgaagagcaaaacacatcaataccaatctcctgagcattatgttcattgtggagattttttcatgaccagtgtttctcgaagtatgctcctacgctaggtaagtcttgaatttattaattactttgccagttagcaaaaataatgggtaacctctacactggaagccgagagaagatggcagatgatttagtttacaattatatatttaaagcttaacggattgcttttttcattttggtgtgcttggaacacagccctcctacccctatccctgccgcttgttttccatcctgagcaagtttgagagctgcagagggaggtatgggcactcttgcatcaggatgtgagttttctaacagctgctccctaaggccaaaagaagagcctcacactaacagctggagttaggaggctgaatgcaaaagatggctttaatactgcggctctcaaatgagtgtgcatttacccagaggacctgcttaaacagactgctgggccctgccccagcgatttctgattctcttgttctggggtggggccggaacgtggcagttaacagttgctgctgctgctgcactaataggttggaatttcagtatgaggtgcctggtggggcttgaatgaatggttttacaaaactgtttattcagtagcacaaggttgggaaacacctggggagagaccgagtgttggctaataaaaatttaattggaattaacccgagagatgtaataactaactagaaaatgttatttgaatttggtgctcctcacacgcccccctcctgtcccagaacaacactgaaggtcttctccatctcttcaacctgtggagtgactgccccagagagaggcatttgccatcacctattccgtttaccctcctgtttgttccctgcactctgctgcaaagggccaaatagggggaaaaattgagctcctgttaagggtatgtatcactgtccactccccatcctcaccccacctgccctatgaagtttgactcctttgaactttaatgtcccaggattgtagtgctggagcaggattagacccaggcaacagcattccagttggctaattctgaagccagttggcagggagcataaaagtaggagggccttgtgccagctgctaagcatacaaggtgtgtatgtgtgtgcgcgccagctaactaagcatacggggtgtgtgtgtgtgtgtgtgtgtgtgtgtctgtgtgtgtgtgtgttggaaggaaagcatcgggaagtaatccaaactagaagggctatggtcatctaccctgtgttgattatggaagtccttt

SEQ ID NO: 14593 - DNA, 37288 bp, Human
tcagctaatattatcgtcatgtgtgctgcctggagaaatttttaagtggaaaacaaaacaaacaaacaaaaacacaggccagacgaggtggctcacgcctttaatcccagcactttgaggggccaaggcgggtggatcacctgaggccaggagttggcgatcagcatggccaacatggcgaaaccccgtctctactaaaaatacaaaaattagctgggtgtggtagcaggcacctgtaatcccagctactcaggaggctgaggcaggagaatcgcttgaacctgggaggtggaggttgcagtgagccgagatcgcaccactgcactccagcctggaccacaaagtgagactctgtccaaaaaaaaacaaacaaaacccaacaaaataaaacaaggtgaactaaaatgagaaatatccttttggaagaacatagttccaaatatttattcattcaacaaataaccatttagggccaacttgcactgacttttccttataacacataagcaataaaccctattattgcgtactctcgcgtgattagggaacgttgttaagaggctcaaaaatcggacgtcatagctcaaaaatcggacgtcatagcacattggctaatggaatcacccaggggctttgcggtttccccttccagcagccagaggggccagagtcggaagctgggggtcggactcttggcatcttctggtggattatgaggtttggattaactgggatttcccgttggtgtttttctgcctcatctgtttagctttttgtggtcccctttttggtatccaacttgctctttcttaagtgaagtttctgattaaagcaagagcttcgagtaaggggtctgaccgtaatttttcactggttaatgtctgacgtccagtaggtgctgtctggatcattctccgtccctccctcccttctttccctcccccccttcctttctctccctttctcttttctttctctctctccctccctccttcctttctctttctctctctctctctttctctcctttcttggatggagtcttgctttgtcacccaggctagagggcagtggcgtgatctcagctcactgcaacctccacctccggggttcaagtgactctcctgcctcagcctcccgagtagctgggaccacaggtgcgtgccaccacacccagctaatttttttgcatttttactagagacgggatttcaccatgttggccaggctggtctcaaaactcctggcatcaagtgatgcgcccggaccctcaaagtgttgagattacaggcgtgagccaccgcgcctggccttgaactttattttctcattgagcccaggcacctcactaaattcggctcacccctatgtctcactttcctacttttgttttgaagcctttgccccaccccctccacgttgccgcctttttcgtactgagcgcgcagggcactacgcccaccactccccttgacccactcctcaagccctgataccggggcgaggccccttccttttctagtccttctacgcgccaggtgggtgggtttcgcggtgacgaggcgacacctctttcccctctggcgagcacgttaactggggaagctaccaaattctcacgccttagctgccctgcctccacctcccgcaagtccggttgcccctctaggcttctgcgcctgcagtggttccgaccctcgcctttagaactctgccgcttccgcctcttatttcgcgcctttgtttttagttttggaaggggcggagttgaaatggctgcgccgcggttgccgaagcaacgctttggttacttccgttggtttcaatgcttccgggttggcgctgcagtggcgtttccgactgtgggagcctcagcttcccagtcgtccgatgagcccgagcaggtgagggggagctcctggacttccaggctggggagcggggctgggccgcgccaggccgcgcggggccgggctggcctggttcccggcctgggaggggcttaacggtcctctggtctctctctcccctcagctgagtcccttccctgtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttgcaacggcggccgtgattgtaagcggagtaagcaaacacctccattgtattagtgtaagggatactgttgaaagatgctccccttcggtttctaccccctgtcactcctgaggtcaaggcattgaaggcatctattaaaatgcagttcagttacttgattggcatgacagctgttatcaacatgaattagtttctcagacaggataacagcagggacatttatggtttcctgtcagtgattccttgttgttgttgtttttccccccagcctagagatgcctagcgttatcatgaactcttccctcgtcttcattccctacatcatcgagttctttgtgtcttcattggggaagtctatctctaacctcagtgccaacaagcatctttgtctgctgtactttgcaccatcctaagctagtctccctgcctctcccgtttgtaatgtaatccactgtgtttgctgcagccctaataggctaaaatgtggtggatttcctcaagtcacttcgttgttaaacacacacacacaaaacatgcagccccctcctacaccccctacccccaccccttggtttcaagcctttcaacataacatgctccttatcacacttcttgtctgatactgtttcagtcaacaagggaattctctgttccagttaggttcctttcttcttggcacaaaccatactgatgcctgcttctacatgctgtgcttgttcccacatttgtgtttctgttcattctctcttccctgcccctctcccttacctgcacctaaccaggttgtacctaccgtctctcaaggttcaatttaggttctctcacctcggcaattttcaaattagtcaatcccatgctggttgtagtcttttctatgctcctcttgctcttaaagtttgtactacacagtttagtacttaatttttctctaacgcactactttgatttcttccaccagattataagctcttgaaaggcaagtactgtatttcgtacttttttctctgtcccatctcattggttattcagaaaagacaggttgagtggtaaatattgtcttggtgctagaacgaatatctgtgtttttcaaatatgattatacccaaagtgcattgcaggtttgggcatttagcatgccttcaataaatatctgcttggctctccattgttaccttctgaatctgagaatctctaatttctactctttcttaaaggagaaagcaggagaggcacccagagtttcctgaccagatcttgggagtagtatagggcaatgtaacttgtatcgtaggacattcttactttcactcattagtctatcaaattctccgaagtcagatcttcagaataaatgttggcattttgaagacaattttcattggtttctttatacagtaaaaatatttagggtactatatttttattttaccttagatatgactacttttacgcatatttggggttagcccctacaagttaaaataatttttagagggcttggggtattttacataagtaattccttggaacaaaagcaagggaacagggttcgcaggcagagaatatctggggatcaagatagtgtcatacacagggtgtgtagcattggccaggtccagcaagttaccttccttgtttcctctgcaatcttttatatacaggctgcatacataggtaaaggatgtcacactgcaaaaccaactaagtattgaatggatatgtattcaattctatgcaagctataatgggggttataaaaagtactgtgagatatagtatcttcccttggggatcttacttagttaagagaggaaataacattggacatcttgaagttgaccctcatcctagtcattatttttatgcctgagattaagatatagaagggataaaagaaggttcaaaaaatattgcacacctgtagaataggtgtgacacaacacgcatgcatgtagacaactttatgtaaaagacttggaggtttcagctgacagtttaatgatttgatagtgtgatgtggctcccaaaaaagtgagtgcaattttaagctctagtaattgaagtataatgtgtcaaatgaagagaaagatcatggatatttagctcgagaaacatgagatgtaagagaacatcatagctgtctttaaatatttgaagggcttgcctagggaaaaaagaatgcatttgttgaatattacctccaaagactgggtacaaattagaggaagacagacttttggctcaatatgaggagggagtgtctaaaaacagatctaatcaaatatgatccaggatttcttcataagattttttcctaacattggagtgaaagagattttactatcagatgggggtagggaagtcgtgattgtggcaatggtgggttttgcctgtggtctccagatttttggatttcatgggccagtaaaatgtaaatgaaaatgtgggaagggtacacaaatacaggctagttagcctgtgctccaggcgtaagaagaatctgatctgttaataatagacagtccctaaattaaatacatttagctgaaaaaaaaaaaaaggactaagtgtccttatttttttcatttcgccccagaattgtgggaacttcattagggaaccactgggctaactggcctaagattcagcgactggtctttcatcttcctgccatgtcctccctgttccttgcctttcactgattcatcattgctccctgagcacattttccttattaaagggctggtagcagcttgtgaagttccgatagaggctttctctgtaatacaaagagttgaaaaaagttgtaaggagaaaaagttttggagagacaactttaagtaaaagtagctgtctgaaacctttaagactatttggggcaatcgataaatttgtgaatggagagttaattttttcctcacaaactcaaagaggggatatgccatggtcttgcttttccatctctactctcaccatatgtgtcatattttactatcaattctaattggaaaatgtgggcatagctagaaatggtgataaggtagtatttagtcttcaagactcctatttccagctgcagttgatacttgaagtggctattcctactttgctcattagaattcttttcaacaactttccctcaaaagggctatctatcccagactctatatgtgctatgcttgaaaggaagcctccataatgatttttgtggcctgtaactaaaacatttaatcagcgtgtttgctatcttctctggaaaattgtattttgcttagttacagagaattccttatgtggaaacaaagcaaaaccttcaaagggatactgtgactcatagctgctaaccccagactgggcaatgggagggaggggtgggcagcaagtaatatctgttaagatgtaaatttgggtacttaaatttttaaaaatgtaataatgatagttaactaacaattattgagctacatgccaggcacttttaaaggtgtttttcatatattatttaattttcacaacaaccctatgatatagtttttattattagttccattttacagttcagaaagtggaggcatagagagattaacttgcccaaggtcacagaactagtaagtggtggagtcaggaaatgaatctggagttagcatttaaattttaacagtctgacttcaggagtctgcattcctcaccataaaccacttggaagttgcttttgaaattcagaagtatacatactgtgaagctctgaaaaaggaatatttgaaagaaatctgagagtccatgctaagaacagatactactttcagatggaccaggatttagtaggcaatgcctagagcagttcttaagtgtggaagtatcagcgttatttgggatcttgcaaattctcagggccataccaccaatcagaaactctgggggagaggcccaacaatctatgttttaatagaccttctagatgattctaatacatgctaaaatttgcaaaacctagaggccagagctctggaaaaaataaaatccaagagagagcaagctgacagtggcagaaaaagagagtaaagctgaaaagattgatgatgacaggtctaacgggggtgggatagggaaggagaaaagggaggctgggagcagaatacgttgttaaagaactagaacataaaagaagaacagtatttatatgtgtgtgttttaaaaggccaagaggaaggaaaaggagatccactagatggatgtacgttaaatgtcagagggaagatagacatcatattgctatcattcctttgggcgctagaaggaaggtgaaaaagttcttagctcagcctgggcctagttggggggacaaagttatatatagctagataccctatagtagagagataggagggctaagaatatgagagagtagtagtgtgagcctgtgctttgcacctgaatcaagctaactgaataccatgaactgcttttatgagatgcctcagcctatataatttgaattccgggttccttcatttgtaattatctagttgaatgtcaaagttgggtgtgctggatggactgaagcctcttctctgggtggggatgaatataacattaaagaaactggagagaatgaagggcacaggttgatctctgagtgaatcacacgcctacccctacaaaatgtcagtaaagaacaaactcatgatcatccagcacataaaacaggatcccccatttttgtgtcattccacttggtggggtttttcttctacatctattttatttgccaattttgtttatctaaattatatgatcagatgctaacaaatgctcctcactcttgtgccttgttctgatttgtgtttatttttagcaccagaaaagtaccactgtaagtcatgagatgtctggtctgaattggaaaccctttgtatatggcggccttgcctctatcgtggctgagtttggtaagaatgtgagaaatgacaaatctgcattatacggtatagatggtagcttatgatgatggttatttttggtgaaagctaggtaaaaaataagaagctcgccttattttgaaaattgtctcaaagccatgaagtaatatttcagggaaagtactactgatggtatggcagatgagttaagaaaagtcaaactaaggaaagcttttttggcagtttagtgatttgttagtttgctaggcttaagtaaaatacatgaatatatagagggagttgatatgtcataagggtttttgctatatttctgtattaatagtcttttatgctaaattatttataagtttatttgtactgaaagtcctttttttcaaacctctttcccattttagaagaaaatgtactaacaagatcaaacaagattctcttctacatgattttgattttgaaatatttttagattgtcgtttttttcatcttccagatgttctcttttctaaactattcatgagtgactactgacgttcttggcatatcctgtggtgttgtgatatttgggtcatcagtgaccagagctacctaatcaccttgttagttttacaccctgaaatatattttatcaatgtgatgaccacttctgtttgttgatgtaagaggtttggttaaagaaatttcccccccaaacactctgctggtattagtcctgaattacctaagggaccaggatgagtagaaccaaataagactttgccattatctttcataatattaggggactatttgtttcttgtaaacagataaaagaaaaaccccacaaaactttgtaacactatataagagcatctggagcagcaatcccatgctttcctatctttgtgaaaatttagggagattttatgagacacagaggtggggagacttggggtgggaaggggcaggagggagactgataaatgccagattatatgttacagatgaaataaaaaacaacatttaattattttgcatttataatagggcaatctgaaagcattttattatattacagtttgaagtatattgtgggtcaattggtgctgcctatgtatagtataatgcatttcacttaccacatgcaactcatgttctctgacagtggtattctactagagctcttctatgtgttataaaaaggactttgtcttaggattcaaatattgtccttggcttatatttagcaacaacttaactgtgattctttggacatacttataaataagtgtgttcctttatagggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcagggtgagactggttctttccttatatcattaacagaaatgctttttaaagaagccatagttttcagctgtctgatagtttgtgtccgtttcatattcaccatttcaacttgtaattcagtattgatatgccagtttatatttctcctgcttgtaagtcttgagctttggattttgtgttcatttggttataagtgataataacattttaaaatggatatgtcattgcagcataggctttctgtggatttcccgagagtcactaatagccactgttaataacagcaccaattaattatatatatttttgtgatatccctcctgagttggcaaattctgacttcctttaaaattttcctctttgaaaaaatattattcttgcagtttaaacagaaagtgcataatgagagagagggagacccatctttatcatcaccttttgattagccataattttgtggtttactgtctagtttgtagtttatctgttgccagtttcctaggccactcctgcatctaggctaccagtttattactcagagaatagacatcaattttattgttaaactatgttacatcgttaaactatgttagacttaatttaaaaggtaattttcttgggggaaaaatcaagtagtgtatcctgaagcatcctgaagatgatccaccatcctgatttgtggatcatctgtttcaccttgttctttcatcagcatagatcatcacaagatattttctgatagcaagcaataaagtcagaaatatgcatatttagtcatcatttaaaaatcctaaccatttgagctgctgctgtctttctatttatacctcctacagtatagttctgcaatttggaagaatcccaaaggaggtatgaatgagaatgtctccagtttaaaggagaacttaaatagggtggaattttggctctagtacctccttgttgatgtgattaaagacgtatctgcaactgttaggaagtagaggttgatttttttaaaaaaatctttattaggtgagcaatgatgtataattctttttatacattgctggattcaatttaccaatattttcttaaggagttttgcatctaagttcatgagagacattagtctgtggttttccttttttgtactgtttttgtctggttttggtatcagggtaatactagccaaaattagttgggaagcattccctcttctgttttctggaaggaactgtgtaagcttagtgttaatttttaaaatgttttgtagaattccccagtgaaattatctggggctgactatttctttttggggaacatttaaattcagagtgcaaattctttaaggttatcatagtttggggtgctataacaaaataccatagactgggtgacttataaacaatcggaatttatttctcacagttctggaggcaggaaatctgagatcggtgccagtttggtcaggttctgctgaggtctcttttctgggttgcagactgccaagacttcttattgtatcctcacatggcagacagagtgagggagctctctgggatcccttttataagggcactaatcctgttcatgagggctttaccctcatgacctaatcacctcctattaccatcatattgcgggttaggattttaagatcttgatttggggacgatacaaacattcagtccattgcaatgggtatgagttttattcagattatttgttttatctagttgagttttggtagcttctggttttcaaggaatttgtccatttcttctaaggtgttgaatttatgagtataaagttgtttataccatactcttattgtccttttaatggctgcaggaattgtagtgctagtccctgtttcatttcttatttgcatcttctgtctttttatctttgtgagtcttgctagaggtttatcaattttgttgatttttttttaaagagctaactttttgtttcattgatttttctctattttcctattttcaatttcattgatttgtgctttttattattttcttttgcttgctttgggttattttgcttttctttttctagtttcttgaggtaggagcatagattattgatttgagactctacccccccccttttttttttttaaaatgcaagcatttcatgctgtaaatttccctcagcactgctttggctgcatctcatacattttaataggttgaattttgttgtcatttagacctgtgaattaaaaaaaaattcctttgacagacacttggtctgaccaatagattatttagatatatattgtttaatttctaaatgtttgaggatttttcttattgatttctggtttgattccattattgtcagataacatattgtatatgatttcagttcttttaaatttgttgaggttggttttatgacccagaatgttcagtttcttgctgagtgtttcatgagtgcttgaaaaaaatcatattctgctgttgttgggtagaatgagatgggtagtccaaataagtaggctatctagatatgtataatctgaaaatgttgagaataactttttacttttttttttttcagaattgctcctgcgttgctaagacaagcatcatatggcaccattaaaattgggatttaccaaagcttgaagcgcttattcgtagaacgtttagaaggtcagtatacttaccctcttttgaggtgatactcaaagggattgttgaaatcatgcttagtgagaaatgttggtcatgaggtgcctgagaatggaggagagtcactgcaaagacaaagtgagcttgttctaacttggaataaatctttgcagaggtgatatatgaattagagagacctgttcttcaaatttgtcccttttcctatcaacaaaaaaggcatgtgatcatcccaaaagaaacatggaacaatcttgtccagaaaattaatgctatcttcatcaataagaggacttcaactgtaaggcattttctagctggcaattttgataagcttttattaggcagaataattttaggctgttttctaaattctgatgtacctttggctaccttatgcatattcagcattatcatatgtctgtttgctgctgtagcattttccatcatgatactacactaaatggttattttaccacaggcctggggctgttggatgtttggggacagctggaaagcctttcggttagtaatgtcctttgaatcactttattgtcctaaagtcaactttttctgaagcctttttttggggattgtgaagggttctcttccacctctttctgaaatatttttctttcatagattcttcacttgggtttatttagtttctatttgtggggtcttcatggtgtgaaggagcggtaaagattgaatttcactatagaacaatgtgctctgtggtttctttgttcttttttctcactgaggagatttagttctaaatgattgctttttcatatttgactacagaaatattttataaattaacagaggctaggagagatctcaggcctatcaaaattaatattcaaataagttttttgtattagacgtaagattttctcttttaacattcagttcctgaatctttagagttgatgattacccagaaaaagacttaaaaagtatgttctttagatgtttgaaaaggtcgaaggggaaataccaccttctgaatttgtgtgtgggatactgatagttatgtagaagaaaaggacgtgttccagtgtcctttagaaataatgatgtttttagaaatgatttatattttacaagttttaatatattttagcactgaattgagatctagaaatatttgagtttctttattttcctaagctttttggttcatttctaaagtcatctctctaaccaagtttcccttcctccagtaggtcagtagtatgtactcaaactggtgcctaatacaagcagacctttctttttcttttccttttcacagatgaaactcttttaattaatatgatctgtggggtagtgtcaggagtgatatcttccactatagccaatcccaccgatgttctaaaggtaagagagatacagtgtgatttgaaaggagcataactttgagtcagatttgggttcagattcccactctgtcacttgccagctgtagaaccttgggcaaatcagttaactgcattaagcctcaatttcatcatttgaaaaatgaatataatacagtgtttataacatagagttgtaaaggattagcgataatatatatataaactgcctatcattgtacttggtgtagtagatgctcaataaatggcagtcagtttattatgatatgtgttaatccactggtcctcacactggggtatgcaagaccctataggttctttccaagggctatgcagttttataggaatcaatttccagatctcttacatccatttgtactccatcctaaaactggtacgagaatgaatctgttcataatagcccttactcaattttacaaaagaaatgtacgtccccacctattctaaatcttggtatggtatgttgacctgtggtataacctgggatgccaaacagaggggtaaactgaaatacagttcttggagaagcctattttagtaaccaatttgggtatcttaagtctgtaatgcctctgtctttccctgtcttattaatatttctattcagggtgagatttggctttaaacatggtatattttggcctgtattggaatattctgaattcagaaccagaatagtataggttggtggtgctgacttgttaagagtatagttggatttctttaaggttttttcaagtcacagactgaaacatttcttttaatataaattttcatcttatttcataaaatggtaaatattttctacttattaacgtatttaagcttatgattagttaaaagcactaaatataggattaaaataagtgaggggaacccaaagttttaacaaattattttaaggggattgcgagaaaaaagtaagaggacacatgcttttttaaatttgaccactagtgaaaccacaagtggctaggttagcaaaggagagatctatttattgcaattcagagaggggtttgagaacagagagaaagacatgaaaaacaacacacatgaaataaaccactggtggttgatggataaaaatatgagacagtctttctggactaaaatgatagtaatttacagaatttttatatcattttaggtttacagaacaagtttttttttcaccgtttattttagattcagggagtacatgtgcaggtttattacatgggtatattgtatgatgctcaggtttgggatatgaatgatcccatcacccagatagtgagcacagtacccaacagtttttcaacccttgtccccctccttctctcctgcctctattattccctggtgtctattgttgccatctttgtccatgagtatgcaatatttagctcccacttataagtgagaacatgctatctttggttttctgttcctgcattaattcatttaggataatggcctctggctcaatccatgttactgcaaaggacatgattttgttcttttttatgactgcatagtattccatggtgtatatgtaccacattttctttatccagtccaacggtggtgggcacctaggttgattccatgtctttgctattgtgaatagtgctgtgatgaacataggagtgtatgtgtctttttggtagaattatttattttcttttggatatatactcagtaatgggattgctgggttgaatggtagctctctgttttaagttccttgagaagtctccaaactgctttccaaagtggctgaactaatttacattcccaccaatggtgtctaagcattcccttttctctgcagcctcgccagcatctgttgtttttactttttaataataaccattctgactggtgtgagatggtatcttgttgtggtttgatttacatttctctgatgattagtgatattgtgcatctttttatgtttgttggctgcttgtatgtcttcttttgagaagtgtccgttcatgtcttttgcctactttttaatggagttatttggtttttgcttgttgaattaaattccttatagatgctggataccagattttcatcagatgcatagtttgtgaatattttctcccattctataggttgtttctttactctgttggtagtttcttttgttggaagaagatttttagtttaatcaggtcccgcttgtcaattttttgttttgttgcaattgcttttgatgacttagtcataaattatttcccaaggccaatgcccagaatggcgtttcctaggttttcttttaggattcttaaaatttgaggtcttacatttaaatctttaatctgtcttgagttaatttttgtatatggtgaaaggtaggggcccagttttattcttctgcatatagctagtcagctgtcccagtaccatttattgaatagggagtcctttccccatgcttatttttgttgacttagaacaggtatttatgaagagaatttaattgaagagctccttgtacctcttactctaagcagacaaccccacctcctatggcctggccttatacctctcaatttcgtgtcctttctaccttacaggtgtaaacttacttccatctatacccatccttatcttgtcttactgtagtggttttccagaccagaccagtattacctgggaacttgttagaaatgcaaattatcaggccccatccaacacctactgaaccagaaagggtaggatggggcccagcagtctggtttgacaagcccttcaagtgattttgatacatgctcaagtttaaaaaaaacctggttactctacttttattcacttctgtttcatcagagacctttatcatttgtcctctttctcttattttcagtgtcttcctctttaccggttatcttctctcaaatgataaatatggtcaaatctctctatcctaaaatattttcttgaccctctgacctcaaaacaccatgctatctcttttcttaccttctcatccagattttacaagagtaatctttacattccatttccttcataacctgctgtaatcactcctgctacttgattgaaatcactctccacagggtcagcagtaatgtcctcattatccaatccagtggacattttagttctcatcttacttaacctattttgactaattccttctactagaagttcttttttggttttgttactacactatttagattctgcttctagttttcctattccttagcttcattcatgggcttcctttttatgcatatactttaaatctttttcttctcccacccaaggttccatctttagctcttttctcctcttcagtctctccttgatggcctttttcattctttttttttttttttactattattattattttttttgagacggagtctcgctctgtctcccaggctggagtgcagtggcgcgatctcggctcactgcaagctccgcctcccgggttcacgccattctcctgcctcagcctcctgagtagctgggactacaggcgcccgccaccacacctggctaattttttgtacttttagtagagacggggtttcaccgtgttagccaggatggtgtcgatttcctgacctcgtgatccacccgccttggcctcccaaagtgctgggattacaggcgtgagccaccgtgcccgaccgcctttttcattcttaatactttagctctcactatatcagttaggttatgggctaagctactgtcacaaagaaactcaaaaataaaaggtctccatatacaagtatttatctctctcatgtaaccatctagaggactgcagttaatgctggtaaggcagaactacttcatgtagtcatccaggatccaggtttcttcatttttgttgcactgccatctcctagggcagggattggcaaactactgtctgtgggtcaaatctggcccaccccctgttgtgaataaagttttattggaacacagccaccccatttttttatttattgtctataattgcttttgtgcttcagtgacagagttgagtagtcacaacagaggtcataagccctgcaaagcctaatatatttactgtctggacccttacagaaaacgtttgttgacccctgtcctatggtattattttagtctgtatagttgaagttggaccactatcaaacctacattccagcccatgggaagagagtcaagggaaagcagtttccttttgatttgtcaaaaataaagtcaggaaaaattttaaagtttattgtatgcaataagagaaagtacgggtctcgatccaggatacttcaaaccaaatgataacaaacttatcttacagtacagtttataaagcagaagggcagaaacattttgaccttttttgtgattggctgttataaattatcgttcttttaaaggcaagcagctgtttaaggtgattgtctatagttattggtttcatttcactgaagcattctgacaaagatgtaaagcttatgttttgtgtttatgattagagatagcagttccgaggaaataggatgacttaaggttcggttacctgatgatgggtggctggtcttggggtttatctcaattgttgcctccatttttatctttaacagtttaaatctttaaatatgtagttttggagaaacaatttcaaacatatgagtgagtagaaaataacatagtacagtgaacgtctttgtacacatcacggaggtagctaagattttgctacatgtgcttttttattccctttttctgaattattttaaggcacattccagacattgtcattttcccccatatacttcgatgtgcatctcataaaaggaatatttttctatataaccatggtgctattgttacatttaacaaaattaacatttattcattagtaacatctaataatctatgttcacatttccagactgtcttatattttacagttgatttgtttaacttgggttccaaagcctatgcattatatttaatagttatgtttcttaagtcctttttattctagagtaccccactcctgtccatataccttttatttatttatttatttatttgctttttgccattaacttgtcaaataaatgggatcagctctcctttagaattcccaagttttggatttgtctttttgcttccttgtgatatcatttaacttatttctctaaatcttctctctctgtaaaagggaaggtttctgtaaaggtcataccgagtcatgtgaggaggcacacagtgtttggttgtcccaatatagggatgttaaggttgatcagtgggttcaggcgtgacagcccgatttctcctttgtagtttcctgtcaatccttcatctaatggtttcatccattggtggccattacctgaattgattgtttcatttaaggtcgcaaagtggtgattttctaattccatcattccatccatgtttcttagctagaattcttctgcaagggcaatctttttttttttttttttttttttttgagatggagtctcgctctgttgcccaggctggagtgcaatggcatgatctcggctcactgcaacctccacttcctgggttcaagcaattctcctgcctcagcctctcgagtagctgggattacacaggtgcacaccaccacgcctggctaatttttgtatttttagtagagacggggtttcgccatgttggccaggctggtttcaaactactgacctcaggtgatccgcccacctcggcctcccaaagtgctgggattacaggcgtgagccactgcgcctggccaaggacaactttttctcatttagtagggctgtttggctgttctgaaatataggcaatttccttttaagcaagacactgggaagtttcaaccattatttctgttcacgttccattctgaaggacttggttccatggctacatctagcttcaagaaaggagagtagattttgggagacaataatctaccacactacccagacctactgggtcatctaaactagaaacctagatcatctttgattcttctatatctttgcttccttctagtattggattaggtatcaagtttctacagattttgcctcatctgtatttctcaactttgtcctttccccaccattccttttgtaggacctcatctcagtagcctcctaacttgtcccttcactctagtgtgtaccccactccctcaacccatctccagatgaagctggagagatctatcgaaatccatatctgatctactatgtactgcttctttgcctttgtgcacgtaacactttcttcctgaaacgtctttctcattttcctggtgaatttgtccttcaagaccaggctcataaacagggccaggactagggcaaaacaagtaaggcagtcccctttgatgcagaatgtaagaaggtgccacaaaactcagtaatcaatataaacaacatttgtatgtagtatttttaaacaatcaaaattaacgcaaaaaattcatgatgaaccaaataccaaaatttcacataactcatctcattcaccttaccctaatcctggccctgttgagtcctagctttagttaaatttgatatttgattcattatggctttttgtggattaattttggttaaaaaatatcatattgagacatcatttatcttgattactgagtttttcttgcactcccttacatttcatgcctaagaaaagtacttcacttgcctcacgctagcccctctgttgtcaggaatcacctccttaaagaagtgttctacttaccacagtgtattagtagttttcatttgtctttgtgataggttgtatcttgatttaatgggtttaggtttttataattacaatatttgaaaactcttagtagtaacagttaactttctgcataaaagcatgttgccattacatgacttactaaagacatttgttgaaacctagaatggtagcatggtgcttcataaaaatcaggcctacatttgggccgctagtatttagtgactgactactaggattgtatgtgtgcagagtctgtgggaaattgtaccaaaccttttacatggccatttaatgctatctttccttcttgcagctctcaaaggccacttggcagaatataatattatgctttttataaatagaactcaacttaaggtctcataaacataaaattatattttaaaacacatttttcatttttataattacgtaagcaatgcatgtttaatgtagaaaaatatggaaggcagaaaaaacacaaaagagaaaaatgcttacttgtagcctcaccactcagacataaaccactgtaagtatttagttttatatgttcacctcgtctctttgctgtgcttatggatatttttaagtttacatgttttttataaaaatgatatagtacttcgcaattttttttctggttagcaattaatttttgatatctttcagtgtcagcaaataccattgtacaacaaaattttatggctccatagtattctattaaatgaatgtataatttctgtaaccaacctgtgtagttgtttttggatattaagttgtttctaatttttcactaaatgagtcattttttagtcctgctgagtacttgatctttcttttctccaaattttcttctagctccagaaataatagacttagtgtgaggaatgtgaggccgatgaaaaccatttttataaaatacactttgacacaaattctttttctatacagtttaactaattaactttatcataatagcagatatttttctgggattcctgaatacttctttttaaattttagatgaatttaaaatgaatttaaatgaacttaaaatgaatttagcattttggttctctctgacaaaataagatgttcacctcttttcattttagattcgaatgcaggctcaaggaagcttgttccaagggagcatgattggaagctttatcgatatataccaacaagaaggcaccaggggtctgtggagggtaagtactcttttcctgctattatcctacactctcagttcctacaatttgcagagaatttttttttatataaagacataaaatcgtgaattataatccaaaaactaaggtaagaaactcctcatctcccttgaaaggcccaaaacttatcattggccttttatttctgcataatgtttggggattatataggtggggaaagttattacattatttgagatggctgtttcgatcatattcacagtgaatgtagttgttcagtgtatttttttgcaagttctgtactaacacgatgatgtatgtctttgtagtgcttatgttcaaaagctgttaccggctgtgtgctgtggctcatgcctgtaatcccagcactttgggaggccaacgcgggtggatcacttgaggtcagaagttcaagaccagcctggccaacctggtgaaaccccatctcaactagaaatacaaaaattagccaggcatggtggtgcatggctgtagtcacagctactcaggaggctgaggcaggagaattgtttgaaccctggaggtggaggttgcagtgagccaagatcatgccactgcactccagcctaggtgacagggcgagactctgtctcaaaaaaaaaaaaaaaaaaaaaaagaataagaaaaaaaagctgttaccttaaacaattttttaacctaaaaagtctaacatgtactgtaaaatattgagaaaatatagaaaagtaaaaagaaaaaaaatccagtagtcccactgcctagagataatttctgttaaactttttgtcatattatctttcagtcttctatctatactttgcttttcgtcattgttgctctaactttttaatccctaattattgtaatattaataatattattagtagaatatacagagagagtggaatgggaaatctattaatagacttttaaataaaaatgagagctttggtatttttctttataatttttcataacaaaaatttcaagcataaagaaaaattgaaagaatagaactatgaaatacatacctatgagctggatttgatggctgttaaagtttgatcgtatttgctttatctgtttacgtgtatacagacatacactctttttagctaagctaaatgaaagtaggttgcagacatcatggcactcaattaaattcttcattgtgcatctcctaagaataaggatagtcttctacataataataataccattatcatatctaagaaaatgaacaagtccctaatacctaatatctagcccatattagaatttcctgttaatgagaccaggctaatttataatttattttcttccttcctccttttttttttttctttttttttttgacagggtctcactttgttgcctaggctggtcttgatcttctggcttcaagtgatcctctggccttggccttacagatgtgagccaccatgcctggccaggctagttttcttataaagtgtttcctcattgtgtttgtttctctatctttatagagaaaatatctttatatttacagtttatttcctataaactgtaaatagggtccattggcttgattagattcatgttaaacatttttggtaagggtgcttcataggtgatgctgtgtatttcatactgcatcacagcaggaggcacataatattagtttgtcccatgattagtggtgccaagtttgattatttggtaagatgacgtccaccagatctcgccattgtaaaacataagttttttccccctcctttgcaattagcaagtaatctgtggggtgataatattctagtaatatgcatatatcctaatatctaatcacctttcatctaactaatggtctttgcatccattaatggtccttgaggtttgctttttggtaacagcagggtacacttgcttgatatgtctaatttaaagccagaaaatagaactaactagaactttctcacaaactgatgacaaggaacaaaaacagaggaataaatagaattggagattttttcacaggagcatagctactttattttttattgtagtaaaaagtagacataacataaaatttaccatcttaaccatttttgatggttcagtagtgttaattaagtacattcacattgttgtacaactgatctccagaactctttaggtcttatcaaactgaaactctatacccatgaagcaactccccatttctccttcccctagcccctggcaacccccattctcttttgtgtctctatcaatttgactattataggtacttcatgtaagtggaatcacacaatatttatctttttgtgactggctgattttacttagcatgatgttctcaaggttcatccatgtggtagcatgtgtcagaatttcttcctttttaaggctgaataatattccattgtatgtatataccacattttgtttatccattcaaccattgatggacatttgaatggcttctgccttttgcctattgtgaataatgctgctgggtaaatgggtgtgcaaatatcttttttagaccctgctttcaattcttttggttatatagccgaaagtggaattgctggattatgtggtaaatctatgtttattttttgagaaactgaacataactgtttttatgatccaggctacttacatgatctaggcacctaacataaagaagcaaagtacattgttgaatgtattcttctgagacagacatgttttatttgcatgttaaaaatacaggacttattttttcatttcaacaagaaaatatgtttgcatttttcttcaaacgtgctcatctttgtttatcttcctgctctgattgtaacatgaatactgaaaacatttcactttcttcctaacttcattgtaagaaaaaatagcacgagcacaataacaaagtataactagcacttaccacagagttggagagagagtagcatggtggggactgtggtcctggagagcacggagagcacagtccccgttgagagaggacagctactccttagctccagcccattgctgccatgcgttgatggtgagcccggtgtggtcaaattttctggcctttcaagagaagctggaaatctgcatttctgtgtgaaatatcctgatttttacatattaacagccaattcagtcttttggaaacactgtgggccactcgaaacatgcctatagcctgattttggcctgtgggctccagtttggggccttactgttcaccaaagcagtcttctgtgaagggtaccctctttatgagaagcaggtcaaagagccagcaaggaaggcacccttcggctagccagccatatcagcacaatcaaacatcttggcatagctgtgtcacttccacttcattttatttatttatttatttatttatttatttatttatttatttatttattttttgagacggagtcttgctatgttgccaggctggagtgcagtggcgcgatctcggctcactgcaacctccgcctcctgggttcaagcgattctcctgcctcagcctcctgtgtagctgggattattattattatttttttaagtgaaagcaagtttattaagtaaaggaataaagaatggctactccataggcagagcagccccactttataaattgagtttgggaacttagagatgactgaaaactttttaatatagtggttatcccagaaagcagatgtcctcatggtatgttattttcaattttaactgacacctaaacacagttataaaagtaaaacattcattgtgaaaatgtaaaaagaaataggcataaaaatgaaaattaacatctcttatcctaataccagaggaaaaaaatattttgatgtatttcgttctaatcctaagaatttggcctggtgtgtataccttttcccctgaagacagaataatactatatataattttatgccttgctttatttaacatgctatcatgctatcataagcgttttcttgtgtcattaatattcttcaaaaatgtgacttttaatgctctagcaaccctgtgttgtaatgtgagctgtgataggagcatcgtgctagtgagtgaaaccctggtaatgttaccacagcaggacttgtaagcgaaggaccactttcccttggcttttcctcttgcttcttcatacctttgctgtcaccttagtgtttgtcctttctgcacatctgaaaattctgtgaattaaacctgaaagctctcttctccccactgatttttgcttcatgattttatttataacagctttattgggaaaattcacatattataatgataattcccaaattctttattgagataattcacataaaattcaccatctttaaagtatacgatttaattgtttctagtatattcacagattagtgcagccattaccactgtctgagtttagaacattttcattaccaaaaagaaacccttaccctttacccatcacttctcatttcccccagccctcctagctgtggacaaccactaatctactttctgtctctatagatttacctgttctaggtatttcatgtaaatggaatcacgcaatatgtagactttcgtgactggcttcttccatttagcatactgattttaaggtttatccatgttgcagcatgtatcagtactttattcctttttatgggtgaatattaattccattgtgtgggtataccacattgtatttgtcccttcatcaattaatgagcatttgggttctttgcacattttggctattatgaatactgctatgaacatttctgtacacatttttgtatgaacatctattttcagttctcttgggtatatacctaggtgtagaattgctcgctcatatggtaatctgtgtttaactttttgaggaagtgccaaattgttttccacagtggctgccccattttacattcccactgacagcatataagggttcctatttcttcacatcctcaccaacacttgctcttttactttttctttcttaatttttttaaatttttttttgaggcaggatcttgctgtgttgcccaagctggaatgcagtggtgcaatcatggctcactgcagcctcagcctcccaggctcgggtgatcctcccacctcagcatctcaagtagctgggactacaggcacatgccaccatgcctggctaatttaaaaaatttttttaagagatagagtcttactgtattgcccaggtttgtctagaactcctcctcaagtgatcctcctgcctcaccctctcaaagtgctgggattacaggcatgagcccctgtgcctggccttcttttacttaaaagaaaaatcgttatagccatcctagtaggtatgaagtggtatgtccttgtggttttgatttgcatttctctagtgactaatgatgtttagcatcttttcgtgtgcttattggccatttgtgtatcttttttgaaggaaatatcttcaggtcttttggccattttaaaattggattgtttgccttttttgttgtaagagttatttatatattcttgacactagtcccttatcagatatatgagcggcaaatgtttttttcctttgtgtatgttgactcttcactttctgagtggtgtcttttgagtcataaaagtttttaattgtgatgaagtccagttgatcttttttttttcttttgtcttttgtgctttgggtgtcatatcaattattttatttttagtatagcaagtgaattggaaatttgtatatgttccattattagtcattgatttgaaagagtgacgtctgtacttcagacttgtatttttctgttacttttcaactcctgacctattttgttcactctaagacatcactccctttgtatttccttggtgcctaatgtcacttgtgtttcgtagggtgtggttccaactgctcagcgtgctgccatcgttgtaggagtagagctaccagtctatgatattactaagaagcatttaatattgtcaggaatgatgggcgatacaattttaactcacttcgtgtaagtaggatgggatgtgctcattttatttccagcattttgagcacaaaaagcctcttttactgaaatcctcaggtggaatttgataactggtacgtatggcctaaatacccttgtctctcctattatcagaacttcaagccttatgaacactttatacttcacagaaatgccaggtgctatgggggcttgggtacttgggaacattgtctaatacagcagcctatcagaggtctatttgatttacatttatccatacacagcttctatatctaataagcacatctattatttgctttggttaattttgtttgagaaagcaaacttttctcagtgggaatcagaaaaaaaggggtaaataaggtctgtgaaactaaagcacagttttttggctaaagactgttactgatctcattttacattttctttgtcttgcaacctttatgataattttgttactcaaatgcatttggcatgtgatgctgtggtttgaaaaatttatgtaactaatacatggtgcatgatactttctacttaggaatcttgttaggtttagaaactctcctttaaaaaaaaggctgagtttcagattgaaaattgaagggacagcctttgaatgatgtctctttagaaaaatttcctgtctctttagattgtaacgaaaggccaagtgccaggttttatctgatgggtctgagttatattgtacagtttacgtttggcctaatttctgtttaagtgggcagggagtgaaagtggggtcgatctacttaaacttttcctcttagttccagctttacatgtggtttggctggggctctggcctccaacccggttgatgtggttcgaactcgcatgatgaaccagagggcaatcgtgggacatgtggatctctataagggcactgttgatggtattttaaaggtaagtacattgtggatttgggttacaatttggctttctttgatgtcttagaccttccttcagttcttattattagttgctacataccattttgaagatgaaagaatcatatttttttagtagcttctcagttattcccaggtagaaaagctgtctccttagcaatctgctaatttgcagtggtacttaatataatgattcccatttgaatgctttaaaatacaggatgcttttattaatagtatcatgtagaattattgatagaaaagacaatatatcccccatttgcctacttcatacaacacagagaccctgcaatagaaaactcaatacttaaggaaaaaagcctgtattttatttcagttcacggttatgctgttgttcactttggctttgaaagttcctgctgttgtgtttgtgggaactgaatattctaaaagtattacatcattactggtgatattattgctactgaaaacaaattgaggctaaaatatgatgttgccatatggtttctctcctgttatcagttttgtttaacaactattacatattagacaccattttagtagttagagagaaattacagttattacaaaagtactataggtatacaaacggatcatcagtacagcctgataagtgataaactcaagagttctcaatttggaagcattgaggtaggctccctgtagatggtggcatcttgaataacaataactcatatccactgagtgcttttttgtgtgtcagcaactgtccttatgagacttatgtgtattcgttcattgaatcctcaccattactccacgaggtagacactgaagcactgaaagattaagtaagctgcctaaggtttcacagctactaagtgggagaactggaatttaaactcagatcacttgacctcaaactgacatttacctctccactatggtgctttcctcatattggtggccaagggttagattataaaggatactgaatgctatattgaggtgcttggacttttttttaacttgtcagggagctgttgaaagtttttaatcagattagctttgcattttaaatagattactttggctttatggagactggatctaccacagtggttcctcatcttgggtacacattggaatcacttgggagaactttcgcagctccctcctctaccttagaccaattaactcagaacctggggagtaaggtccaggtgtcaatattttaaactatatcaggtgactgcaatgttcacctaaggttgaagactactaaggggataagcctggagccatggttcttcaaagtttaacatgcatcagaattacctggagggcttgttaaactgcagttcacttggagccatctccagattctgatttagtaagtatggagtgggacctggaaatttgcatttttaataaattcccaggcaatactgatgttgctagtctggagaccacacttggagaaccactgacctacagatagggaagctgattagaaggctcttgtaatctgagaaagaggggatgaaggcctgaacttgagcatgataatggagatatagaaggtgggacagagtcaagaaagaattagttgatagagtcagcaggatttgattgactggatgtggaggggtgtgggagaaaagaggtgtcaaagataagttctgggtttttggagttggtgaccaggtggtgacattcattgacagaggcatcacaagaggagcacgtcttgggggagacatcctagttttggatactcagtttgatgtgcatgaggaaaatccagtggatacatatggatattctagccctgactcaagagaggtttcatggatatagataaaagcccatggagtcattagcacacaggtggtatataactgtggagagagttgaccaaggagagtaggtagaggagttcacaacctttttgccttcccagcatactggagtactataaaattctttcccgtaataatgattgcctggggcagcaattctcagaccctggaaagtatagtttggcaaaagcccccattggtatttctgcatttgacaattactggtgtagagggaagagcactgggccaaggaaaaaacactgcagaataccaatttttatttatttatttatgcccaggctggagtgcaatggcgcgatctctgctcactgcaatctctgcctcccgtgttcaagcaattctcctgcctcagcctcctgagtagctgggattacaggtgcccgccactacgcctggcttatttttgtttttagtagagacagggttgcaccatgttggtcaggctggtctcgaactcctaacctcgtgatccacccgccttggcctcccaaagtattgggattacaggcgtgagccaccgtgccctgaccggaataccaatttttaaggtcttggcagatgaggaacctaggaaagacaccaaagacgaggaaacttagagagtagtgtcatgggagccaaagaagttaatgagtttcaagaaggaatgagtggttacttaatgtcacatgcaatagcgatctaatatgataaggactgcaaagagtctgttggatttaatattttttagaaggtttggtgaattggtgtttgcaaaagccaattgctgtgcattgaggaatatgtttgattattcattcaagtaataaaaaagaaaaaatcaagctgactcttgaagaggcccccccacacacacacaaaagaaagaaatgtttgtcttatgtgctaagcactgttctaggttgttgaggatgtactggtaaaccaaaatgtccctgtgtttatgacacttagattctaatagaaggagataaacacaggaagtaatgataaatagacaaatgtaaagcactgtttcaagaagattggctaaaagatttactgtaagatttactatacaataatatagtaatagctaatgtttattgaatgcttattctatcgcaggcactgtacatagagtatatcctttaactctcacagcgaccttgtggagtagatattatctttcccattttataaaggaggaaacttaggttcagagtagctaagtaataacttacacaagattacacagctaataagaggcaggtctgagacttaatccacaatctgtctgattccaaagtttgtacttacagccactatgctgttctgaatctgcagaaacatgtttttatgttggtagtaacctttaagtacttacatttgctcactcatttactcacttgctactaaaaaattttaatagcagtcattctttaaaatgactttgttctattttgccatttatgtaatagcatcagactttattattttgtctatgcttatctatagaagttctttgttttcacacaactgccttatgccaaaagatgcctcccagttctcacgttgtgaagaaattggtcactgtttttggaaatttataaagattcaagccgggtgctgtggcttgcatcctgtagtcttagctactcgggaggatcgcttgagccagagtttgaggctgcagtgagctatgtagtcttgccactgcactccagtctaggcgacagagcaagaccatgtttcttaattaaaaaaaaaaagatccagatggctcacaagagtgttagagacccttactgtttttgtgttcacctcttcaacaaatacttacgggaaaatttcttgcaccagacactgtgttaggtggtggtgacacaatggtgaacaaacaaagctagtttctaatctcttggagatttcattctagttgagggagacaataaacacacaatgcacagtataattttagatagaaatagatgctatgcagaaaataacagcatattgcaatagtgactcagtagtggggaactacttcagcaaggatggtcaagaaaagcctctgaggaggtgacatttgagctgagatctgaatgatgatgagctggccatgagagctgggagaaaaccatttcataaagagggaacaggttactgaaggcctgagttggaaataagctggacatgttcaagggttagaaagaaagctagtgtggctgagtgtgtggtgaatgaagggagaaactagtaggaaatgaaactggagagaaaggcagcagctaaatcatgtgggatcctataggtctttgcagagactttgtaattagaatgaaatccaccaggaagccatttgagagctttaagcaggaaatgttatgctctcatttataattttaaaagattgttctagcttctaggtagagattttagaccaattaaaagtccattgtggtagtccaggtaagagattatgagattggatggtctttcagaggtctcttgtcatttaacagtctaggttctaggttattcacatctgggctttatttggggtgattttcacaattttccaacatcagttttggtctcagacctttactatttgctgaagatccattgggggaaacatattaccactatatcttcataaatattgtgcttattattttactgtttgttcccaaaagtagttagtaaggataattatctctagtatacttaatgtacaggatgggaaaaagaatatttacaactctggcttctcatattattgtcttatccaaatatatcctttttttagaattgtggtgggtttcacttcactattggaaaggcaaaataacatttttcaatgtctaacacaatgcctaacacactgtagttatgtaatagatatttgtccattatatacgaaccatttctgctggctaaattcagcacgtgccaccagtttacaacgtttatgcataatttatcatttaattctcataaccatgtatataagacccctgttgtataaagtaggaaaccaaaactcaaaacacttcacatttttcttcatgtaatcctcaaagcattcacatgaggtaggctatggcattatatagaatttataatgatgaaacagactcagagaagaataatgacttgcccaactttctattttcttaccctgctttagttctctttgtggcacttatttttggatataatatatatcaatttgtgtatttgtcagccccactagaatatgcactccatgagggtagaaactgctgtataggttacctattgctgtgtaacaaattactccaaaactcattgccttaaaccatttgttattttgcagtttctgtgggccagggattgcaaagcagcttagctgagttgattctggcttaggctgtctcctgaggttgtagttcatatggcaactagggttgctgccatctaaagccttgacaggctgggatagctgcttcagtgatcactcatgcagttgttggctggagccctcagttcctcaccatgtagtcctctcttcatgatatagcagatggtttcctctagagtgaatgaatccaagagagaataaggcagatgctttattatatataaaatatattttataacctagctatggaagtgacatatgttcactactaccatattctgttggtgacacagaccaaatactatggggtggaggctacgcaagggtacaaataactggaggtagggttcattgggggccatcttggaggctggctaccatagacactttttctgtcttgtttattagtatattctcaacatcaagaatggtgctttgcatatgtatggtaggtaaatatttattgattaagtgggtggatggatttagactacagatgaatttaaaatggacctttagagaaaagactattcatggagccataagttgccctggggtgggagtggaaggtgatgtcaaatgtagagaaaggtgaattcactctgtttttggttatatctttcctgcagatgtggaaacatgagggcttttttgcactctataaaggattttggccaaactggcttcggcttggaccctggaacatcattgtatcctttgagagaatgaaagcaagtgcttcaagctcccagataattctaggctatgggaaggaaaatttgattattaaagccttttaggctagtgagaaactcaagcatcccattggtgacccttgagaatcaaattaagtaaagaaacagctttcagttggaggctaatacaaactaaaagggatagaaaagatatgtcaaactttactctttaaaacaaaatgacaacaaacacagctaatctggaaggggctatgaagtttttagaaaccctgatggacgaagcctacaggaaagtccatgctgaggtggttcagatttcctacccctaactataggaccaaaatagctgggaaataaaaacaggacagaagacattcatggggtgaaggaatccacagccaagcaggcttctttcttcatgggtgaatctgtctcctccagttgtgtttgagtgcctcctaagtgcagagccatgtattggatactgtgtgtggtgttgtgtgtataatggtaagcaccgcagggttggaaagtaattctctgcccttgtggggtctgtagacagagagagggtatctcgttccctcttggaatcactctgatcatctaattaattatatgtcgtcactgatgttcttggttactgtgtgtgtgtgcgtgtgtgcgtttgtcctgtttccccctgaagactataaatatattagagttttactctgtttatgttgttcgatgccagtgatctgaatgggcacatggtaggcactcaatgcatgcttgatttgacaggtggtgttttatttatttatttatttatttttatttttttttttgagatggagtcttgctctctcgcccaggctggagtgcagtggcgcgatctcggctcactgcaaactccacctcctgagttcacgccattctcctgcctcagcctcccgagtagctgggactacaggcacccgccaccacacccggctaattttttgtatttttagtagagacagggtttcaccatgtcagccaggatggtctcgatctcctgacctcgtgatccacccacctcggcctctcaaagtgctgggattacaggcgtgagccaccgcgcccggctgtcaggtggtgttttagaaaagattttaaagcagatgcagcttggaatagcatagactaccttaatttaagagaatgcgatgctaattttagaactagctttggctttcgatatcaacctggtgatcttccttgacttactcctcagttttttattacatacgagcagctaaagaggcttcaaatctaagaactgaattatatgtgagcccagccctgccagcctttctactcctttgcccttttcccgtgttctaatgtattttgacaatgttgtaagtgtttaccaagccgttggtctcctaagggcctcctgatggaagaacagtggggtggttcaaagttatttctatgtttgtgttaccatgttaacttttccccgagagaaagtgttaacattgagactctggccccagattggtatcttctatgaagatggatactgatgggtgacattgaaaacggcctgctttccaaatgtggttaaatgtaattggttagccccagacttgggctagagcagaaggcataggccagggtggttattgctatatgtgttacagacctcggttctcattaaagtatttattggcagaatcactttggctttgtcttcatttactattttctcctttgccaactcttgaagttacattctccagagaataataaaggaagataactatgaaattgagactggactcttaaagtgcacttttatgagacgagaatgagtgcattgtgctttcccactgccattcattgtcataatgccactgctaaacgttgggcaggtggttctttcttaaacatgaataaacaagcaagtggctcatttggaagttcctacaggtaaaaagctaaaaaaaggcttaaaatagaagcctgttcccagggttctaatcatcttacaggtacaaagttctggctactttttttgtactgaaacagagcccggctcattgtaggcactcaaatatttgtggaattaatagttcttcatctttatccattcattaatttgttcaacatttattatgtatctattatgtctaggactataaaatgactaagacatagtgtctgttttcaagctcacatcatagtggaagaacagatttgtaagtaaataattacagtaggacctaagtactatgtgagagatgaacaaaatgctgtgtgggagcacagaggaggaacagccttacctagaggatttgccaaaggcttcatagcacaaatgacactcgaggtgagacagaggaagagtctatgtcaccatgaggataaggcattatacattttgacaaatgtgtaatatgtatctatcattatagaatcatatagaatggtctcactgccctaaaaatcctctatgttcctcttattcgttccttcctctcgcctaacctctggcaactactgaggctttttactgtctccatggttttgccttttccagaatgtcatatagttggaatcatacttttcagattggcttttttttttttaacttacttatatgcatttaaggttcctccatgtcttttcgtggcttgatagttcatttctttttagcactgaataatactctattgtctggatgtaccagtttattcattcacccactgaaggacatcttggttgcttcgaagttttgacaattatgaatcaaactgctataaatatttgtgtgtaggtttttgtgtagacattttcaactcatttaggtaaatataataccaaggagcacagttgctagatggtacggtaagggaatgtttagttttgtaagaaactgccaaactgtcttgtgaagtggctgcaccattttgcattcccaacagcaatgaatgagagctattgttgctccacatcttctccagcttttggtgctgtcatcggtttggattttggcccttctgataggtatgtagtggtatctcattgtttatattattattttttaaaacatttactatatccatcagataccctactcatccccaaattagcaaaagggaacatattttttgtttcacaatagtacagctgaaaatagtttctttttttgttgcccaggctggagtacagtggtgtgatctcggctcactgcaacctctgcctcctgggttcaagcgattctcctgcttcagcctcctgagtagctgggattacaggcacctgccaccacgcctggctaattttttttgtattttcagtagagatggggtttcactatgctgaccaggctggtctcgatctcctgacctcgggtgatccgtccgcctcagcctccaaagtcctgggactacaggtgtgagccactgcgccccgcctgaaaatagtttcttgaaggatttatatatattgcaaaatggctttagttcacctcaacctaaatattattccttcagaaaaaccttccagtgatttcctctcccccagtgtaaataactttcctcattataatttcatataccacatatcagaatttatatctatgtactatatgtgtgtgattatttcactaatttctgtatctcccatcatttggggctccatgaaaatagggattatgtcagttttgtttactactggg

SEQ ID NO: 14594 - DNA, 37288 bp, Human; identical to SEQ ID NO: 14593

SEQ ID NO: 14595 - DNA, 13402 bp, Human
  misc_feature (1)...(13402): n = A,T,C or G
tcatttatttgtaaagggacatatttctcaagtgtgctagttttccttgattttaatggattaaaatgtgtcgtaggtgagccattttcttccaaatgacgaagagtttttgttcctttgaaagtctggcccaggattttgtttgtttttgtttttttaaagttcttattttacttacagagttaagaaagttgaataactatacaaccagtctctaaatagaagttctaataaatcctaagatgttgcagggcactgaaagaggacaaaatttgatccctaaagccctctccaatctcatactcggtgaaaataacaaacaaaaggcttcagtgttagtggaaaactgannnnnnnnnnnnnnnnnnnnttgaaatgccattacatgaaaaagtttcactattccaattatctgtgtttaccaacttgtggagtaagagtggctgactgaatatgttagctttttcactacactattatatacattggtcaagctttctatattttcttagaatttaagattttaaagtctttacttttttaaatcatttatttgtaaagggacatatttctcaagtgtgctagttttccttgattttaatggattaaaatgtgtcgtaggtgagccattttcttccaaatgacgaagagtttttgttcctttgaaagtctggcccaggattttgtttgtttttgtttttttaaagttcttattttacttacagagttaagaaagttgaataactatacaaccagtctctaaatagaagttctaataaatcctaagatgttgcagggcactgaaagaggacaaaatttgatccctaaagccctctccaatctcatactcggtgaaaataacaaacaaaaggcttcagtgttagtggaaaactgagttcttaaaaagcaggtaaaggtcctgtttggtccttctccagagctgaggagaaagggttttcagattataaataacagaggtgcccttgtatggcacagaattgcgataagactttacttcttaggggcttaaataatgaagtcagtaaaagaggactgaaaacgaacataaagaagagctttagctttgacgcaaagaattacatcagtgcttgacaaaaccgaggattcttaatttctaaaaacgctttctttaagcacttcctaacctttcattatctgagacaacatatcaagtgagcagcagtacaaaggatgcatgtgatttcgaaatgccacaattgagccaactgcagttgcacgcgtacgtagtatagagaggtgtgatcaaaaaaagaatatagggagcatagggcttcgtctgcatcaaaagatactctccccatcttctatagccttaagttttgcgaaggtaagtttctccccgcttgaaagcgcccccagggacaagaattcatcttgaccaagcctaaggccgtggcatgcaaggtgttgagtcaccgggtacagcggtcttgcgacataaatattatttgatgacgaaggtactcggggcccaggtgccaaggtaaaccactggcaaagatgaccgtggttaaggcagtagaaagcaggctcgacactgagacgcggttccagccctagaaggattgcattttacgattcaggcaaacttcgagtctcctcatgtgacatgtgtgcactcctggaccgttttaattatgagaaacgtggtttgcagcatgattccttccagtcgataaatcggaatctctctcgctcccaccccttcttaacttcaggcttcctgcatcccggagcactcccggcagccccttccctcccccgccccggggatgctccgactcggcgcttagccattcatcaaccggttcacaccggcggcggccgccgcggagtgacgtccggagggggcgggcctccgcccccgcctgtcggctcctggcccgcggttccaggccgcgattggtggctggagggttgcacgtcgcgccggctataaaggggagggcttgtgacgcaagggcgcctcggcgcgtgtattggctccttcggctgcgggccggctcggctacgcgctctgctccgagccgctcactgcatggtagagtctggtgcccccgccgccgcctgcatcgccgccaccgccgctccgccacgaccaccgccgcctcctgccctgcagccaccgccaccgcctgtgtcgccgccgcctcgggaccggctgtatgattaggccacaatcttcaatgagtaaacatattcctgtgagtagccgtcgcatcgtcgcctctcgggctgggaatccacgaccggccccccatccccgctgtcgcctttgttcggagcccggcgtctcctccaggttgccccgggttgcggttccggtgggtcccgggtgggagcgggcgggttatggccctgtggccggccgattgcggccggctgtgcggaggcagatgccgggcccctcggggctgcggggtggcggttggccgccggaggcaccggcttttgagtccctcccgagcccggagcgacgggggcggcgcggtccggcttctgcggcggccgggggcagtttcggcttccgcagcgggccgggtgggtggcacaaaagccgctttgtgaccgccgcctccgcccttggccctttggtctggcgcgacccgtccgggcatggcaggctccgcggcgtcccggggcctctttgttcggccggaggagagtggctgcactgggagcgggagacgtggcccggggtggggcgagggctgcgcgtgtcactgcggagccggatacggggagggcgcggcggtggcgggttcgcctccagatccgggcgggcgtggggtaggccggacagccaggcacgggtggtaacgatctggttccagagcttctcggagctccggggtgggcgcgggacagccactgggtgcagctacactcttgtgctcgacggccgggacccgagcctcagacaaaatggcctcggcgcccgcgcctgactgaaggcgcggcgcgaacccgtgattgcggcgcggagagggggcgcagcgggcgtgctcgggcgcacacagccgcgtgcgcggggcggcggccctctggggcattccgcgagctgcacccctgcccgggccagagtggggttctgctaggtgagaacttcggccgtccgccccgccctcctcccaggctccacctggtaattcgagctgttccggatttatcgccccacctcgggctcgtgataatgggaacaagtctagtcttgtcctttctctgggccagtcgtcgagaaatggcctggttcggagcgtcttggaaactgacagggctactgttagttacactgacgcgaaggacttcccgtccgggcaccagcatacatttcccctgccaattttggaagggccctggatggcgccttttaatcggggactgtttagaactatccctgagctctgtggtgtaatatgttgttgcctcctgttggtttgtggcagcagtagccaaccagagacggaattctgagggttttttatcttctgtccgcggagccccctaccagtccacgagtattaagttatttacactacgattggaactgttgacctgcccgacatctagatcctgaggcagtgcttcctgttactcagtcagttgaaaactagaaaactaaatcattcccaagagtgagcagcattttacacatgctttcttaggtgccctaagacctaaatagatgtggaacagactatacaacgaattgtttgtgacaaaggagttacacacattaattggcttgactctgcagtataataatgatttaagcttctgcacagagattactctttcctcctctcccttcttgtatatgattgtgattataatgcaactgataggtgggagggaaaaaatccccattatggatagtttttcctgtgggtaggagattgggaatggaggagtgtcttgggcggaacagaaatctatcggtggccaccactgctttaacagacgagtccccccatccactaggtggctccactcagtaaaaataaccatttcaggaagggaattcttaatatagttctttctctgcttcctgatgaaagtgcttacttacatgaagggatatggccagactaggttgtagccgacaggagttttagctattaaatatggaaatagtggtgtgaaatactgcctcaaattagcttttaattgaaaaaaaggtaatacctagaaattagaatactgtgatgagtcattataaagcttttaaagatcattgtatgtcattgggaaagtgtcagaatacactttttattctacggaggttgtatttagaatttggggtgaaagtataatgaaattattttcagattactacaatctgtattcactgtaactgtgatggctttgtaatttagacacttaattttttaacccagctgaccaactaggtgaagtaacctctgagggcttgtttgaacaaacttgtgataatgaaagttaccttttttatgggaccttttgataaatgattgttaatgctagttgtatgttttaccagaaaagtagactgggtttttgacttgatgttttctgcagtaatcatcataagaattattcttcaaaatttagcaaagttctagaaactataactagcatgggactatttaaaggtgtaaaatggaaatgggagcagatcgtttgaattttaattttaagacttcaaatgcttaaatttaagcatggaaactaatggaaccttttgttaaaacactttggtaatgagagtacacatgaagtgcttgaggcagtgactatgaattactgctcttgttaacctgttattaatactttccttagtgccctctttactcccgagtacacaagtaccttataaactatttggaagaagactgattattaacatcagtgtcttccatgtacatattttaaaaatatgctgtgactattggtttaatgtttgatattggcataaaaatggtttagttcttaagggggaacttagagaaaatataaatacattcatatttgtttatatttattggttacagtagttaccttgcttttgagacctgccacttccaccttcaacatccctttgtccgccttctctgagttggatttcagttttgagttgtatatgtgaaattttggttttaaaatacaaaagaacattattaaaattatgaatattttctttacagttataaatgagagttgtttcctttttagattcataagcatacattcttatgatatttcacataacaagttgattttcagagactcattttcctcgtcttcagtttaatgggaatgataacagattgttaaggataaagtgagattctaaatataggacttaaatcagtctaagaaaaggatataaaagcataaagttggaaaagaacttagatgtttcagtttatgagttaagtaaattatgcaagactaataacttcagagttatctggagtttgtattaatgtgtaaaaatgtttttgttagttggaaaaatcaacataaagtgtatgtaattacaatgtaaagaaaacaactatcgaaagggataattattagaatcatataattatatattatatatagatagtatatatacagagaatataactagatagaatatatatgaatatatatatgaatttcacaaaaatgtaacaatgggtttggtttttttttctgaggaatcttggtaatagatcatggatttcagtttaatctatctgactgcttgttttatgctgattgatttaatctgtactcaccccttgagttttgcaattcaagtaaaagtcgatgaagcggctcaggccctgctttagaaaaatagttgtgtacttaaatagtgtaaaaccctaatgtatttcttttgaattggaaaataacttattctctctttctgtctttttcttttaaacagcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggtaagatttgatatgttttagtagcttaaattgattgcaatataatagtgggacttatagctaacaaaataaaaactactttggaaaaaatgagatgatatacctacaattccagttcccagaaataaatgtcaatgtcttctataggttagaggtatatttgtacattttgagaagggcatgtgcttgagttaatagttattgtacctgagtttgcttgaattggtatgtggacagtaaaacagtatagctcttacttatcttgtaagaaatttacatgggaaaggttgccatttatggattttttatatatctgcttaacctaatgactaatgccataaaccagttggtttttcttgaaccccatctgatgcttagaatccaattttcaactacaaattctgttccttcctaatggtagctatgtagccaaaactctacctgcctctttttactaggagaaaggaattgaatgctgaataatatatcgggatgtgcacatgttttattttataaatacctacagttgttaagaaatagcaaataggcctctcagaacataatggaaatacttttttttcctttttttgagatggagtctcgttctgtcacccaggctggagtgcagtggcatgatctcagcccactgcaacctctgcctcccgggttcaagcaattctcctgcctcagcctcccaagtagctgagactacaggcgtacgccaccttgcccagctaatttttgtatttttagatgtagtttcaccatattggccaggctggtctcgaactcctgacctcaggtgagccaccacgcctggctgggaaatactttaatggtactttaatttttattactatatattatatatacactaatatatactatatagtgtatataatagtatattatattagtaatatgtaattagtaataatgcattttgaagcctgtagttttaaatggtatgtgggcttttttactgtagttaagacttcattcaatgtattttaaatcagtaaagtttaaggagtgagtataattgagtgaagtcagattacccgattagttataaataatgcctttagttacatttacctttgtctgcattgctgctagccccttttggttaatgtttcatcccaatccggtattaccatgactgtaaacaacttcagtgtatgaagggggcacacaatttaaacaaaagaaggaaaacttttccagtttattaaaaatatgtatggtatttaatattcacttttctttttatattctagcattgtcacttaaaacaaaatttgcttttgtgttaaacataaatggattctagcattctttaaatgatcttctgttaaccagcatacttactgatcagagatgatcagaatataaaatgttgagttatagtgatgtggttaaacattaagatttttttaatgtacgttttatccaggaacttaagaagtatggagttaccacaatagtaagagtatgtgaagcaacttatgacactactcttgtggagaaagaaggtatccatgttcttgtaagtatttaacagttcttatgggtttatggtgctgtgctacaaaagtttattcaaatagtaaattcaaataaatatctatttaagtcataaatagacctcaaaaagctaaaaacaaatattatattattgtgcagaatcttaatttctaaataaaggtgaaaagctaagcaaggatttgaagttgtgaaacatttttgtaaagattgagcatttagtcacatttggtagacaacagggtttaataagatttgattaaacattaaaatgagaatgcttttgaaaacatttccatgttagaaatttagaattattactacagtgtttatattaatgatctaaaatgtttaaatattcttctgacttaggattggccttttgatgatggtgcaccaccatccaaccagattgttgatgactggttaagtcttgtgaaaattaagtttcgtgaagaacctggttgttgtattgctgttcattgcgttgcaggccttgggaggtaaatgaatttatcaatttgattctaggtaaaaatctattgataatgaaaatacagaaacttgaaaaattcttataattttttaatataaagtcaacatttgtcataggtattacttaaataggaagggtggtagataatacttctgagttggggaatgtttggagaaataaatttacaaagatctgattttgaaaaaactatttatcaaaattcttacctcaccagagctccagtacttgttgccctagcattaattgaaggtggaatgaaatacgaagatgcagtacaattcataagacagtaagtaatggattctcttttcatttgtactctctttcatttccttgttgagtgtcagtgagtttaatagtctaatagcccatttaatcattatgattattttttgagatagtattaaaaccaggaaatcaagatcttacattcttttttgcatttcatgcagttgctcatattactaagattctaatccaacaagagtttttgaattattgttttgctttaaatacttgattgaatatgttggttattttgtatttttattgaggtataattaagatacatttaaagatacaataaaatgcacaggtctccaaaggagaccagttgacaataacagccaaattaaccatccaatacaacacatagaatattttgagtgctgtagaacatgcctttgtggcttttgtagtcatcttccctgctaccagaggcaacttctgacttcactataaattagttttgtcttttcgtggacttacgtgtaaatggatttgtgagtcgactgttgtaaccaatactcaaacgaagatataaagaaaattaactttttatgattttttccatttacactgatgtgcctgttcatattcctttctgcatcaggtcacagcctaattaatcaaaagataaattgccacaagagaggtgatggttgtctataagacactaaatattactgtagggggcttttgccttgtttcatttttttttttttttcctcccagaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaaaataaattaatttactttataaaccttatctgtacattatacgatgtgatgaaatttgctttttatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgcaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccgttgccatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgccatacatgttaatattctacattcttgcttccttaaattaatatgtttgtgtgtatatatgtgcctcacacctgaattgaaaattaaagactggtttaaaagtggtttaaaagtgacatttaatgtttctccattacgtttggggtaaccagcctaagtggaatcttggaaggaaagtaagggaaaaacttgtatttgccttcaatgaattaaaccagtgatatgtgttaacgtatgaatgaaaggattgatggtgattttataattatatatattgccgcagtaaccagttaataaattgatagctaccatttattaatgattttattttcaggtagtttttataatttgattcccttccaacagtcttgtcccaattttacagtaagggatttgagcctccagataggggactagctaataagtggtagaagtcagggattcagacctgtgtttgagctggtccactacaccacacagttatgtaaataaatatgcatgactttttttgttttttgttttgagatggagttttgctgttgcccaagctgcagtgcaatggcctgatcttggctcaccgcaacctccacctcctgg

SEQ ID NO: 14596 - DNA, 20681 bp, Human
aatatattgattcttagaaaataaactgtcaatttagaattctttgttcttgccccctgccagggcaaaggggatacaaagggaggttctgtgccccagggatgatacataattgggcccaagtggttgctgactgctgtgcatgctacatttcataagacacagcaaagagagcccctgttgcccatgcatggagtgagtggcaggccctgtgttgagcacctttagacattcagctttgcgtaatccttgcaataactatagggtagtttaataatagactggttatctccacaaagatgctgaagtttcaaaaaattatcttgcctaagttcctacaactaggaaggtgcagagctagaattggaacccaggtctgtttgcaaacctggctcttcaaccagtatgctgaactgccaggggaagagtcaactatcgattcctacttggcccttagaggcctcaagtcctttgccagtggcatggcccaagtgtttcagcatcaatacagctgagaccttccccactgcttaaccggagacagagctgggatggagacggttgctctttgctcacccccaacctcagcaccttctttccagactccaccgacatttattgaaggaatgccttccaagtgctaggcgcctgtgggatggcatgcctacagataggaacagtcacaggaagaaggggcggcccaggccttgcagccactgaggactggcactgagacaatgatggcactggtctgatgttgattccatgctgacggtacactccgctaggtctctggctgggacacaagggtcaatccgctgcagatgttgctcttcaagaatttgcagtctgggcggggtgcggtggctcacgcctgtaatcccaacactttaagaggccgaggcggctggatcacgaggtcaagagatcgagaccatgctagccaacatggtgaaaccccatctctactaaaaatacaaaaattagctgggcgtggtggcgcgcacctgtagtcccagctactcgggaggctgaggcaggagaatcgcttgaacccgggaggcggagcttgcagtgagccgagatcgcgccatcacactccagcctaggcgacagagtgagactccgtctcaaagaaaaaaaacttgcagcctgatagttaagatacagcaaccccaaatccctatgctaaaaggtgagaatggcccagataaaggtcatgtctcctagctccctgctttttcatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtgagtgactgagcctgagaagcctgtcccctcggactggctcctgccgcctcaacactgcctggcatggggtacaaaggaatttgggggatgatggaagaaacccggggtacaaaagaggaaacaagcacgggtagccaacctgttacctttaatatgtctgtacagtgataattgtaaggatccagcggtataaccgatgcagaagataatagcacttgtttttctttttttgagacagggtctcgctctgttgcccaggtaggaatgcagagaggcccattccagcctcgaccccccgggcgcagcctcccgagtagctgggactacaggtgtgcgccatgcccggttaaatttttgtattttttgtagaggtgaggtttcgccatgttgctcagactggaagatagcactgttacttgtattagtttcgtacatggagctattgtaggataggagggaccccaaagggtgcaagaaaggaaattgagtgccagggttgtcatgtgccttgggctcaggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgagtacaggacctgggctggggttagggttcttggacataagtcacttctctatgactcagttttgccacctgtaaaatggggattatatctacttcataggcttttatgaggatttaaggaactaatacatgtaaagtgcttagaataatgccaggcacatagtaagtattattaccattattattatcctgctaatcaccatagtgaagtgacaaggattttgagcccattcctggttgtgtgacctagggcaagtgatttcattcattctgtaaatatatacaaagcatctgctgtgtgaccggggatacaccagtgaacaaaacagacccaaatgccagtcctcatggagcttacattgtggcctctttatctgtggaatgggatggtaactcagccctcacaagatgctatgaggaatgagaggtctggtgttgctttctctaacggtgctgactctcattctcctgggatcctcctggagttttggtacctaggatctgacctgtgggtgggaagaggccacacccaacagcaggtacctctcctaccccctgcatttctggtctccaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctggtgagtaggtgggtcccctgcccccaggccttccatcagctttcaagatctgttcatttctcccctggttaccttctcaaggcttcctgccttcccaaacacttcccctatccagaaccgccctgcctggtctgatcaactccagttactcatcctccctatgcatccctaaaatgtcagcacctcactggtctgtgctttttgcccaatgggttcaatgcctaatcagaaaaatatctgtatacaatgtacagtagtttggggttaagagcatgcattctggggacagacccatgcctggttctgaaccccaactctcacttgggcacattatttagcatctctgtactaaagtttcttcatctgtgaagtagaataataatagcacctacctatgctattattggagttgtcatgagggttgaagaaaggaatatacatactgcacctagcacagtgtttggcacacaggaagtatatgtaaaattcaagctggtatcagccaggcgcagtggctcacacctggctaacacagtgaaaccccgtctccagcctgggcaacagagcgagactctgtctcaaaaaaaaaaaaaaaaaaaaaaattcaagctggtatcattgtagtgaatgggatagttttgtatctaagaacacgtgtgttcttcacagtagccctgtaaggcaaatgttttacagaggcaagtgtatcgattggcagatgtgagaaccaagctaggacaagtgcttgggaactgcatagcaaagagacagactgcctcaaaacaggagaatgtttttggtgcttagaaacccattcctggccgggcgtggtggctcacgcctgtaatcccaacactttgggaggtcgaggcaggcagatcatctgaggtcaggagttcaagaccagcctggccaacatggtgaaaccccatctctactaaaaatacgaaaattagtcaggcgtgatggcaggcacctgtcccagctactccggagggtgaggcaggagaattgcttgaacccgggagcaggaggctccagtgaaccaagatcagaccacagcactccagcctgggttacagagcgagactccatctcaaaacaaacaaaaagaaacctgggtcaggcacggtggctcacacctgtaatcccaacactttgggaggctgaggcaggtggatcacctgaggtcgggagtttgagaccagactggccaacctggtgaaacccgctctctgctaaaaattagctgggcgtggtggcaggtacctgtaatcccagctactcaggaggctgaggcgggagaatcatttgaacctgggaagcagaggttgcagtgagctgagatcatgccattgcactccagcctgggcgacagggcgacagggcgagactccgtctcaaaaaaaaaaaaaaaacctggccgggcgtggtggctcacacccgtaatcccagcattttgggaggccgaggcgggtggatcacgaggtcaggagatcaagaccatcctgcctaatacggtgaaaccccgtctctactaaaaatacaaaaaaaattagccgggtgtggtggtgggcgcctgtagtcccagctacttgggaggctgaggcaggagaatggcgtgaacccgggaggcgaagcttgcagtgagccgagatcgtgccactgcactccagcctgggcgacagagtgagactctgtctcaacaaaaaaaaaaagaaacctgttcttgagtctcagctcctggcttagttagtcataaggcctcaagaaagtcattcacctcttccggcttctcttagcttgtttgtagaatgggaataacagtttctatctagaagggctttgggagtgaataaagcaatcatgaggcagtgtagtgtaatgggttaagagcacggcgttagccaggtggggtagctcatgctggtaatttcagcacttttgggagcccaaggtgggaggatggcttgagcccaggagtttgagaccagcctgggcaacatagtgagacctcatctctacaaaaaataaacaaaattagccaggcatggtgacacaagcctgtagtctcagctactcaggaggctgaggtgggaggatcgcttgagccttaggaggtcaaggctgtagtgaactgagattgtgccactgcattccagcctgggtgacagagcaagaccctgtgtcaaaaaaagaaaaagcacaggtcttggtgtcccagacctaggtgcaagatcttatctcccccatgtcctttcttaagtaagttaacctcttctaagccctcattttctccacatgtaaaatgggaaaacagcagtactgtcagtggggttcttgggaaaagtaagcatgataatatatctgaagcatgttgcctagcacttgatcatagaagctgttgctatattgtggttatttttttagatcatgagtgtgaacactctttcggaaaggttaaggaactcagttggggagctcctcaagggaagcaagtcctcagtccctggactagacttgggctccggggccaattcatagcaggtgctcagaaaacatgtgtagagggacaggacccaggcctaaccctttcccttgcacataaaagtgtccactatcccatagagggtggggaggtaggaggggaacttaggaaaagcactcttgtgaggtagagagctcacttactagcctaaggacaggaagaacttgaagatgcctgatgcttgccctcctcctcactccccgcagggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtgaggccccagggggtaggagctgccctctctactgacactaagaggagagcaggaaatgagccaagcctgggagctgggtggaggcttggcttccggaggcagagcaggaaggagaaaggatataagtagatgttttatgagagaaaaaagcagagtgcagaaagagtagaaaggatatagccctttgaatgaatttctagaaagaccatttgttcagatgcaacacatatatgctgctatatatatgcagcaatttccagaaggaaattgcaggaaactaaataatagtttccttgggggagacaaatgggaagatatttcttcttttcggttttttgtttgtttgtttgttttggtagaaataggctcttaacaatgttgcctaggctggtcttaaactcttgccctcaagcagtgttcctgctttgccctcccaaagtgctggaattacagggatgagccactgctcccggccacattttgttcctttcgtaaaatgacatgtactgacaaaactttttgcttgatgtcaatagggttaactggcaataagatgactggaaattaggcatttgtctttttttttttttttttgaggtggagtcttgctttgttgccaggctggagtgcagtggtgcaatctcggctcactgcaacctccgcctcccggcttcaagctattctcctgcctcagcctccagattagctgggattacaggcatgcgccaccacacccagctaatttttgtatttttagtagagatggggtttcaccatgttgggccaggatggtctcaatctgacctcgagatccacctgcctcagcctcccaaagtgctgggattacaggcgtgagccactgcacccagcctttttttttctttatacttctctgtagtttaaaaaatgaatttttgcttaaagatttttttttgatgggctttggactacagcctaacattaaatcttggttctgcctattctcagccatgtgactttggccaggtcacttcacctttcaaagcctcagttttcttgtctgtaaagtgggtgtggtaataccttcttcccaggttatgataacctggcccacataggtgttcagctagtagcacctcttattacagcaatttcagtgtattcataggccgcgcatggtggctcacgcctgtaatcccagcactttgggaggccaaggtggacagatcacttgaggtcaggagttcgagaccaggctggccaacatggtgaaaccccatctctactaaaaacacaaaaattagccacacgtggtggcacatgcctgtaatcccagctacttgggaggctgaggtaggagaattgcttgaacctgggagagccaggattgcaccagtgcactccagcctaggcaacagagcgagactccatctcaaaaacaaacaaaaaaaaagtgtattcatagatagtatctgttgattgagaatatagaacaacagtaaccccagagtgaaggagaaagcagccggctttggggctataagcaagatgctggccacatgctgcccttcttccacaagggctcattctgtgtctgtcaaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggtgaggaaagtgggctgcaggggctggcagtgggctgggatggtagaaacttctctctctcttagtcacctctccctcagaccctacttctgttgatgggtcacagaaggggtcagataacttagtctcatcacttctgatttaggaaactttttccggagcctgtggggaccttatgctggctgggcccaagcggtgagtgtacctaggtgtcctccctaggtttcctctcctccagcccagacccagtggactcttccaccaccgccccaggtggccctaaaggactctccagccacccctgtcccaaccccagtggattctcattgccttcggccctgttccccaaggactcttccacctcccaacactgtcactagtctcaccagccctgaccccagtgtaccctcctccccacacagactccaccctcctacaggtgctgttcagtgccgacctgcgccaatcccgccatgctcaggagccaccagcaaagcgcagaaagggttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattgagggagacagcgctaaggatggttttatcttccctttattacaagaaggaacaataaaatagaaacatttgtatggaaaatgcagtgaggagtggtagggaagcaggtgaggaggggacagggcagagaaactcccggttcagggagggaaggggagcaggctgcccccaagccctcccacgcagaggatcatgacccgaggtccagggccctagagctggtggggcagtgtgggggacagttctgtgcccggctccacgcagcagtctcgacagcaacagccagctgccggccctgcatgggaagacagaacagaggtggccgcaggggcaggccctccactccagcccgggtgcacctttgtggaccacccatgcccttctgcagagcccgctcctcacccccagccactggtgtcagcagctccccatggctcgccgtctgcccctgcccctcctggctggtgcccagctgcagtttcctcatgtgccgcaccacagccgtggcattgaaggcttgctggcattgaaggcattgaagggagaggggagaaaggacttttgagagagtcaagtcatggggcaggggcgcagtgggattcttgcaattgttctgttattttcattcaggagttattttattaattcccctaaagccccccaaaaacctctacaaggctttattatatatttacacacacacacgcacatatgttagatgtatgtgtatctatatatataaatagaaacataactataattcatattaatatgtaatagcaaacactatagcactgtatgtcaggcactgttctaagcactttacgtagtaattcatttaatcttcatgaaagtctttgaggtaggtactattatcattttcaaaggaggaaactgaggcacagaaagctgaagtaacttgctcaggtgtgtctctattcaatatctccacctaggtgtcccacacacccctcaaattcaccatgtctaaaactaaaaccatccccccaaaacatgtttctgtccctgtgataaccatctcagtcatggtaccaccaccatccattctgttcccagccacagtcttgggccagcccttgacatctctttcccccaacatccattgcatcgtcatgtcttgtcagtttcacctcctaaatgactcctggatcaaccactgttctctgccccctgttgctgctactgtggttccaaacccttaccatctcctgcctgtatctctgccacagcctcctaatgcgtcacccagtctttactccatgccattctctgcatcctgagagctctttcttttttttttgaggtggagtctcactttgttgcccaggctggagtgcagtggcgcgatctcagctcactgcaacccccatctccgaggttcaagtaattctcctgcctcagcttcccaagtagctgggattacaggcacgcaccaccatgtgtggctaattcttttatttttagtagagacagggttttgccatgttggccaggatggtcttgaactcctgacctcaggtgatccaaccacctcggcctcccaaagtgctgggattacaggcgtgagccaccatgcctggccctgagagccctttctatgcagcaaatacttgcctaagattcttctggggctcctcagtgccctcaggatcaagttggtgctcctctgtggcatatgaggccctaagaggcctggccccttacctgcttctctaaattgggctcctgcctctcagtcccctcagcccctccagtctggccaggcttagcacttgcacttcccggaatggctatagacattattccgctatgcctcactaattcctacttaactgacagctctgtcaggtcatcaccacttttatgacctttctcggaccccataggctggatcagatgcctcctgaagaattacagacttcttcctctagacttggaggtgagggaccctctctggaatagagaaggtgttgggagtgtttgttgaatgaaagagtgaatgaatgaagtccttcagtaaggatccctaagcagttactgtgtgcccagtgtgatgccaggtgctgtgcaagctgagcctgggtagggatggggaggagtcctggggaggctgggaccagaactagggatatggactcaccttccacttgctcttggcaaagttcttcttgatctgctcactcaccgactggtggatattcttatctagagctgtatctcctgcaatcctaggatggggttatgtggtgggttgcctatgagggcagaagcagacctgagggccccaaatcccgccccagctcacaggttgtgtgaattctcaccatgggtgctgcaaggcctgctcacaggtgaatcttttctctgggtccttctccatcaagtgccggatgaaatctttggctaaacccccaagacaaaagcaaagataatgacagcatggtactgcctgtgtactccccaagagcatacccactccctcaggtctggcctggcatcaagacaaagaggccaaatcagtccatgccccaccccacccaacctatgctcttcttcaggccctcccaccccgtgccttccagctctttcctttctctcttaagaaaaacatatggccgggcacagtggctcatgtctgtaatcccagcactttgggaggccaatgcaggtggatcacgaggtcaggagttcaagaccagcctggccaagatggtgaaaccttgtttctactaaaaatacaaaaaaaattagccgggcatggtggtgggcgcctgtaatcccagctacttgggaggctgaggcagagaattgctcgaacccgggagacagaggttgcagtgagccgagattgtgccactgcactccagcctgggcaacagagcgagactgcgtctcaaaaaagaaagaaaaaaaaaaaaaagttgttcttgactaatctcagtgcattcacactgatgataaacgatagtagcttcacaggtttgcttcttaatagggggcacaaaaggaggatgaaaatgtttatggtggtgttttagacattagggtgtcaataggggagaggtattttcaaatagactatgtttgaagattgaacaaatgaatgcctagtttctcactctgggagccaagcagaaggaagtacccaagcagaaggaagaaggggtagggtgtctggtctcgaagacagctctttgtgtggtgctggaaaatccgacagaaggaaggcaggagggagaccgcccccaaagcaggtgagggaggaaccagaggcagggcccaggggaaaaaagcaaagccccaaataccagagtcagagatgtcgtcccagtaaggagagtcaaactcgtactcggccttcaaaatctgttcaaagagtttggcatcattctcgtcatagaagggagggtaaccgcagagcctgggcagggagaaactcatcctcatttccactttcgggtgccgttggctccggggtggagcactggggcagtctcaggggtcaggcaggagccatggaaggagttccccctttataaactctaccagccctgcctgctcactcctgttctagctacattatcctttctgttccttgtatgtgccgccatcttgccctcctcagggcctttgcacttgccattgcttctgcctatgccactctttccccacacctccaatgtctggctccctcaccactcggtcatcacctccacagcgagcccttccctgacctccctactgaaatggcatcaccccgtctccctattcctgcttggtttttctccacagtatttatttttatcacctgacgtcagtttgtagatttatttacttgttgattgtctgtcttccctactagaaagaaagtcagctccctgagggcaggcactttgtctggtttgtgctgtgctaaatttaccccagtgcttgcttggcacagtgcttgaaacatagtatctattgaatgaagtaatactggtaattgattggtggaaggaagggagggagggaaggaagggagggcagagggagagcagaggaaggaagagaggaaagtaggcgagaggacaactctggagccacagcctaccatggccaagccccacttacaagatgtaggcgatgacacctatggaccagcaatccacagccttgctgtagggcttctgggccaggacttcaggggctgtggagggaagaggacgtggtggtgacaaatctctgcccttcaactcctggttccccccaccatcacagccccagcccagggccctccgcacccacgtatcccggagttccacaggcggtggagagcacactgcccgggtcctccatcttggagaggccaaagtcggagatcatgattttggagtcttcatccaggctgtagtacagcagattctctggcttgaagggcaggagggaagagaaggggcaatcagagatggttagaggctggtagaaccttctgccgctccaagcaccttctgagaaataatggatccccaaaagccactgtggcttcatggctgtcataagaaaatcaaggaagctctcaagaaggccaaaaattccaggaaggacaaggctcaagagggtgtgggggggaactgtctctaaacctcaggtgtgcactgtaaagccctaaaggaatgtttgaatgcctattttatgccagaccctggattagtgcttgatttaatgccatcctcactgcttccctgctaggccagtctgtataatctcacctaacagatgaggaaactgatgcctttggaggcaaagtgactcacccaagaacccacagttaggcagtagcagagccagaattcaaaaccaggcatgtcacaccccaagtgcccttctcctagaacggattgagatgtactgctaaatgtgagccccgtcgctatttccgaggagtaggatttcggggatttctggcttttttctttatgttttgctgtcccatccaagttttctacagaaggggaataggattttttgtttttattttattttttttgacatggagtctcgctctgtcgtccaggctcgctctgtcgcccaggctggcgtgcaatggcacaatctcagcttgctgcaacctctgcctcccgggtccaagtgattcgcctgcctcagcctccctagtagctgggattacaggcatctgccaccacgccgggctaatttttgtatttttggtagagacagggttttgccaagctggtctcgaactgacctcaggtgatccacccgtctctgcctcctaaagtgctgggattacaggcgtgagccatcctgtctggccagatttttttttttttaatcagaaaaagacaaaatgttgtttggataaaatgccacacaattcactcgtgttcctttgagtatctggactagaatgggaggaggcagtttaaaggttacaagatccactttgtagatggaaatccaaggctcagtgagggggtgaaagttgcccaaggtcagacagtttggggtttgcaaaggccccacccctgggtaccctagctcaccacacccccttgagccccaccttgagatcccggtgtacaatgcccaggtcatgcaggtatttcacagcatccagcacctggaagatgaggcggctggcgtcccgctccgtgtagaagcctttttccacaatacggtcaaagagctccccacccgacaccctgcagcaggggatagggcagtctggcaaagagggttgggacagctgggagaggtgtgggggcagggcagaggttgggccactcacagctgcatgatgaggtagaggtggcccccactctcatagatgtcatccagggctacaatgttggggtgcttgatcctgaaaggagaaatgaggtggtttagccaggcatggcggtgtgcacctgtagtccaagctacttgggaacttgggaggctgaggcaggaggatcacttggccccagcagttcaaagctgcagtctgttatgattgcacctgtgactagccactgcactccagcctgggcaacagagtaagaccctgtctcaaaaaaaaaaaaaaaaaaacagcggtttagagctcaggacagctcagccacccccaacccccgaccactgcctacatacctgggtaggacaaaccaaggatctcgtccccaaagggaaaagctagcttaccatggtttattaccattttttggaaggtgagagagcagagggataaacactgggctctggcatacacagacctgggtccaaatcctgcccgtcacatgctatttgggtgcagatcttttcaccagtgagccactgcacccagcctgatacatacctcttaagagttttctggctaggcacagagactcacacctgtaatcccagcactttgggaggccaaggcaggcggatcacttgaggtcaggagttcgagaccagcctggccaacatggcgaaaacccatctctactaaaaatacaaaaattagccaggcatggtggcacatgcctgtaatcccagctatctgtgaggctgaggcaggagaattgcttaaacctgggaaacggaggttgcagtgagtcgagatcatgccattacactccagcctgggcaacaagagcaaaactccatctcaaaaaaaatatatatatatagttttctgtgtttacatgtttgtcagcctcccccaccagacataagctccccgaatccagaggctttgtcttgcttgccactgttcctccagcacctggtacagggtaggtgctagatttaatgtaacctctctgaacctcagtttcttcatctataaaatgaagccaatggtagtacttccctcaaagagttggagtgaggatcatgtgagataatgcaggtaaggtgcttggcacagtgcctggcacacggtaaatactcataagtgaaacaataatggtaattgattttttttttctttttttgagacggagttttactcttgttgctcaggctggagtgttgcccaggctggagtgcaatggcatgatcttggctcatcacaatttctgcctcctgggttcaagtgattcttctttctcagcctctcaagtagctgggattacaggcatgcgccaccatgtccagctaattttgtatttttagtagagacggagtttctccatgttggtcaggctggtttggaactccccacctcaggtgatctgcccacttcagcctctcaaagtgctgggattacaggcgtgagccactgcgcctggcgtttttgttttttttttgttttttttttttttttgagatggagttttgctcttgttgcctaggctggagtgtaatgcacggtgtgatctcggctcaccgcaacctccacctctcgggtttaagcaattctcctgcctcagcctcccaagtagctgggattacaggcatgtgccaccacgcctggctaattttgtatttttagtagagacagggtttctccgtgttggtcaggcgataattgatcttgatgatgaggaaggctcagctctgccacaaacttgccatgtgactgtatacaaatccctgtcctctctgggtcttattagaaatgctctgccaggagttgggtgtggtggctcatgcctagcactttgggaggccgaggcgggtggatcacctgaggtcaggagttcgagaccagcctggccaacatggcgaaaccccatctctactaaaaatacaaaaattagccgggcgtggtggcaggtgcctgtaatcccagctactagggaggctgaagcaagagaattgcttgaacccaagaggcagaggttgcagtgagccaagattgcgtcactgcactccagccggggcaacagagtgagactccatctcaaaaaaaaaaaaaaaattatctgcccagggtggttggaagctcaggggagagattggaagtgattctctgtaagttttccagtgaggacaggaggtttcatatcagcatgagcaattcatagaccagttggttgtggatttagtctgggggtcagcagacagtcatttttaaacttgctgagtggttttaatatgtgaggggaacttgaggtaggtccagagacaacaccaactgagatatgtgggtccaagccatgttcaggatggatctttacacctgattgaacagttaaacccctgtgactaagcactggcacctccatcacatctgtcatgttaggccaggcacttgaaataaaggacttctgatgttccccacaaccctgccaagtggaaattgtgatccccattttataaaggggcaatttaaggcttagagagtttaaatgatttgtccaaagcaggaaaggaggaggatgggagggccaaggcagggtcagcttggggcagggaaaggctgtggcccacgcacttgtgcaggacagcaatctcattctccatgctgccttccttgccctccagggcctccttggcaatgcatttgatggccaccagcttctgcgtcctcttatcttctgccaggatcacctccgagaaggcccccctatcgggagaggggattcacaaggtgaagaactggaaccccagcttccctccagcctctcctccattccctatgggttctgtgaccactgctggaccaaggacgtggatgaccctcccctagtcactcatccatcccctggctccagagatggtcacatgacccaggcctggccagtcaaagtagtctctcccctggccacagtaattggtcatgtgatgcaagccagcttactagcactttgagaatgagtctcctgttgagctggtaggatgtaagcctggagctaatggcgatcatctttgccaccacctggggagagcctgcttgggaatgaaattaacacaaaggaagtccaacctgagaaatggccaaatatatttcctgataacattatgtggccctctggatccagccatgcctgaggtctacccctgggcttttggattatgtgtacagttggttcatccctttttctgctaattcgagtcatggctaatttaacaccctttagaaccttaaagaaccatcagcatcacccgggaacttttttagaaatgcaaaatctctactgctttggatcctgggtcaaaaaaaagaaaaaaaaaagaaatgcaaaactttaggccctgccccagatttactaaatcaatctgcagtttaacaaaatcctcaggtgatttgtatgctcattgaactttaagaagcagtgttttagaacaggttcttaaaaaggaacaaataaactcatttaactaaagttaactgattaaagaggatttgctagggtattctttccacatctgtttgctttctctgggagaataagaagtcataagtcaaagaaaagcatctctcgtggtgaaatttcaatcctcagggataattagttactgtagtaacctcatcactggtttccagtcttgtccctctccaatttaccctccaagctgtggccagagtgactatcctgaattgcacacctgccaaaaagtcttaagtgtctcccggtggcctatgggacaatatccagcctccctggcctggcttccaaaaccctacacaaactgtcccactttcatctccagcccctttttccactctccccccagcctgtgattttaagctccatcacactctacctctctccacatagaaccatgcctctaagcctttgtttatgctattccttctgcctggaatgtccttcttcctctctgacaagtgcacacctacccatccttcagtccccagctctaatgccccattctccaggaagttttcccccaggcagaaggcacagctctctctgggctccacaaagccctcaatcccaaccttaattggagcacagcacacaccctgttgtcattttctgtaggtctgtctcttgcacatgtctgggatcaacttgaagggcagagaccaggtttgagttatttctgcattcccagcaccaagaacagagccatctccagcctcagttcccaaacctaggctagaacacttagctcttggcagcaagttaaatggactgactggcaccttcattctctcgacttctttctcttcaagaacccagggctattgggagagcagcccgtgtcccacccactgtcatccagaagtgaaaagctggggacagtttaggccctagatagtgctgccacagggcctgggctgtgggaaacaggaagcattaattgaccagaggaagccccaccctggactcagcctccctcagccatccagcacccaatcctgccctggactcacgtgcccagaacatctcggaagtcgtagatgtctctaatgtcctccgcctgcttccacctggggccttccactgcccccagcatggcccactgccccccgaccacagccagggctcctgtaaggagaatggaaggaggagactcagcagagcccagccctctgtctgggaatttactgcaggccccattcagtcattcaacctgcatttattcatccttgattcatccatttgacaaaatcattcaacaaacattcatttgtttattcaacattcagcaaattctcatgcctagagaaaaacctttcacagtggcagcaaaattctttatttaacaaagtcatgcattcattcattcatttattctagttctcttcccagttttccccctatccaaatccaagcacctagggaaaccctgacttctggcagtacaacagataaacccccagagcagctggtagaagcctggaggatccccctgtccccagaaccagtgatgtccccgccccaccctggggattgctggggtgtctcctttccctcctccttcccccgactccccggcctctccgaaatcaggtttccagcagcctgggcttccagcaacatctcagccacatttttaaatagctctttctgcactgttaccacagcaacaacagccacagctggagctccccagacctctccctcctgactccccatctgggtcccgggagcatgagaaatggtcctgctcactctgtcccttcctggccccatctaaccctatccagcctggcccttcctctgctgaggtctgtctcatccagcaggagagggtgggagttctctcccatttatcagatgaagaatggggagactgaggttggagttaggtagaggctggctccagaggccctaatgacacctggcctggggcccccagctaagcttgctgagggcaaaggccatcgaatggccttggctggtacttccaatatgaagccag

SEQ ID NO: 14597 - DNA, 20681 bp, Human; identical to SEQ ID NO: 14596

SEQ ID NO: 14598 - DNA, 20681 bp, Human; identical to SEQ ID NO: 14596

SEQ ID NO: 14599 - DNA, 20681 bp, Human; identical to SEQ ID NO: 14596

SEQ ID NO: 14600 - DNA, 20681 bp, Human; identical to SEQ ID NO: 14596

SEQ ID NO: 14601 - DNA, 20681 bp, Human; identical to SEQ ID NO: 14596

SEQ ID NO: 14602 - DNA, 7015 bp, Human
ccaggttgatctcaaactcctgacctcaaattatctgctcacgtcggcctcccaaagtgctgggattacaggcatgagccaccgtgcctggccagagatatattgtttagacgcatcattggtctcactgccaccactccctttacaggtggcagcaggttgaggttacattgtaatttatcatcgttaacatatgtgtggatatatgaagggcactatggggattttacataaatatggagcagcgtggttcatgcctttaaggacattaaaataaaattcaatcggaagcagtcaccatatgcaatgcttaatcatgtaatacggtggccatttgctgatggttcgacaccatatttccaaagtattagtgctttcacatgactcaatcagcttctgcgaagttatgcaaaaattgttgaacgtggagccttttatgttttcctatttctgctaccaaattcatttaatagaaataactctttgagtaagtgcacttgcctactgtggaaaacactttatttggtggcaatgttgaaacagccaatatgaattataggcatttattgcaatagaatcaagaaacctatttcccccttcaaaatcaatagaaaaattgctacttccactaggtattctttgtctttgtaaagacaaatgacagtgcattcaatttcagggtagttgaaacatttctcaactggcaaagttgtttggtcttctattttacctgtgcagataaaaggatccttttgcatctcaaaggctagaggcaatatttttcacaaataaatagcatactaaagtgattgttaattttttaaaaattagccttttgaaaagagatagagagcactgaatttctgacagtaaacattaatgtttctttatcaaaatcttaaagtcatgtgtgcaaagctgatagatgttttaaaattcaggttatatagagataatattttccattcatgaagttattagtaatactttataaaaaacacaaatttcagcctatgcagacttttcttcttggaatttgaaatgcttttattatttttgaatctagaatcagtagtcttaaaagttttatacttgaaaattttctgttggataattattaaatattttgctgtcacaataaaattgtaccctgtatagatgttgtcatgattccttattagcgctactgaaaatttatatgtataatttctcttatttaataaaagcacatttattgtttgtttatgagtatgtgcaaaaattaggcaaacaacggaatcccattgatctgctgatattaaaatgcatttaaatgggaatgtgtatgagtacataaacgtgattagtcagttctgggagctatcagaaactcactgaagctcaaataagtagtaacctttcatatcttaattcctccctaaattgtttgcatcctaagaaaatgtcaaaacaatagcaagtacacagatttagtatttcaccagtgtcttccagagagctagaaacaggatttatgaagaatccacgttatgattttcattattcaatagctaatgttacatggataaatacattattactgttatattattgcttactactgactggatttcttcatcatactcctgagcatcatgaactgaaaaaactatagaaatgatagcaatatcatctgattaacaatgggcagatcagtcctggtgcacaatgctttatacatgaggccaaaaatgactttggattaagaatattctagtaaaacttctgcatctaaaaggagcaggaagaatgcatacattttaataatcttcaaaagaccagtttagctaatatcaatatatatttagaggttgttgtaatttctattttttctgtatccgttcaactgtcctgtgcaaggcaaaaatgaaccaagtatgtggtcaagagtagtgggcattcacattcagacaatttgtgtattcttataaatgtgtttaattacaactgcttcaaaagaatcccagcttttcaaaagtttattttaagtttggagactagacaaggtcatactggttttacatcctacgtgatataagtatatatacaaagaaaaaaacaacattggaatattacacagcttgaaggtttgcaaaggttatttgtgtcttagttatttctgcacttaatgacacatcagacgcattgagtatatttcataagttgttgactagcaaagatacaatcattagtaacccaagtcttcaaaattcacaccaaactttatgaagtcattcagaaagagaaagtcaatcctaaaattaaaattggcaactatgataaataccttcaaaaggatgtagatataatggagatgtttaaaagtttagtttcattaattgtaaaattagcatgttatatttactcaatatagtgaagactaggtgattcttacatgtattctacttatggtactgtactggttttagtgtgaatttacatagaataaatttacttcactttcatgtcatcgacatgaatgacacaaaagctacttcataatactactttacaatagttttcaacatttccatatggtgcgacccctttgctctcatcaattttgggtgtcatgagaacaataggtatcccgttggacatgatgtattgcgaagagcatataaagcagagggaaaatgaaaaagcaagagaaactcatttcaatgctttttctaaaaggtaacaaatataattttaatcaacttccttggaaaatatttttaaaacaggtatcaatagaaaaaattacaaaacatcatatgaagctataaataattttgaaaaactatatcatcataaagcataagtaataatcttaaaaatacactcttaagaaggtatgtaatttgcaaaggaaaatggctagatatctgatgggacagtaaaccttgaaagaaactggctaaagagtaagtgtgtgtatatttctgaacctaagtaattatttgtcacgactttaaaatttagccagttacaaatattttaaaatcctaactttaaagttatctaaaaaaggcaatatggaggaaatagtaattttgtttttgaaagatgttgaaaactgatcaccatttcagaggcttcaaattcataatttcataataagaacaagaagtagaaagcatatgggcaaggaacaaatatgtggccagccagtccccttagacgaactaattttgttcttattaaaaatgccaatacaattgactttctctttaaattcttcactatgattgaagaccactccatatatacatcattaagaaatgctgttaacacatggacagacaagacagtaacagtctagtggcttttgttatgcagcacaaatattaaaggaaaaaaatagcagtgttgcgtaggatcttaacatttcatacacataccatcctttcttttccaatacacttaatttaaaactccaataattctgtctaagccttataaaataaatacttgtaaagcttataaattagatgttgaagacttttatggaggcagtgtgagctttaatttgagagacatgtcaatgaaacctccagtatcaataacaaattgttatgataattgcttattttttcaggacctttgaagcaaaataaatagaaatcagttttcatcttgaaaatggtttactactttgtcattagtaaacactttgcttctcacaaataactccacctgtgccttcctgggaaactaccaccagtttcaaatctcaataagatgttagtttcacaggaaatgtggagctgaacaaagaaatgatgagtatgcttggccgaactatgcagcactatattaatatttctttgctaaattttttataaaataaacaaataagccgattttttaaagtaaatataaggatatgtaattaccatctaaatgaagatttaaatttaaagagacatatatattttttgttcttttgtgcaaactgagagtatgggattctttatgaagcaattatttggaaattaaatagttatggcttccttcaaaaataaaactgcagatttaattaacgaatattaaatacagatcaatctactgataggcagtcatgttctacatatatgagtaaacatgacacttcttttagtcaactaataggaaattcaattagaaaaaaattgaattattcaggtaatatacaatattaagaatgtagaatagaactaaaagaaaaagaagtcacataatctcttattagaaataatgaaagtaaaatgagaattataatatcagtactgcatgttacatattcttctttaaaattttgtaataaacattgacagtgtttggtaggcacagggaaacaggataacgtagagtcattacagaagaaaaaaacttattgctaacattgcagtattccttttatcagaattaggtgagtattgattgtaaaagctctatcaactcttgctcttatttgatgactttgagacttttttactcttgctataaaaagaaggctactttctttccctaatatatttctaccaatgcgaataattcaggaaacaatgagagaaaagtaattcacacttaatgtgttgttacttaagagatttgacggataaaataaaatcaaattaaatcattgaaaaggcaggcttagacccccttaaaaacaccgttagttgcctaccataatttgagcactttttcatgaaaaaaaaaaaaaaaccattcagtttcctacagattttgcacagttcattccatggagatacttttagggaaatagggaagagggttgtgaaatgtagcctcccctcattcctcctctgtgcagcccagcagctctgaccgcaatgtgatcctcccgtaccaggaccaaggaaggattcttatgtgtcgtgcatagatgggagggtcgatgacattttttctgtgagtgtcattgtcaaaatttccctggaaaacctaataaagaagagcagaaaaatgtcagtcacacagccttctttctttgaaattatttttatgttcctgtttggaacattttccccaaacatgatatttgataactattcattttcttttcttcaaaatatattgcagcttctttttaataataattattttaaattaaatggtcaattaatgtttaaagagttaaacctttattgtttaatgcagacattcataggtctatcattttcctctacttgtttctctcaattaaaaaaaatacaacaggtattcattttttgcttatgtcacaggctgacgttagtcatgtagcttgctgaagatgctctcttccacggggtgactcagagatccaagctgcttgcaaagtacagctatcatctggagcaggtggcctccacattcacaaggggcaaggggagggagagttagcagactgtgcagagtgtttaagagaacaagcatggaagcagcttatatcacttctgtatatatctgtttcaccttacctaattatatgactccagcctaacagcaaaggaggctgggcactggagagaagcacaaggctatctggtgagcactaacggcctctatcacagtgccttttgcccacttcttctcacatagagaataaaactagcccatctccaaatgagacaacacaatcaatgctgtttttgaactgtttttctcttcttttttggcttcatctattaattcctggatccatacaatactattgggatgaatatgacttataatatcctgaccctttgcattgcacgtctattcttctttcttcttttgtaaaaatgctttttttttttttttttggagctttactattactatggccacttgctcttccccaaaagactttcataataacttggacaaatgtctgcttcagaaaacaaaacaaatttaaaacactgggtccctgataggaatggcattaaattataaattatgttggggtaaactgaggtatttatattatttagtctttatctgaagattttatcctttttttcttatagattctgaacatttcttattaaagtgatttctaactattttatatctacatttttaaaaatttagatttagtttagatttttagatttagtttaaatttttagagtaaaaatctcttcaacgctttctgtttttgctttatgaagcatcttataattagaagataattttctttcttgtttgacatcaaatttctttcttgtttggcatcaaaacataactatgtggccagagacacctgaagataaaatccttaaagtagaaaacaaaaaacaaccaaactccatcatcacatgacagtaatacttaacccacatctttcagcattctgaaattaaagggaatgttttaaaagccttctaggctagattggttcagtcttatacggccacaaatgttctcctggaaagaaaaaaatcatattctcctcaaaagcattaggcagtacggcactgattaataggagcaatagacaagactgaaaagtctctctgctggttctgctggcatatctaaattcatattcatttagcaggcattttatgcttagtaatgccctgtcttgcacaaaggaataattcattctggactgaaatgtgctactactatgttacaatgtctctgttagcaaaactcacaggtacaggacatatcataaacactcaccaaaaatcttgagagactgttgctactgcaacagcagaaaataagccctggtttactgacatcctctctgacatatgatgttggattcaaatatttcactgagattgtggtattacaatttaatacggaatctaaaatccaattttgtagccctgctagtgaacttaatgtatatctctgggataatagagtttaaattcattaactttcattgcaagatttataacagcccgaaatatagttttataccacttcttgggaaggaaatacagaaagaaacaattttctcttaagtgtctgctctccagcacaggttttgatgcga

SEQ ID NO: 14603 - DNA, 76269 bp, Human
acccttattctacctggatttatggtgattgtgataaaaggaagacggatttccttttgtgcaaagtattgatggatgctcttttactttgttcctggaaagttaaaaaaagaaaaaggtgcaggctatgaacagttacatacttcaatgctgctgtcagggatttaaaataaataaataaataaataaataaataaataaataaataaatccccaacctaggcgtgtttcattatagaaatcatttttaaaactcactccagtgtcatgtctgtcctcctccccacctcccactctaggttccagtcaaatggaaatatgtggcttttctcactccattctgtctctcttttccatttgcttacccccttcgcttcctctttcattctatttccttctgctttcatgaactttctctttcacacatattcactgatgcattcccactcacctgttctctcttactctgtcaccccccagtacttactgaatgccagccatgggctaaagaccatagtaagtggacgctgggcaggaagagaaaggccattgtggctggaggatagtgatgtggtaccacgaaacgtcagagagggcagtggggcccagatcaccagggcactgagggcctggtacccagtgggaagtgaccagaaggtggggcacaaaatagaatcagatatcctgctgctctgagaagaatgaaggggttgtgggcaaaagtgaaagctggaagatcccttagacagtctctatagtcaccttagggttaattttggaggtggggcagacaggacttgtctatggatttgatgtgggaaatgagaccaaaaaaggaatcagagacccaagtttcaggcttgagcaactctgttctccctagttcattgccatccttttttttcctttctccttccctcctcttccttgttcacgctatagcagaatgtgacatactccttaccagccccaagttcattcctcttcaagtgtcagtttagaagtcacagactccaggaaactttcctgaagtccccacactggggcaaagccacacacgtactgtcatctccctcccggcatcagtgtgcacattattactttattcacaggagttccaagcaggagtttctacagcccaaatgcagcaagtctgtgtctaagctcagttagctaagtgaaatttggaaagttacttaaggaagtctcagtccccacatctgtaaagtgcagataagaaaatggtctacctcacacaaagttttgcatgagatgatatacataaaatgcttagcacaaaactggcagagagcaaatgctagataaatgatagtcgttattattatcgctgttgttactggtttacattatccaccttcatctaagcagggtttctgcagaatagcagaaaccaaactaatgtagcaaataagctacataattcaagcccaggaaaaagttaacatttcagtggcatgcattcaagacgaatagtttgatttattagccaattcagataaatgtgcacgtggaagtcatagttaaatattatcgtcagtttccacgtcctgcgtttaatttggggtttgattttccaaatacaacacttaccagattaggtggacccacaggattatttttccttgaggtctcacctgagcaggtgcatgtacagcagacggagcagaaagagactgattagagaggttggagtggtagagggcgtgaccctcttaatcattcttcacttccttttttaaaagacgacttggcatcgtccaccacatccgcggcaacgcctccttggtgtcgtccgcttccaataacccagcttgcgtcctgcacacttgtggcttccgtgcacacattaacaactcatggttctagctcccagtcgccaagcgttgccaaggcgttgagagatcatctgggaagtcttttacccagaattgctttgattcaggccagctggtttttcctgcggtgattcggaaattcgcgaattcctctggtcctcatccaggtgcgcgggaagcaggtgcccaggagagaggggataatgaagattccatgctgatgatcccaaagattgaacctgcagaccaagcgcaaagtagaaactgaaagtacactgctggcggatcctacggaagttatggaaaaggcaaagcgcagagccacgccgtagtgtgtgccgccccccttgggatggatgaaactgcagtcgcggcgtgggtaagaggaaccagctgcagagatcaccctgcccaacacagactcggcaactccgcggaagaccagggtcctgggagtgactatgggcggtgagagcttgctcctgctccagttgcggtcatcatgactacgcccgcctcccgcagaccatgttccatggtaagcgctcttctcccttgcgcacaagttcgcgcgcccgacgcgccggggcaatcccagacgcgctgggggcccctgctcctaggcaagtccgggaatagcccggccttgcactttggacctgcggagagcactggctctcccatgggcagccaacagccgcgcctgagtatcctggcacatagccacttgaacctggggcggctgctgcccctggcaggctgcgagtaacagtccccaacgcctgctttctgtcctgagagggaacgctgcagcctccgcgccgctcagcggtggcagcccacagccggtctcagaagcagccaaaggctctctgtctggcgcccttcccgtgctcctggccgccccaagttactcacgcaggcggcccgggttcggcgagtagctgggctcttgcagctcagaactccctagagaagtgaaagcgaagctcccacgggacgcgcttttaaaccctaggggaacaggtctccggaaaaccccatttttcccccctgagtaagactgggagtttccggcaagggctgtaccttgcgcctattgctgggaaaccagtcctggggctggcgctgaggaaggccagcttctgggtttttttgtttttgtttttgtttttgttgttattttttcctacgggcgcttcttgatggaggcagaatgaaataggcgtgactctaacttccagaccagtattgagacctaatatatcttatttgtgcagaatacggatttagaatggacagggacagaattcaggagggttggattcggatggcagtcatatatgaccaatgaaagagccaaaaaacttactggaattaaaaaagaggaaaaaggattgtgaggggaaaagatctgcttaggaaaattggaatgctttacagtaagtacttcctcaagcaagaagacagctggggggagggtgcgggaataggaaactgactgctctttcttttgatggctactccgttagatcaagacttctttccactctcgtgggtaaagaatcaagaattgacacaaccaaggagtgccagctcagtaacaaaacaaagatagagagagcggaaagaatagccaacgtaattatggaggacttctaaggaatgtcctcccggagcttaatacaaaactaaaaattgagcacaaccctattttccttgcaatgcccatagttctgcagtttcttcttctggatcacccttggttctaatccttgcaacacctctgctctaaagtagaaaggtaaactgagaaaaggaagctagcgtgtgcatttttcagaaaaagcctttacttcctgaagcacagttatatgaatcatgggctataagttttcattagcagacaaaatattaaaattctaataataatgattataatgcatggcttcctgaagtttgtttcaagaaatttcactagaagcttgttccattaagagtgcacataatgttactctttaccctttgtctttgccatttcttttgagagttgaagtagttgaggatctactatgtggtctccaactgtcttatctggtttgggtaatttcatcatatttgaggaccaaaaagttgaatagcaataaaaatagactctactcgggaggctgaggcaggaggattgcttgagcctggaagtcaaggctgccgtgagccatgatcttaccactgtcctccagcctaggcaacagagtgatgccctgtctcaaaaaataataatagagaactaatattagaaaccctgaacaagcataaaggagaattacaaactgcatcacgttagtgtttgaatatttttttaaaaaatggaaaaggccatttcatagaacgaacttacgtgtcatattcacactcatctatgtgacttttttttctgcttttaaccctgacacataacctactgtaacaagaacaaatatttagtctctttttctgaaataaaagcatatgatgcagtttcacagtttggccaggaagtaccttagtgaggttcatgcacaggaagatgggtttttatgcaatccccttgactacacatatatggttattttttaaggaagcaatgtagttcagtgcctaaaagctgaggttctagactcttcaatgtgacagtcttggatttgaattccatatctatattatgtacaggaattttctgactaggcatggtggctcaagcctgtaatcccaacacttggggaggctgaggtgggcagatcaccttaggtcaggagttcgagaccaggctggccaacatggtgaaacctcgtctcaactaaaaatacaaaaaaatttgccaggcgttgtggtgggcacctataatcccagctactcaggaggctgagggaggagaatcacttgaacctgggaggctgaggttgcagtgagccgtgatcgcaccattgcactccagcctagatgatagaatgagactccatatcaaaaaaaaaaaaaagagagagaaaaatacgaaaggaattttcctacatgactgtctttgtgccccagattctccatctataaatgtgaataacttgtagtacttacctacttcttcatgaagtggttatggaattaaattatcagtgaaaataggtctatgcaatggacattcagtaaacactggttttaaagactgataaagactggagttgatggattgtagaaaactatttatgttaactttgacccccataacttaagcagctgaggattgaatgtattatttggcttacattaaaaaccaacaagaatttttagacagacctccttctggtttaaccaaattccctactgaaaacaaattctccaatttcagcctcttcaggggaagtaagggcaatcccacaagccacgcttgccttgcgttattcctatggtttatcttttcggtaacctaatgaaaagttcaggatggtggggagtgtgggtgtgacaacaatgccaaaagcactctcaaaccagccattcttaatatgttactctctatgtgatgtaggagaaaggtcttcaattatggaccaaactaccaagctacatcattaatgggagagctgggaacctatgagatgtgggtccaaggccctaggtatgtttgcagcattgtccgtgaggcaatttcagatctaaagagtttctgcatttggaggaccaggtagattcttagaataaggtgtctgcaagatgaaaaagatcatttagtctgaagttttcattttagaaatcaggtaagtgaccttaagagatgctgtgtcatttacacagtcacacaaaccattgtcttggcaagtcaaaagtctcaagttttgacttgactactcagcctaggctcagtagatcgtggctcacggccatggcttacggccatggctcacggtaagatcatggctcatggcagccttgacttccaggctcaaacaatcctcctgcctcagcctcccaagtagagtctgtttttattgctattcaactttttggtcctcaaatatgatgaaattacccaaaccagataagacagttggagaccacatagtagatcctcaactacttcaactctcaaaagaaatggcatagacaaagggtaaagagtaacattatgtgcactcttaatggaacaagcttctagtgaaatctcttgaaacaaactgcaggaagccatgcattataattattattatgagaattttaattccaaaacctctgtgctttatattgccatagtctgtctggggctaattattcaatgacaacaatggcaacagaaaacactcttaacaggcaaggcaaattatgttttaaaattgagaaagtacgtgtaatatacaaaaagactgaattttccagcaaccctcattggaaagaatgcacaaaatgccatccggtgaataaataggttgatttaaatttgaggagcacttaactactgaaaattgaggtgaagaagacagctaatgctcatagcaagtaaaacaacctcatgtattaaaacaaaaggtggacctttggaatatttatgataatggtaaaagtatccctttcactctagcatttaattattttattatattctcctttaagctcatttcaagttatatgttatataatttttcctctatcatctactcctcccgaagtataccttttggacccctgtaagatgacagagaaaataaaaagtatgatttcatacaatctatacaaatctgattacaaggtcagaatctggtgaataattagcaattgatcatccaaatgtccatcagcagaggtttggataaagaaaatgtggtatggccgggcttgtaattacagcttgtaattctgacacttaaggaggctgaggcaggaagattgcttgagcccaggagttcaagaccagtctgtacaaaagagtaagagccgtctgctaaaaacaaattttaaaaaattagctgggcatggtggggcaccctgtagtcctagctactcagaacgctgaggtaggaggatcgcttgaacctaggaatttgaggcttcagtgagctatgatcatgccactgcactccagcctgggcagcagagtgaaaccctgtctcaaaaagagagggagaaaaaaagaaaatgtggtatatgtataccatggaatactactcagccataagagttaagtcgtcttttgcagcaaaatggatgaaacttgaggccattatctaagtgaaatgactcagaaagtcaaatgctgcatgtttttacttataactgggagctaaacagtggtacagatggacatacagggtggaataataggcattggagactttgaaaggtgggagagtaggagggggataaggattgaaaaattacctattgggtaccatgttcactattcaggtgatagatacactaaagcccagacttcaccactgtacagtatattaaatatgtattagtaagaaatctgctctggtcccccttaaatctatgagtgtacatttttttaattgccaaaatattttttttaaattagcaattgatcactgaggatctttaggttgaaggaacaggagtagaagagagaggcaaaacttcattcagaagacaaatgtgattacatgttatcaatagattatggccatttctaatcgaatcctggtaaagcaacaaattcaggttagcatccaaacctggcacctactatgtatgtgttacagaaagactaacttgcagaactttttggatatttataaatcatatatatatatatgagattttatatataaagttcctgacacatggtaggtactcaactaaaggtaactagcatcatcatcattatctgtctcctaagttaattcatgctcatcatgcatataggcacttagtggcagagttattaatatatttgtataaataaaattatcaatttttgtttctcttactatgttgtcacatatgcagatgagaagttagatttatgtttgttttcataattgctacccagaaaattttctctatttgtaacaacatgggtcacttgatttattgggaggtgttattgattgttttatatgacagatcatgatataatagatgacaatgttactggaaactttatgatatccctaacagtcttcaggctgtcacaatattagttccttgggtttgaaggagtgttgcttgtactcttaatcagagaaggcacacaagtgaaatatcttgcattcaagtacaattgaagttcatttgggaaattcacaggaaatacattgtcaacatgcctcagagtttacaaaaagatacaaataagacactatggcaggtttatgaagaaataggtccctgtatgatcagattttaatgtttgtgggaaccactggctttccatctttctgcctgaaataataccattatttcagtccttttgattagacaattgctcctaattgggaagagttatcaaaaacagatagaaatcattggtttctatctgaggatgtgaatttatttacagagtttttctaacatgacaagaagctggatagcgctgtgtttgaaaagaatctgggtctctggggactcagagacagaagatagtgaaaggataggagagtagtcccaaaatacaaacataaactttgtaagacttttgggaatgtaaacccttcagggttcattattaaaaagaaagagtgcacttacagtagttacagtgcaatcccagggagattaacctcccacagtgttgcctccaagaagcaaatagacatggactaccatcaaggtttacaaaaatatacaattacgtgcagtacatcataaaattccaacaatatgtaactcttcgaactgtagtgcacctctttacctgtatatgccttttcttatggggatgttcaacataaattcaaattgattaacaccctggagtgtttttcagaagcagtctatgatttcatcacccttgttttgcactttcctaaagagtaattgcaaaataaaaaagtgaaaggacgctatactccaaaatgctgttccactttggttgttacataagttcaacttttgaggttcttcctgtagtatctccaaaccaagatgtatttttaaaattattagaaattagtggtccagtccattgaaaccccacaatcaaatgcaatacgatataacatttagctcattcttatttactgtcaaatttagtttcttttaggtatatctttggacttcctcccctgatccttgttctgttgccagtagcatcatctgattgtgatattgaaggtaaagatggcaaacaatatgagagtgttctaatggtcagcatcgatcaattattggtatgtgattattttgttttactcacattttcatgcattgggaaaatttgaacctttttggtatgcagttttataatcaagtattcatctttcttgacaagaaagtgaagtaactatagaataaaatttaatgagctactaactgtatatttttatagctgacataattatgtagcttaaaaataattctttcctcgactctaagattctcacaactattcatttcagtcctatttcccttttagtaaatttcttgtaagcataattcagtatcactgcctaaatttcctcacctcccatttaccatgttagtccctgtagaagcattacattaagagtgggaaaataacagagtaaatagttaagacttatggtgaatagatgtgtattttatttggctgtgtgtagatgcatagttatttatatgtgtgtattttatatctatgtgtaatcaataatttgttatgagttaaattttctatttttgatggttaaagcttttctaattaatagattttataccttagagccaacttaggtttctagaaaattcgagcagaaagtagaaaattcccatatgctctctctctctctgcactgtttcccttattatcttacatcagtatggcacatttattacaattgatgagccagcattgatacattacataagtgcatagttaacattaggattcattctttatgttttatagttttatgggttttgataaatgtataccatcacatatccgtgattacatatcatacaaatcatatggtaaaaatctcctatccaccgactcatccttctctttcttcccctgaactcctagtaaccactgatttgtttatgtctctgtagttttgccttctttagaatgtcatatagttagaatcatgcggtctgtatgtggcctctttagactggattctttcacttagcaatgtgaatcaaagcatcccccatgattttttgtggtttgatatttcattttttcttattgctggataacagtctattgaatggatataccacaacttgtttattttttcactgattgaaaaatgtgtcacagttgcttccaatatttggaaattatgaataaaacttctataaacatatacgtgcagggttttgtgtggacataagttttcaactcaggtaaatacctacaagcatgactgctggatcatatggtaagactgtgtttagctctgtacaaaactgccaaactttcttccaaagtggctgtaatattttgcattcttaccagcaatgaatgagatcctaatgccttccatcttcgccagcctttggtattatcagttttgcagattttaaccattttaataggcttgtcatagtatctcagtgttgtttcaattttccattccataatgacatacaatgttgaccatcttttcagatactttttgccatttgtatatctgctttgctgaggtgtctgaactcacatttttactgaaatcttaacaatattgagtcttcttagccattatcatgcactatctcttttttaatttttttcatcatttaattgtattatctggacagagaacaaatgagtattactgtgacaacatttgtaaataattatatgtgtgtaaaactctgcaaaagaagatgcaattgaaaatgcaaactttcatcagagctttgttcttttcagcatataaatcctgtaaatattttattagacttatacctaaatatttcatattttagtgctattttaaatggtgtgtttctaatttcaaattttagttgtttattgctggtacataggaaagcaattgatttttgtatattaacctatgtcctgcaaccttactataatcacttgtttgttctagaagtctgttgttgattattaggaattttctacatagacaatcatgtcatctgcaagagttaattttttccaaggtttcagagctgtatcaatacaatgtgattgatttattgttttaacagataattagtctcttttcaatcagattgaaactgaatagcaaaggaaaactctctcaaatgttcataagatgggagaaattgtctaatctgtcccccgacttttactccactgtctcttccacatactcatactgaagtggcatgatgccttgaggaatttagtgttatacctcttgtaggaatatggaaactaaaaagagatactgtgctacactgtacattgtaatccagaggttcctgattttgcccattgacaagaaaaaaaatagtgcacagtaaatggcaattgctccatttagatttcttgctaatttggacattgcatttgatgatgctactaaattaatcttttgagtcaagataatatttctcatttaattttgttatctgggcagagaacaaactagtgctagttcaacatttataaataactatatgtgtataaaagtgcaaaataatatgctattaaaaattcagtaaaaggagagtttcatccaacagactcatgacacatttttttggtgggagaatatagaggagcttatctcattaacacacaaaacaagaacaagtacatcagcagcaataattatattattttcaaaaaacaaaacatggctactcttcttaaggaggttaattcacaagacatggaagagaacacagctaatcagtccaactgagtagttccatagtaaccttaagaatgttttctatacatagaaggtgataaatttgagggaaggagaaagaaagtctcaatgaattattaatgtcaacatgactggtagagcagatttagttactcattcattcagtgtggactagatgctttgcagacattactgtgtttaagtcttggggagaccataatactaatagttatgaagtgcttgttatgttctcagtgctttccatgtgttaactaatttaatccttacaacagcccttgagaaagacactcttactacctccgtttcacaacagaagaatctgaggcccagggttatccagtttataagtgaccgagccagaatctttgtccatgctctctaccccactctcctacctcccaaggacaatctctgtgatagtttattcaatcagcaaacatttatttagggcctgatatgtacaagttactatgaaaaacccatttgtgtaggtgatgttgggtttgggtgtggatagaatgatggaccaagtacagatcttttttcaagaagcttacattttggtgagtgttaaagattggtggtgaataatgcaagttacagttttaaaagtaggaagagtgacttcctgtttgttagatgtctgcttatcatctaacaaatagactggttgtaaaacaagctcagaaacaaaaagatgtaaatggtgttctggaagtagtaaagaagcaattttggcctgtgtagaagtttcagcaagttatccagaaggtctagctaagatgattggtaaaagtggctacactaaacaacagatttcaatgtagatgaaacatccttctactggaaacaggcgacatctagaactttcatagctaaagaagagaagtcaatgcctggcttcaaagcttaagaggacaaactaactctcttgttagggacaaatgcagctggtgactttaagttttagcaaaatattactgctcattgacaatgcaaaactagtcacccaagagtgctgatggatattaatgttttcataactgctaatataacatctgtttttcagcccgtgaatcaaagagtagtttcaaccttcaagccttattttttaagccatgtatttttgaggctatggctgccagagataatgattcatctaatagatctgggcaaagaattgaaaccttgtgaacagcattcattgttctgtagtagatgtccttaaaaacatttgtgattcatgggaggaggtcaaaatatccacattaacaggagttcggaagaagttgattccaactgtcatagatgactttgaggggttcaagacttcaatagagaaagtaaatgcagatatggtagaaatagcaagagaattagaattagaagtggagcctgaagatgtgactgaaatgctgaaatctcaggataaaactggaatggatgatgagttgcttctcaggcatgagcaaagaaagtggtttcttgaaatgattttactttgagtaaagatgctgtgaacattgctgaaatgacaagaaaaaatttaggatattacacaaaattagttgttaaagcaatggaaggatttgagaggattgcctctaattttaaaagaagttctactgtggataaaatgctttcaaacagtatcacatgctacagaggaatcttttatgaaagaaagagttaatctatgtggcaaacttcattgttgcctcattttaaaaattactacagccacccaaccttcagcaaccaccactctgatcagtcagcatccactaacgttgaagcaaggccctccaccagcaaaaaagtttacaacaccctgaaggctcagatgattgttagcatttttcagcaaaaaattctttttaaattaaaatgtatacattgttattttagacataagactattgtacacataatagactacagtatagtgtaaacataacttttatatgctgggaaaccaaacaaaattgtatgactcactgtattgtgatacttgctttactgcagtggaaccaaacccacagtatctctgaggtatgcctgcaataaattatgcaatcattatcactatctaattctagaatattttcatcattgccaaaagaaatattctacccattagcagtaactctttattccccatcactagcctctggcagccactattctgcattctgctttctgtctctaggaatttgcctattctggacatttcacatctgtcttgtatataattcatatggatgatatgcagctttttgtattgatcttgtttgccttagtataatgtttttaaaattaatccatatgataacaggagttagtatttcatttctcttcatggctcaataaaattctgttgtatggatatgccacattttgtttatccattcatcaatttctggacatttgggttttccattgtttggctatgcaagtttttatacaattgtcttgatatgttcctagtagtcaaattgttggattatatggtcactctgttaaactttttgagaaactgcaaactgtttctaaagaggctgcaccatttgcgtttctatcagcagttaaggctctgatttttctactttctcaccaaagcttgttatcatctaactttttattctagctatctctgtgggtgtgaagtagtatctcatagtgatactgattggcatttccttgatgactaatgatgtcaagcatcttttcattattggctgttattatcagccattttatatatcttcttttggagaattgtttattcaaatctttcacccacttttaaattggattatttgtcttttcatttttatagttgtaagagttctttatatgctctggatcttagacctttatcagatattatattttttcctcccatcatttgtattgttttttattttcttgatagtgtcctttgaaggacatttttaacttttatgaagtccaattcatttactcttgttgcccatgtttttgttttcatatcaaagaaactattgcttaatccaagacaacaaagatttacatctatgttttattctaagagctttatagtttcagtctcacatgttggtctttgattcatattgagttaatttatgtacgtggtgtgaggtaggggtccaacttcattctttttcatgtggctatacagttgttcctgcatctgatattgaaaattatattttccctcattgaatgtctggacacccttgttgaaaataaattgaactcaaatgtatgggtttatttctgacctctccatggtaatccattgatatataatccctatgccaggaccagacagtctcaattactgtagcttggtgtttagttttgaaatcagttttgtctttcaattatgtttttattttcttaaaatcatttatactgatgaaattgctgatatttattttatggattgactacctttttttagggattagtatattaaatagctttataatttaaatgcaatctaaatctctctggtgatgtcatatctctgagcaattactaaaccatgtgactccatatactagtaagtatggtccagtgagtggcatggacagaagtaatgacagactgtagagaagtggtggggagcttaagagtattctcttccttatagctctcaagatccgttttcattctcccattagattttgatgatatgctcatcatttggtaagagcacatgataatatattaagtataatgttattgatttatttagagacagagtctcactccatcacccaggctggagtgcactggtgtgttcttagctcattgaaatctccacctcccaggttcaagcaattcttgtgcttctgcctaccaagtagctaggattacaggcatgtgccaccacacccagctaatttttgtatttttagtagagatgggtttttgccatgttggccaggctgttctcaaactcctgacctcaagtgatctgcctgcttcagcctctcgaagtgctgggattacaggcatgagtcactgtgcttggcctaagtataactctgtaattgtcctatctgtttaaaacatctttccattcataattcccttattttcttacttttgatatataattttatttttatgtagtgacatctatataataaaatttcagatggttcaatttgggcaccaaggtgggagggatcagggactggtgtgaaattgatacagaaatagttttcctataaagccacaaataagtgatacttggagaagaaagaacttgtctttcccccttgaataatcttggcatcctcatcaaacatcacttcaccagagatgtatgggtttatttctggactctccaattccattttgttcatctgtatatctgtcctgggtcagtaccaaactgtctttattactctttctttggataagtttgaaatcgggaaatatgaatcattttactttttttttttttgagattgttttggttcatgcataaactaatttgggaccatcattttcgtaataatgtttaaaaatgcttgtggtccatgaacatgggatttttgttccatttatttgtatcttttaaattttcttttaacaatattttatagttttcagaatataggttttacccttcttttgttaaatttattcctaagtatcttatgtctctttaatgctattgcaaatggaattttttctttattttaaaattatctatgatttctaactctccactccttgtatacttacctaagtatgtgtcttatttccccgtactagtccatatgtatattaaggacagattttatgtttgagtcatctttgtatctcacagactattagcccagcatcttacacgtagtagtttttcaaatgtttaattaataatttatggattgttaatcaacaccataaattaatgaaaacccagagctaattttgaataatctaggaagcctgtttttttaacatatgttctttggaaatttgttatgaattaaatatcaggtactttttgatatcaatatgaactagttttggatgttatacaatattttttatccataaaaaattattttacctaaatataactcacatggttgaactacataactcttagtcaccacagcaaaggctgtttcaaaatataaaggctgctagaaatggccaaacgctttctaggaataactcagtctaattgtaggcaaatacagggctatccctttattttaagttgtaaacttataaatctaatgactaatcggttataatatactttcacaacttccaatatctttaactgtgactctattccagaggctttcacagattcaacttctgtctttgcactgacagctctcatatagcctgaggtctacatttctcccattaactctaggaccatttaattcaaatatctagtagatatctctacccagatgtactatggcacctcatgcataatagtcaactaattgccatcacatttagcctgttcctgcttctgtattctctatcttaggtaattttagcattttcctagtctttcaattctgaaagcctagaatcatctttgatggccttcatctcatccatcaccaaattctatagtttaatatatcatcttaacacctgtattatccatctattctatagacttctactactagtcttagttcaagtagttgtcagatctcaccgggaccacttctgcagctgtcagtgggccctgactaaccttcctgcctcccctgtgcatctggcctttttaatgatgcttgagttatctgtcccgattcaaatctgttaccatttttcttctttttaaaaactctttaatgaagtatctctcccccagcacctatcaggatttggtcttgcatttgattggtttgctaacagaagtagccaaagaaggatcaaattctagccaaatattgcttcaaaaatatgtgtaaataaatggacaatgtttaaataattgtagttaacaaataaggaaaatgtaaattgattacaataaaaattagttttttaatatcaatttatgctagagtaaaatataaatttcctgtttatatgactcagtagcatgactaatcagttgcaatttaacaagagacattgctttttaagaggcaaggctttttgttttatgaataacttttttctagttataaaaattaaagaaaaatagactaattaaaagatagagactgcctgagtagattttaaaaaccctactttacgttgcctaaaagaaacctactttaaatataaagatacatatagattgaaagtaaaaggatggggaatgatacactatgttaacactaatcaaaatgggagtagctatattcatttcagtcaaagtcaacttcagagcaaggcggactatcatggatataaagagggtgcattacataataataaagggccaattatccaagaagacataagaatccttgctctgtacatatctaaaaacagcatcaaactctgtgaagcaaaaactgataaactgcaagaaatacatgtatctattattatagttggaaacttcacagccttctgtcagtaattgacagattcagcagggaggaaatcagtaaggttacagatgaacttgaaagcaccataaatcaactggatctaattgacagttataaaatacttcatcaaacaacagcataatacacatttttctcagactcacatggaatattccccaaaattgaacatgtactgagccgtaaaacacaccttaacaaatttttataaagtacaagtcatgcacaacatgctctcaaccaaaatgtaattgaagtagaaatcaataaaataagaaaaataggtggaaaattcccaaatatttggaaattaaaaacacaatttttgataacatatgggtcaaacaaaatgtctcaaaagaaattttaaaatattttgaattaaatgaaaagaaaatagatatttgcatgatacagtgagagcagtgcttagggtattaaatgcatagaaagaaaagaaaaagatataaaatcaatagtctaatcttccaccttaggaaaacagaaatgagaaagaaaattaaaactaaattaatcagaagaaaataaataatgaaattagagatgaaattgagaacaagaaattagtagaggaaaatcaatgaaaccaaaactggttctttgaaaagatcaataaaattaataagcctccagccaggctgaccacgaaaataagaaacaagacacaaactactactatcagaagtgaaaagagagccatcactactgattccatggatattataaagataatgaggtaaaagtattttgatggttaattttatgcattaacttatcttggccaaggaacaccaaggattgccagcagccaccaaaatctaggagaaagtcatgaagtggtttcaccacagagcctccaaaaggaaccaaccctgccaacactttgatgtcagacttatggcttccagaactctgagagactaaatttctgttgttttaagccaccctgttcatggacatttgttatagaagccctaggaaactcaaataaatggtgacaaaagtggacaacatcctgaaaaaaaattcactaacactccactttgaagagaggccgtggaaatgtctactggggaaaagcaagtgaattggggaaatgacccctaaatatggtagtctctatgaaaagcaaaacacctctttctcagttgggaggaaacttgaagaccaaatgagcactctttcctcatgcaggccagctcaccatacaccatgatgcactttaacaaaaggtaaattgttaaaaagagagcacagtgttaataacagggaaggctatgcatgtgtggggacagagagtatctgtgggaaaaaaaacagttttcttattctctccctcaacaacaatcaacataggagacttctatgaccaaatgtgtgagagtttttttcctcatattctaagcaaagaatcaattctgcaaaggacacaagctggctgtcaattcaattatgacactatctatctgaagacagcaccacatagcacaggttgaggctgtcttcatgactcctccttccccctccacccccatttcagatgccaatcacaaaccctaggatgtctaacctgtgcttctgaccaactggctgtacaatggggatcccacaacctgctccttgggtttaactaatttgctagagcagctctcagaacttggggaaatactaatatttatcatttcttataaaggatattacaaaggtacagatgaagagattcatgggcaagatatgggagaacaggtctggagctttcttgccttctctgggcatgccaccctccaaatacctccacatgttcagctatttgtaagctctctggagagttaggcatgactgattaaatcattggccattggtgatcaacataaccttcagcccctctcctctccccagaagctgggggatggggccgaaagtcccaaccctctatttatgccttgttatcctaggggctgggactggggctggagctgggggctgcctaggggctgccagataccagtcatctcattagcacagaaaaagacattcctttggaggtttcaaggattttatgggttgtgtgtcaggaatctgggacaaagaccaaacatacagtcatacgacacaatgtttcagtcaatgagggactgcatataccatgatggccccataagattataatggagttgcaatattcatattgcctagtgacatcatatctgtggtaatgtcttagaatgcattactcacatgtttgtgatgatactgatgtaaacaaacccattgcactgccagtcatataaaggtatagcacagtagtgttcagtaatgtcctaggccttcacattcactcatggctcactcactgactcatccagagcaacttgcagttctgcaagctccattcatggaaggtgccctatacaagtgtactatttttaatattttataccatatttttactgtacctgttctatatttagatatgtttagacacacaaatacttaccattgtgttattattatctatttagtgcatgctatgcaggtttgtagcctgagagcaatagactataccttatagcctaggtatgtaataggctataccatttaggtttgggttctatgatgtttgtgcgatgatgaaatcatctaatggcaccattacaatgacacatttctcataatatatcccctatcattaagtgacacataactgtatttcacagtatcacaatgtacatgaggaatctctataccttcttctcatttttttgtggacctaaaattgctctataaaatagtctttaataaaaagagagaaagaggacagtccctgtccaccaacaaaattgaccacaggttttcccacttctcagtgcactaccattgccacataccccttcgcatatagctgtgttcccaggctttccaagagcacacagagcagataatactgtggcttcacttagaaattcaacagagaagtgactgtgataagtgagaagaggatcatgagatatggagtcaaataaatatcagcacagagtggtccactttaaatttaagatgaaaataacatacaacgatacagaaatgccacagcaaaataaaaagactaaaagaaacctagaatataagcatccattctggaagggggcagacacgaagaaacagaataaaaactttcatttgtacttcacgccatagttttaaagtacacatgaattttacaacagaatatcaaagagtagttgataaaagaatagaatgagatgaaaaaatattatacaaccaaggaaatacattgaaatccaaaattatgcactccctccattttagatgtgacaaaagtgttagcaacaacaagaagaatgaacaaaaaatatgaaatagatttgttataatcaccataaatgcacagtaaaaatacaaataccaaacagttgctgaaacaataaaagataagaagagatgatagtgatccattttatgaataattgttcctaccaaagaaaattcatcgaatggaagaataaaacaacctatgatagaggaaattttttccacaaattgaggcaaaatggaatgaacagtgctaggtagtatatcatgtactataaaaattgattcaacatgattgttactaagttatatcttggaaaagtgactgaatttcaagagcaaggaagaataattctaaaggtggaaatggcaagtcagttggaggagaatcagagtggcttcagatttttcacatctaaatgcaaaagataatggaataatgtctacaaaattctgagagataaaaatgtggctcagaatttgatacctagacaagatgttgttcaaatataaagtgcacaggcagaaatttatgtatgtcagaatttaggcaatagaacactcatgagccttttcaaggagaagatggagggggaggggagctactggatataaaatccaaccaaccaagagaaaagtgaagacactgtagtaaaaggtcaattgatagcacaaaattcacttccttgtagaattagagtagcctcttcaaaatatattatattcttttattttcctcatggttcttgctactgtctcaaattatcatatttttaggacagagactctctgtcttgataatccttgtatccccaccatctagaatgttacctggtacagacaagacccttcataaatatttattgactgactgagtgaatgaacatagtttacattaaaaaaaacttaaatgttattttaaagttataaaattacagtgtagcataaaattatatgttatatcgtgtatatagtataattcaaaattatgttgtaaagatgttgatatacataagtgactgtgttagacacttctggctgccatatcaaagaaccatggactttggtactttggtggcttataaacaagagaaatttattcctcacagttctggaggctggaagtccaggattggggtggcatatggttgggttctggtgaaggacctcttccaggttgtggactaccagcttctcatatcttcacgtggcagaatgtgaaattttcagatggctagagagctctctggtgtttctttataaggcactaccaccattcattagaggttcaccttcatgacttaattacctcccgaaggcctcactttctaacgacaacacattgggggttaggatttcaacatatgaatttcgaggagacacaaatgttcagttcataacagtgacattttaaaatcattatatgacttatagtcttcaccatattggctctatcagtgacttctcactattggtttatgtgctactcatatatttacttgcagtttacctaatggctcgcttatttttgcttaaccaggtggtgtttagagttatgctctcaaaacagaacactctcttctgacagtttggtttatcatacttggctgctttgctttacatatttctttaataaatctttatctttgatctgcctgttaccaccccacttcagctcactagaatcttcgaatatatccatctcatacttcatctctcaaattgtctcattaatcacaggttatatagttgaaattgatatttaaagttcaagtaaatagttataaagtacagcatataagcatttgtgattataaatttacagttgccacatatgttaattggtaattagatcgctgcttgtaggatggtatataaccattactgcatattaaccttaagactaatgagtgagagctgggccatgatggctgactagacacagttgcagttggaggcctccaccgagaataacaaaaacagcaagtgaatcctgtgctggcaactaaggtatccaggttctctcatttggactgactaggtggttggtgcaactgacagaaagcaaagaaatcagagtggagtaatggcccacctgcagggggtaagtgggactcccatccccagccaagggaggcagtgagtgattggccatcctgcccaggaaaccatatttttccgtggatgggtgcaacctgcaaatcaggagattcccatcataagcccacaccaaaagggccttgggttccaagcacagagcagtgcatattctctcagtggccactgggctggggtctgcctaagactacagagttcctagagggaagggtagccaccatcgctatggctacctgctgcctaagatgactgaacttagaaaaggggcagcaaccatcactgcagctccagtctgccttttcccctgctggtgccagagatattgggtggttcagatccaggaggaattctccacagtgcaacacagcagctgtggcagataatcaccagactgcctctttaggctgcacccggacccatccatcttcactgcatgtggcctccctctgggaatttcatcatctccagccaggggtttacggacagagctctgatacccctgggatggagcttctggggggaggagcggctgttgtctctgtggatcagcagacttagtcttttccccgctggctctgaggaatccaggcagttcagacgagtgggattccagccagagtgcttcattaagtgggtctttgatcctgttctcctgactgggtgagaccacccccaacaggggtcaccagataccttatatagagacattcccactaacatgaagtcaataaccctctgggatggagctcccagaggaaggagcagtaagccatctttgctgttgcgcagcctccactggtgacacccccaggggtgggagagacccaggcaaatagggtctggagtgaacccccagcaactgacaggagccttatggaagaggggcctgactgttaaaagaaaagcaaacagaaagcaacaacaacaacagcatcaacaaaaaggcacccacagaaaccccatccaaaggtcagcagcctcaaagatcaaaggtagataacctcagcaagatgagaaacagtcaatgaaaaaacactgacaactcaaaagccagagtacctcttcttgaaatgatcgcaacacctttccaacaaggcacagaactgggctgaggctgagatggataaactggcagaagtaggcttcagaaggtgggtaataatgaacttcactgagccaaaggagcatgtcctaacccaatgcaaagaagttaagaaccatgataaaacattatagaagctgttaaccagaataatgtttagagagaaacataaatgacctgatggagctgaaaaatacaacacaagaacttcccaatgcaaccacaggtatcaatagctgaatagatcaagtggaggaaagcacttcagaacttgaggactatcttgctgaaataagacacaaaattagagaaaaaaggcatgaaaagaaatgaacagaacctgtgagaactatgggattatgtaaacccacaaaacctacgcctgattggggtacgtgaaagagatggggagaattgaactaacttggaaaacatgctttaggatatcatccaggagaacttcctcaacctagcaagacagggcaacagtcaaattcaggaagtacagagagccccagtaagatacgccatgagaagaaccactccaagacacatgatcatcagattctccaaggttgaaatgaaggaaaaaaatattaagggcagccagagagaaaggccaggtcacctacaagggaaagcccatcggaataacagcaaacctctcagcagaaaccctacaagccagaagagattgggggccaatattcaacactcttaaaagaaaaatgtttctaaccagaatttcatatccagtgaaactaagcttcataagcaaaggagaaataaaatcctttccagacaggcaaatgctgaggaaatttgtcatcaccaggcctgccatgcaagagttactgaaggaagcactaaatatggaaaggaaaaatgattaccagccactacaaaaacacactgaagtacacagaccaatgatactatgaagcaactacatcaacaagtctgtaaaataaccagctagcatcatggtgacaagatcaactgcacacataggaatattaaccttaaatgtaaatggcctaaatgccccaattaaaaggcacagagtggcaagctggataaagagtcaaggtccactagtgagctgtatttaagagacacatctcatgtacaaagacacatataggctcaaaatagtaaaatctaccgagcaaatggaaaacagaaaaaatcaggggttgcaatcctagtttctgacaaaacagactttaaaccaataaagatcaaaaaagataaaggcattacataattgtaaagggttcaattcaacaagaagagctaacatcctaaatatatatgcacccaatacaggagcacctagattcataaaacatattcttagagacatacaaagagacttagactcccacagaataatagtgagagaatttaacactgcactgtcaatattagacagatcattgaggcagaaaattaacaaggatattcaggaattgaactcagctctggatcaagtggacctgatagatatctacagaactctccaccccaaaataacagaatatacattcttcttggcaccacatggcacttactgtaaaatcaaccacataattggatgtaaaacactcctcagcaaatgccaaagaactgaaatcacaacaaacagtctcttagaccacagtgcaatcaaattagaactcaattttaaggaactcactcaaaagcatacaattacatggaaattgaacaacccgatcctgaatgactcctcggtaaataatgaacttaaggcacaagtcaggaagttctttgaaatcaatgaaaacaaagaggcagtgtgccagaatctctggaatgcagctacagcagtgttaagcgagaaatttataaaactaaatgtccacattaaaaagctagaaagatctctagtcaacatcctaacatcacaatgaaaagaactagagaaccaagggcaaacaaaccacaaagctagcagaagacaagaaataaccaagatcagaaaagaattgaagcagatgtagacataaaaaacccttcaaaatattaatgaatccagaagctggtttttgaaaaaaattaataaaacagactgctagttagactaataaagaagaaaagggagaagaatcaaatatacacaataaaacgataagataaatatcatcactgaccccacagaaatacaaacaaccatcagagaataccataaacacctctatgcaaataaattagaaaatctagaagaaatggataaattcctggacagatatatactcccaagactgaaccaggaagaagttgaatccttgaataggcgaataacaagttctgaaattgaggcagtaataaatagcctgccaaccaagaaaacccgcgaccagacagatttagagctgaattctaccagaggtacaaagaggagctggtaccattttttctgaaattattccaaacaattgaaaaggagggactcctcactaactcattttatgaagccagcatcattctcacaccaaaacctggcagagatactacaaaaaaagaaaacttcaggccaacatctctgatgaacgtcaatacaaaaatcttcggtaaaatactgccaaaccaaatccaggagcacatcgaaaagcttatccaccatgatcaagttggcttcatctctgggatgtaaggctggtgcaacatacaaaaatcaataaatgtaattcatcacataaactgaactaaagacaaaaaccacttgattatctcaatagatgtagaaaaggcctttgataaaattcaacatccccccatgttaaaaactctcaataaactagatattgatggaacatacctcaaaataacaagagccatttatgacaaacccacagccaatatcatactgaatggacaaaagctggaagcattcctctagaaaactagcacaagacaaggatgcccactctcaccactcctgttcaacatagtattggaagttctggccagggcaatcaggcaaaagaaacaaataaaggtaggcaaataggaagacaggaagtcaaactgtttgccgatgatgtgattttatatctagaaaaccccattgtctcagcccaaaagcttcttaagctgataagcaacttcagcaaaatctcagaatacaaaatcaatgtgcaaaaatcacaagcattcctatacaccaacaatacacaaggagaaagcaaaatcatgaatgaactcccatttacaattgctaaaaagaggataaaatacttaggaatacagctaacaagggcaagtgaagacctctcagggagaaatacaaaccactgctcaagtatatcagagaggacacaaacaaatgaaaaaacatgtcatgctcatggataggaagaatcaacattgtgaaaatggccatactgcccaaagtaatttatagatccaatgctactcccattaaattaccattaacattcttcccagaattagaaaaaactaccataaaattcatatggacccagaaaagagccagtattgtcaagacaatcctaagcaaaaagaacaaagctggaggcaccatgctacccaacttcaaactacattctacaaggctacagcaaccaaaatagcacagtactcatacaaaaacagacacgtagtccaatggaaaagaatagagacctcacaaagaagaccacatatctacagccatccgatctttgacaaacctgacaaaaacaagcaatggggaaaggattccctatttaataaatgtttccttaatattccattattttaaacatttattaagcatctgctaatagtaatctgtcaactcaaatctgaatgatgtattcccctcttcaagaactctagtgactcagagtggaataacaattttaatgggactttgaagaatgtatagttcttaaggaggcaaaaatgaaagggaatgccatttcatcagagaggactatttgagtcaaagcttcgaatcctgcctttccatgcaattttgcatgcatttatgaaatggctgttaaagattgtgtgcaagctgttaaataatgagcacaggtataaaaaagaccagtttaccagactatgaggtttagttttgaaagagagctagactcttaaataaagaattgcaatgcaatgggataatgctgataattacagttgaaaatgtttagggataccaactaatttgacctgggggcttggtaattagatttaagtcaatggccccatgtagctctagaggagatttggatgtagaaaagttggaaggtagggtatggctagattttgcaagaccttacataccaggccgaagaatgtgaacttgatctttaggactatataataaggagcgatcaggcttttaaactgcagcagtgtagaattaaatctgggatttagaaagataattcatatgcgccatataaaataaatttgtgatgaaaagcattcagaaagataggttatttcagcattcgtagttggcactgttgagtatggcatgtttctttttaaaaaccatagtaaaatttacagatggcagctgatgtcctctgaaagtttgggagtatgtgattgatgatattgtcattcaatcagtaatttttattacatgaaaatacaatggaaaactcaaagattgataaaatatagttcttgcattaggaacaagcaaataaaaggcagtagtgaatgcatggagtccttaaaggtagtttcccaaaaggaagagtaaaactgaaatggcccccagcacctggagagaaaaaggagaaactgcaagttggagcaatgagatgaatgctaatgccacaacataattacaaagtccgtcctagtgaagaaggaaggcactttcagattgcccttttttataggtgcctgttgttgtcaaggcctgttctcatacctggccagacttccattaagtctgtgcattcaactttgaggacaatgatgcgtctaatactcccaggcctgaatagctattttatgaaaattactatattggtatttttatttgttttgaacccacatctatgcctgcattagatattataaactttattatctagcttctttaccatgtgcagatagaggtgaatctcaactagacaaccgatgaagacattgtcgatcacataatgataatatttgtgcttcagttgtttttctcttaatggtgcttattatgcaggttattaattcaaagaccatcattggtattgaggaatgtgagagtaggaatgtcatttatagagatgaaaagtttctattcaccatgaagatcacagatgttttcatctgccagggagtaatttatactgcatctacttatgttatgacccgtgtggaccctgtgtcaatattgaatctgaatatgccacttgctagctatgtgacattggataaattacttaatccttctgtgccttagtttccttatttctaaagtggggataaaattaggacccatacttcatagggttattttaaataaattaaatgggctaatatatgtaaagctcatggaacagtgcctggaacttaagcattcaacaagtcatagttcttgtcatattattaatgttagaaataatgtctgcaacaatgctctctaaatttcctatctcacatccttaagaacagatgcaaataaaaacctgtaatatttgaaaatggctagaaattgtgtgatttatgagagcaaaattcaaacatacacaatatgattttgcattcactttagtcccctcttatccaacatttcagcttctgtggtttcagttacccaaaaatcaatgaaggttcaaaaatcttctatggaaacttccagaaataattcgtaaattttaaattgtgtgccgttctgagtagcatgatgaaatcttgcactgtctcactctatcccatccaaggggtgaatcatccctttgtctagcagaaccgggctgtggatgctacctgcccattagtctcatagtagccttttagattatcagattggctgcagaggtatctcagtgcttatgttcaagtcattcttactttacttcataatggccccaaaaagcaagagtagtgatgctagaatattgtcataattgctctatttcattattaggtattgttattaatctcttactgtgcctaatttataaattaaagttttatcattggtatgtatgcataggaagaaaagtaccgcatatatagggtctggtaccatgtatggtctcaggcatccactggtggccttggaaagtatcctccaaggataaggggtactactgtagagaatgtagaagtggctatttaataaccactaaatatttatttagcatggaagtgtttgaagtaaaatcttacacagaggtccagtgaagtcccaagccctgactatcctgtatcatccttacgcttacttctaagcgcccccccagttaccttatgaaatcctaggactacatggaatatgatctatgaaaaccactgccctagtccaatgtactcattttgcttatgagaaaattcaaggagaggttacagtaagtcagtaaaacgctacaggaagaaaaaggactggaaatgaaatgctttggtcagagtccccactttgcccctttggctatgagatgttggacaattcagttaactgcttgaaagcctgatttttccaattagaattttgattttcataatctctgagatccattcctgctgtaaaactattcaatgtcagaaatgcacacagtcatccacaaactctagtttggtgttcttttcattgcactgatgtagaagtatcgactacttaggagaaccaaagaatgaatgccctggatgaattccataataacctttctgcacatccagagtaggatatgtataattttgtgacgtatggcactgtaccaagtacaggtgaatatgccgtcaggttttcaatagttatgcagtgtgtgtatttaacatgaacactgatagctaggcaaatctgccaattgttgaatcatatagttcctggaacaccatttcttatccccaaacttatataaccacacctggattaaagtaaattaataaaatactacgttgtgtacctaaggtgtgttggtaaagctggaaaaggcaactcatgaataaaaaatatatattacctccagaaaaataaatgtaatgcatacacaactttacacaagttaaagaatgggtttaacaactaagatttgttcattaccctttcatgagacattcttttgttctgtattcattacattattagattttctagtgaatttcaccaattgatttttcttaagttgagcttcatcagagaaattctgtagaggtattttcacaaatgaaaactcacaatcacaagttttctaactcttttgcataaaaaagcactgaggacactttcatgatgatattattctgaaacaccatatttaagaatatagtcatttttattctttgtttgttctttatgtcctaatgttctctacagtggattccatcaatattaattgttaaaatattaactttctatttctgccattgttttatgtaccacagagacatgtattagaaaacacgctatgttatgggtgtaagttaaatgagaagcacagtgccaataaattgcacgagaattgctttacttgggctattcttggtcataggaaggactgggaaattaatatagtcacgtttttatagatgcagagcttttattaattaacatacagttgttaattagtagtatatgttcacctttgttattaacataaaatttagtacaaaacacttttgggatattaaattttggtattaaatatgtcctatttcatacatgttagaatataattaatatatacttattgtcatcacaaagaatcaatgctaaagtcaaaaaattccaggtactttttttccttcttgttaacctagcaatgttgggcattagatgaagaagaggcaaggctacagggttagataaggatctgcagtcttagtctttgcaaatacttggtatctcttgccttctcaaaacttaggcattgaaaattattataagtaatgaaatccaaaatgttagatagggtaaacacagttgaactcacaaatatatgtttttttttcttttctctgctcttttggtagaaaatgtagaacatgattaataaggttggagttttttctttataatttttttcacagtggcgttccaaactaaagaatgcttgtttacctaatatggccaaattggagccagtaccttcattcagctagatttaccccagttgcatatttgcaatgaggcagaattcctacagacagccttccttctgatttttctgcctttgttcctcctcacactgtgtttctcccataattcacatctaccctctacctaattggcttctccagtcaaagtggataagcatctcagtcagaaatacattatgagaacttcccaaacatgtactaatcgccacaaaccaaggctcagatcatgccatatcgctgctcaacaactttccttaggttaccactcactggctattgcaggactaattccttatgtgggcattggagaaggaaaatctgttctttacatttctagcctacttgccactctgtattgccccttacacgcccagcaccacaaccaaattggattacttactgtttccaaaatatgctccacatttttgtacctcagtgcctttgctgttttctcattgtggaattttctacttcccctgtcttgctccacaaatcttcccgcacccaaatttaaagacagcaggaattgaataacatcctttgttcaataccgttcgttatgacattgatgagaaaaaagtccatttctggccctggaccactgtctgtgtagagttagcacattctccccgtgtctgtgtgggttttctctgggtactttggtttcctcccacatcccaaagacgtgcccactgggtgaatgggtatgtcgacatggtcctagtctgagtgtaggtgtgtgtgaatgcaccctgtgatcgagggtgtcctatccaggactggtccgtgctttgtaatctgagctgctgagatagactccagccacctgaactagaataagcagtttggaaagtgaccctgaactagaataagcagtttggaaaatgaacaaatcaatcaatgtaaattattgtcaaataaaaatttgttaagtaaatggtcattatacaaatacacaacaataaatgatgcaagacgaaggtgctcatccagctgtgagtcagccttacttgtttgtgattcttttttaactgtgtggtggaagtgctcctgacagttttagctttgcaaacacttatttcttgacttaatccaccaccactatgaccatcgacactcactgatttacaaaaacatgggtaattatcttgtttttgttaatctttcttaaatgtatgtgtagctcatatttaattcagtgtttaatattagaaatgtttggggtcttcatttagaaatttggcgatgtttttgtgatgagaaatatgccacaggatcttaactcttttttatatcaattaacctacggtaaaattggtttctttgtacaacagtttacttaaagtcgcagtttccaagaacctatccgtgatgttagatgaggacttactgtgccatttaaggtcaagttcaggttctactttattcataacgcaagtcaaaagtagtcttactgttgcactttatcttgaacactattaaggaaggtatcattctatattttatgcataaaatctgaatatgcatatacattcaatattttttttaaagtagacatgtaaatgactaagcaaacaaaatgtattacaggctatgtcatgtggtcagggcttaggattcagaaaataatatgttgtcttgaattttgctagcacttatattgtcaactcttctattaaattctgttgattgaaaattttgaatcaagctcacattacttatatgacaaattcgggtaatagaaaaagcatgggctttgtaaccaggcaaaccagtatttgcatgctagccctgccaatcattagtttttccacttagtgtttttgtgaatctggtttctttgggattgtggagtgtaatgatagtgacagttgttagatattgcttgcactgtccattattctaggaagaaagtttcctggaataggaaatataactgattgttttcccacaggagaagaaggcacttcctctcctctttggggctagaaatgacttactttaaaaatctcagttaagagaggactaaagctgttccaatgttatgattgtattcccctaactatgtgaaggtacagcaggagcaagcctttcatttgtagcagtggctgcaacagaaaggggggcagtttttagagcggcctggcacagggtattagtttttgaatcctccaggctgaagaatgtgtgcttcctcagcatgtgtaagtatttgtgtcagtatgctttcatgtataattagtagaaaactgaacataaatggacttaaacattaaagagttatttaatggcctgtataactgaaaagaccccagttgaatgctttcaactgtggcttagaatttcaacttaatttctttgcaattttttgactctgcgtttctccatgtggcattaatcttcatgttgtggcttaccagtagccaccagggtttctttattcttccatatccagcagaatgataattcctttgcctataattaactaagttcttagatgtactctgattggattatctatgaaaaaatccttatgtcagcggaagacccaggtcttaactgccttagaccttgtttaattgagcaagttgctttggtcagagagatgggataacctttatttacttagtatctaagtcttagaccaatcaaaactcaagccagagctggaagtggtattaactttcattaaaaaaattactgctaaataatggagagagagaaataggaatgatatgcaatgaaaaccacaatgtctattgcgttgggaggttttggagctccaacagccaggaaacagctaggaaaacactttctgacataataagatctgtcccctctccacaaatggagtgggaacattagtgattcccactagagaagtagctttacctaggaaagtggtgatttcatgaagttcgtcatttctatgacagcaagttgtggagaccaaggagaagaacctgaagagtttattacagaacacacattagataacattatgggaattttcagaaattacatggtgctttcagaggagtttatctccatcagataggaacttaaaggcttaaattataataatgtgtgtataaaaaaagaagagtgattttattatataatcactggatagacaaaactgtaaagatctcctataaagcaaaaggaaataatttgtgtatctgtctacatactatcttcctacctatctcacttgtgtgcgtgtgcgtgtgtatgtgtgtgtgtgtgcgtgtctttgcatattggtctgtgtatgcatatgtatatataattaagagaagatgattgataccatagacagagcagagagctaatctataaataataagtgtttctgaagagaaaatagcccatcaaaacagaagcaaaagttcagaataaaagagagatatatttctgtattaaaatcttaaacttgttgattatgactcaagggtaagagacaaacactaggatatatcaaggtgaattttttcaaggaagcatccttccagtaagagaggggaaacatgtcgacaaaaggatacaattaggttagcctctatttttttaccaatgtttagctccaattgaccaagctctactgaattttgtgataactactaagttttgttactgtgggttcacagtcttagacccaggcaaattttattgaatgtaccaagaataataaagacacagataggccagcaagggtactgcttctttattcaataaaaacctgaccttaagattagtccatttggcttttgttgccactgcttttggtgttttagacatgaagctcttgcccatgcctatgtcctgaatggtaaagcctaggttttcttctagggtttttatggttttaggcctaacatttaagtctttaatccatcttgaattattttttgtatcaggtgtaaggaagggatccagtttcagctttctacatatggctagccagttttcccagcaccatttattaaatagggaatcctttccccattgcttgtttttctcaggtttgtcaaagatcagattgttgtagatgtgtggcattatttctgaggcctctgttctgttccattggtctatatctctgttttggtaccagtatcatgttgttttggttactgtagccttgtagtatagtttgaagtcaggtagtgtgatgcctccagctttgttcttttggcttaggtttgacttggcgatgtgggctcttttttggttccatatgaacttaaaagtagttttttccaattctgtgaagaaagtcattggtagcttgatggggatggcattgaatctataaattaccttgggcagtatggccattttcatgatattgattcttcctacccatgagcatggattgttcttccatttgtttgtatcctcttttatttcattgagcagtgatttgtagttctccttgaagaggtccttcacgtcccttgtaagttggattcctaggtattttattctctttgaagcaattgtgaatgggagttcactcatgatttggctctctgtttgtctgttattggtgtataaaaatgcttgtgatttttgtacattgattttgtatcctgagactttgctgaagttgcctatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactgtgttgaataggagtggtgagagagggcatccctgtcttgtgccagttttcaaagggaatgcttccagtttttgcccattcagtatgatattggctgtgggtttgtcatagatagctcttatgattttgagatacgtcccatcaatacctaagttattgagagtttttagcatgaaggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcaaggtggataagcttcttgacgtgctgctggattcggtttgccagtgacaaatgggatctaattaaactaaagagcttctgcacagcaaaagaaactaccatcagagtgaacaggcaacatacaaaatgggagaaaattttcgcaacctactcatctgacaaagggctaatatccagaatctacaatgaactcaaacaaatttacaagaaaaaaacaaacacccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccattttacccagccatcccattactgggtatatacccaaagaactataaatcatgctgctataaagacacatgcacacgtatgtttattgtggcactattcacaatagcaaagacttggaaccaacccaaatgtccgtcaatgatagactggattaagaaaatgtggcacatatacaccatggaatactatgcagccatacaaaaggatgagttcatgtcctttgtagggacgtggatgaaattggaaatcatcattctcagtaaactatcacaagaacaaaaagccaaacaccgcatattctcactcataggtgggaattgaacaatgagaacacgtggacacaggaaggggaacatcacactctggggactgttgtgaggtggggggagggggagggatagctttaggagatataccaaatgctaaatgatgagttaatgggtgcagcacaccagcatggcacatgtatacttatgtaactaacctgcacattgtgcacatgtaccctaaaacttaaagtataataataataaaataaaaaagattactccatttgaacaagatattaataaatatcaataatagagaaatggtgatataaaacaatcactattaaatgctgcagtatttggtgatttctagatagctattgtaaatattaaaacacaaaaataacttgtttcacctaagccctaagaatataaaaagtgcgtggttatgggaggactgagaaagctaaaaagatgataaatccctccctttcattagaatgattagtggatatgtatactaattagattggtagagaatataattttaataattattggaaaacactcttaaaagaattatagtctttcaaattacaaagaaaaaggaaaatacaatgtagtcacttaaataccaaaattataccaaaattataaaataaaggaaaaggaacaaaaagaaatagaatgactatctgacaataaatataaattatgttaaactccaaaattaacctgattgttcacactcacacacacacactcacttgttcacactgtatgcactatataagagataaacacagacacacacacacactcactcacactgtatgcactatataagagataaacctaaagtaaaatatcaaaaatttttttaatcccttatataaaattatcaactgatcattaaaagacaaaaaacttataagaaagtggataagaacagactattcatagaaaagaagatgcaaattgttaattaacatgaaatgatgttcatcttcaagtagttacaaaaatgcaaatgtaagctataatgaggcataattttttacttctcaggattggtaaaaatggtaaagactgatgacatctgatccaaataagaatgtaacagaatggcctcctttatatgctggtagaagcacaaattattttaaaaatacatataccattttattcagcaaatctcacttttgggaactaagtctacagaaatgcaagcattaatataaaatgagataacaaacacatacagatacacatacaaagatgtctgttacagaattgttggtaggagcaaatatttgactattcatcaataagtattgaataatttgtggaacacacttaatgtggaatattacgcagttataaaacaattgttctagtatgtttgacctagaatgacagtcatgatataaagtgagaatgatacaaaaatcaaagtgtaatgtatacactgtgatcctattttttaacaaaatgaaaaaggaaaataccctcataaaaccctatatatgcatgtatatatgtgtattttctatgcctgcagacctaacacgcataggcataggatgctgagctgaaagtatagaggtctcatatactccttgtgcccacagacaaatttccccactatcaacagttgctatcacagtggtacatttattatgatcaatgactctacacatcattgtcacccaaagtctatagtttagattaagattcactcttggtgttgtacatactatgggttttgtcaaatgtcttcaatccaaattatattacagaatagtttcactctcctaacaacttcactgttcattctttgtgcctctcctattcatccacttgctccctcttaaatcttgacaaaccacgaatctttttactgtctctagttttaccttttccagaatgttacatagttgcactcaaactgtatatagcctttttcagtttggcttctttcacttaataatatgcatttaagatccttccatgttttcttgttgctttatagctcatttcattttagaactgaaaaaatattccattgtctggaagcaccacagtttacttattcattcacctactgaaggacatattcattccttccaagttttggtcattatgaataaagctgctataattattcacatgggggttttgtgtggccacaaattttcaaattctttgggtatatagcaaggattgctgcattatgtcgtaagagattgtttagttttgtagaagaccaccaaactgtctttcaaagtggctgtactgtttaccttcccatcagcaatgaatgagaattctttttgctttacatccttgccagcatttactgtggtcagtgttttgggttttggccattctaatagggtgtcatggtatctcattgttgttttaatttgcatttccctgatggcatatgctgttgaataacgtttcatatgcttatttgctatctgtgtatcttctttgctgaggtgcttattcaggttttttgccaattttttattgggttgtaaattgtcttattttagatttttaagagttctgtataatattttggataatattattttaccagatatgtcttttgtaaatattttttccagtctgtggcttgtaatctcattctcctgatgctgctttttgcaaagcagaagttctgaattttaatggagctcagcttatcaatcacctctttcatagatcatgcctttggtattttatttaaaatgtcatctcaatgcccaagttcatcaagaatttctcctatgtcattctctaagatttttataatcttgcattttacattgaagtctatgatccattttgagctaatttttgtgaaaggttcaaggtctgtgtctagattaatgttaggggtgtggatgtgaatgtccagttgtcttagcaccatttgttgaaaagagactgctccattttattgcctttgcccgtttgtcaaaaatcaatggattatacttaggtgagtcgatttctcagctcatattctggtccattgatctatttgtctgttttttcactaatgctatagtgtcttgattactgtaagtttatggtaggttttgaaattgagtggtgtcagtcctctaactttgctcttttctttcaatattgaatttactctcctgggtctttttcctcttcacataaactttagaaccaatttgtcaatttctacaaaataacttcctgggattctgattggaattgcattgagtctgtccattcatttggaaagaactgacatcatgacaatattgagtctttctacccatgacctggaatatctctccatttatttttttctttttttgatattatttatcagagttttgtagttttcctcatatgtattttggacatttttttttagatttacacttaagcattttatttttagggctgctaacataaagtggcaatgggtttttaatttcaaatttcacttgttcattgatggtacatagaaaagtgattgacttatttctcttgtatcctgcaacttttatataattgcttattagttatcagagacttttttaccaatttaaaaaaattttctacatagacaattatatcatctgcaaacaaagactgtattattttgttcttaccaatctgtatacattttatttccttttttgtcttactgcaatagctaagttttgcagtaagatgttgaaagctgaagtgaagggagatagctttttttttattatcaggaaacctacaaatttcttattattaagtatgatattagctataggacttttgtagatgtcctttaagttgaggaagtccctctctattcctaatgtgttaaaattttttatcatgaatgggtgttgaatgttgtcaaatgctttttctgcatctattgatatgattgtgtgatttttcttcattggcctattgatgtgatggattagattaaacaatattccaatgttaaaacacctttgcatacctgaaattaaatccactcaattgtggtgtagatgataagtgctatccccaatagcaaattgaatccaataatgtataaaagtatacagttttatgtggaggatttttgaatctatgttcatgagaggtacttgtctatagttttattttcttgcagtgtctttgatttttgatattagggtaatgctggccttatagaatgagttgagaagtattcctcctgctcctgcttacacacactgtcagatagtgtggagcattgatacaatattgtccttaactatttgatagaattcagcaataaactcatctgggattagtattttttgttttgtaacatcattttttatttattttcttgaatagatatagtcctattcagagtttctatttctttttgtgtgagttttggtagattgtgccttttgagtaattgatgcatttcatataggttatcaaatttgtggatttagagttgctcataatatttgtttattatctgtttaatgtctattggatctaaagtgatgtctctgtatcatttttatatgaacaattttcacttaataccaatctaaatctacttccaaataacattataccactttataggaggtacaagtaatttatggtaataaaatattactaatttctccctcctaaccttttatcactgctatcattcatttcacttataaataaacatataagcataattgaatacatggttgctatcattatttgaaggtattaacttttatatcaattaagaataagaaaaacaggctgggggcgtgaagattaaccaccccatgtgccatcactggcaccaacaaatgctgtccagggggctgcatattggccaattctactcaccactgacagtgcttgtgtgcagcatctggtggcatgaggacaggtgcacctcaccataattttcactaacaaccagagcctaagccaatgaagaactctcagacaatgctgacattgatcgcatccaaatagaacatacagagacgacactactgtgctagcccagaattaaagccaaaacatcttccccaaacaatactataattacagctacaggaaaagtctttctctatgaaagaagccaatccatgaaattaaaagagaaactgttaaaatagatgcacagataaggtaaggacatgagaaatatgaaaattcaagaaaaaaatgacacctctgaaggaatacaatacttcttcagtaaaatatcccaaagaaatgtaaatatgttaaaaagcctgaaaaagaattcaaaataatgttcttaagaaaatgcagcgagatacaagaggacacagatacaaatacaagaggacacaatagaaaaaaaaaaatgcattgggaaggcaattcatgtcttcaatgagaatttcaagaaagagagacagatataaaaaagaacccggcggcttctagcccgcccgcccctcccccgcgcgtcggccctgccgagccggccggccggcctggctcccctccccggccccgacgggcgggcggactgccctgaggaggcggggaggggagggctggaccggccggcgggcgggcgacgatgccgaacttctgcgctgccgccaactgcacgcggaagagcacgcagtccgacttgacttggccttcttcagcttcccgcgggaccctgccagatgccagaagtgggtggagaactgtaggagagcagacttagaagataaaacacctgatcagctaaataaacattatcgattatgtgccaaacattttgagacctctatgatctgtagaactggtccttataggacagttcttcgagataatgcaataccaacaatatttgatcttaacagtcatttgaacaacccacatagtagacacagaaaacgaataaaagaactgagtgaagatgaaatcaggacactgaaacagaaaaaaattgatgaaacttctgagcaggaacaaaaacataaagaaaccaacaatagcaatgctcagaaccccagcgaagaagagggtgaagggcaagatgaggacattttacctctaacccttgaagagaaggaaaacaaagaatacctcaaatatctacttgaaatcttgattctgatgggaaggcaaaacatacctctggacggacatgaggctgatgaaatcccagaaggtctctttactccagataactttcaggcactactggagtgtcggataaattctggtgaagaggttctgagaaagcggtttgagacaacagcagttaacacgttgttttgttcaaaaacacagcagaggcagatgctagagatctgtgagagctgtattcgagaagaaactctcagggaagtgagagactcacacttcttttccattatcactgacgatgtagtggacatagcaggggaagagcacctacctgtgttggtgaggtttgttgatgaatctcataacctaagagaggaatttataggcttcctgccttatgaagctgatgcagaaattttggctgtgaaatttcacactatgataactgagaagtggggattaaatatggagtattgtcgtggccaggcttacattgtctctagtggattttcttccaaaatgaaagttgttgcttctagacttttagagaaatatccccaagctatctacacactctgctctttctgtgccttaaatatgtggttggcaaaatcagtacctgttatgggagtatctgttgcattaggaacaatcgaggaagtttgttcttttttccatcgatcaccacaactgcttttagaacttgacaacgtaatttctgttctttttcagaacagtaaagaaaggggtaaagaactgaaggaaatctgccattctcagtggacagggaggcatgatgcttttgaaattttagtggaactcctgcaagcacttgttttatgtttagatggtataaatagtgacacaaatattagatggaataactgtatagctggccgagcatttgtactctgcagtgcagtaacagattttgatttcattgttactattgttgttcttaaaaatgtcctatcttttacaagagcctttgggaaaaacctccaggggcaaacctctgatgtcttctttgcagccggtagcttgactgcagtactgcattcactcaacgaagtgatggaaaatattgaagtttataatgaattttggtttgaggaagccacaaatttggcaaccaaacttgatattcaaatgaaactccctgggaaattccgcagagctcaccagggtaacttggaatctcagctaacctttgagagttactataaagaaaccctaagtgtcccaacagtggagcacattattcaggaacttaaagatatattctcagaacagcacctcaaagctcttaaatgcttatctctggtaccctcagtcatgggacaactcaaattcaatactttggaggaacaccatgctgacatgtatagaagtgacttacccaatcctgacacgctgtcagctgagcttcattgttggggaatcaaatggaaacacagggggaaagatatagagcttccgtccaccatctatgaagccctccaactgcctgacatcaagttttttcctaatgtgtatgcattgctgaaggtcctgtgtattcttctgtgatgaaggttgagaatgagcggtatgaaaatggatgaaagcgtcttaaagcatatttgaggaacactttgacagaccaaaggtcaagtaacttggctttgcttaacataaattttgatataaaacacgacctggatttaatggtggacacatatattaaactctatacaagtaagtcagagcttcctacagataattccgaaactgtggaaaatacctaagagacttttaaaaataggctttcttatatttgatatttggaagaaaaagccgtaaggtgtatgtagaccacttaatcactaaatatctttgcctataggactccattgaatacattagccattgataatctacctgtttaaatggcccctgtttgaactctcaagctttgaagacctacctgttcttccagaagagaacgttgaaagtgccatgtttccttttgcgtgatctctgttgatggcactctggaattgtttcagttaagtcattttagacatagcatttattatcactgtggatctctacttgttgggtgttatgaattctttgaagaaatatattttgaagaggtgtgggaggaaggaatacattttataaaatgttgtagtgaagcccacaattgacctttgactaataggagttttaagtatgttaaaaatctatactggacagttacaagaaattaccggagaaaagcttgtgagctcaccaaacaaggatttcagtgtagattttgtctttcttgaacttaaagaaacaaatgacaaagtttgaatggaaaagcctgctgttgttccacatctcattgctgtttacattcctttgtggagcctacatcttcctaagctttttagcaggtatatgttgaacacttctgtttcatggttgagacagaatcagaggccatggatactgacaactgatttgtctggttttttttttctgtcttttttccatgactcttatctactgcctcatcttgatttataagcaaaacctggaaaacctacaaaataagtgttgtggtttatctagaaaaatatggaaaatattgctgttatttttggtgaagaaaatcaattttgtatagtttatttcaatctaaataaaatgtgagttttgtttaaagctaaaaaaaaaaaagaacccagcagaaatcctggaaataaataattcagtggatgaaattaaaatatatatatacaatcaagagttcaacaatagactaaatcaagcagaagaatttttgaacttggtcttttaaaataacaaagccagattaaaaaaaaaggtgggggggggaataaaagaataaaagagaatgaagaaagcctaatgacatataggacaccataaagcaaacaaatatttgaattttataagttccataagaataagaaaatggaaatgccatagacaacctatttattgaaataatatctgaaaaattcttccttcttgtgaaggatatagacatctagatatagaaagctaaaatatctactagtagattcaataaaaatataagtgttctccaaggcacattaaagttacactgtgaaaggttgaagacagagggagaattttaaaaatagcaagagaaaaacatcaagtcacatgttgggggaaatcccatcagactagcagcctattactcagtaaaaatcttgcaggccaggagagcatgagaaactatattcaaagtgctgagagaaaaatgccaatgaagaatactatgcccaggaaagctatcctttaaaaaggatggagaaataacatctttttcagacaagtaaaaactgaaggaaattcatcactactagatcaaccatacaataaatgcttcagggagtacaacatctataagtaaaaggatgatgtctactatttagaaagcacaagaaagaattaaactcacgggtagagcagatacactaatgaaagcaagaaagaaatcaaagcttgtcactacagaaaatgaccaaactgtaaagataaatattaaaagaggaaagagaaacaaaggatatacagaacattcagaaaacagctatcaaaatgacagtagtaagttctcacctattattaacaacattgaatgtaaatggtttaaattctacaattataaagtatagactggctgaatgggtagaaaagaaaacacaaaagacccaattatatgctgccaacaagaaattcacatcatgggtaaagacactatattagtctgtcctcatgctgctaataaagacatacctgagactgggtaacttataaaggaaagaggttaaatggactcacagttccacatgtctgggaaggtctcacagtcatggtgtaaaacaagggaagaacaaagggatatcttacatgagggctggcaatagaacttgtataaggaaattctcatttataaaaccatgagatctcatgagacttattcactatcacaagaacagcatgggaaagacccacaatcatgagtcaattacctcctactgggtccctcccacaacacatgggaattatgggagctacaattcaagatgagatttgggtgaggacacagccaaaccatatcagacacaaatagactgaaagtgaagtgacggaaaccatatcccatgcatatgaaagccaaaactttgcaggagtagctatacttatatcggacaaagtagacttaaagtcaaagaacataacaagagataaagaggtctagtatgtaatgatgaagggatcaattcattaacaggatataacaattgtaaatatatatggactcaacactggagcactaagatatataaagcaaatattattagagctaaagagagagatagactccaatacagtaagagttggaaatttcagcaccccactttcagcactggggagatcatctagagagaaaatcaacaaagaaatattggacttaatctgtgctatagaccaagtggacctagcaggtatttacgtaatattttatccaacagctacagaatacacattcttttcaccagcacatggaacgttcttcaggataaaccatatgctagtccacaaaacaagtctcaaaaaatttttaaaaatcaaaatcatgttgagtaccttcccagagtacaatggaataaaactatagatcaataataagagaaattttggaaactgtacaaatacattgaaataaagcaataggcttcaaagtgatcattagattaatgaaaaaatgaagatcaaaatgaaaaaaaatctgaaacaaatgaaaatgtaaacacaacatacccaaacctatggaatatagtaaaagtagtgctaagagggaatgttatagcaatagccatctacatcaaaaaagtggaaagatttcaaataaacatcctaacagtgcaccacaaggaactagaaaagcaagagggatccaagcccaaaattaatacaaagaaggcaaaaataaagagcagaaaaaaaggaaatagaaactaaaagctaaactaaactaaataataaaactattaacaaaacaaaattttatttcttgaaaagataaacataaaccacttggaaaataaaataaaaataaaatcctagaaaaaatttaaccaaggagatgaaaagataaaaaataaaccactagctggactaactaataaagagagaagacccaaataagtaaatcagaaacaaataaagcacacattacaactgataccacagaaatataaaggactatcagagattattttgagcaactatacactaacaaattggaaaacctagcggaaatgaatcaattcctaaatacatctaccctgtcaagacagaaccagaaataaataggaaacatgaacagaccaataacgagtaacaagactgaatcaataataaaattctcccaaaaaagaaaagcccaggaccagatggctttatttctgagttctaccaaacttttaaagcaagacaaatgccaattcttctcaagctattcttaaagaaaaaaacgaaaaggagagaattcttcttaattcattctacaaagccagcattaccctgatagcaataccagataaagagacaaccaaaaagaaaactacaagccaatatgcaaagtttctcaacaaaatactaacaaactgaatctaacaacacatctaaaaaataatagaacataataaagtgggatttatcccaaggatgcaaagaaggttcaacatacacaaatcaataaatgtgatacatcacttcaaaagagtgaagaacaaaaaccatatgattatctcaactagcacagaaaaaaagcatttgatataattcaagaactctttatgatgaaaactcttaacaaattggcatagaaacaaagtattgcaactcaataaaggccatatattattaacccacagctatcatcttacagaatgaggaaaaactgaaagtctttcttataataactgaataagacaaggatgcccacttttaccactcctattcaacatctcactggaagccctagccagagcaattaggcaagagaaagaaataaaagatgtccaagttagaaaagaagaagtcaattgtccctctttgcagatgacatgattatacatagaaaaatctaaatactccaccaggaaactcttagaactgataaatgaattcagtaaagttgccagatacaaaattaacatacgagaatcagtagcatttttttatatcataatgaactagctgaaggagaaatcaagaaagcaatctgatttacaatttttgccaggaaaataaaataaaaataaaaacctagaaataaatttaaccaaggaggtgaagacctctacaatgaaaactacaaaacactaatgaaagactgaagagaatacaaacaactgtaaagatataatatgcctatggattggaaaaattaatattgttaaaatgaccatactacacaaagcaatctacaactttaatgcaatccctatcataataccaatgacatttttcacagaaagagaaaaaacagtcctaaaatttgtatggaaatacaaaggacttgaatagcaaaagcaatactgctcaaaaagaacaaagctggaggtctcatactatataatttcaaaatatactacaaagctataaccaaaacaacatagcactggtataaaaacagacacatagaccaagggaatggaatagagaagccagaaataaatcaatgtatttacagccaacttatttttggcaaatatgaaagaacatacatgggaaaatgatggtctctttaataaatagtgctaggaaaactggatgttcacaggcagaagaaggaaactagacccctatctctcaccatatataagaatcaacttgaaatggataaaagacttaaacatgaaacccagaaatataaaaccactagaagagaatataggagaaatgcttcagaacatttttagggaaagatattgtggctgagatttcaaaagcacaagtagcaaaaacaaaaagaaacaaatgtgactgtattaaactaaaaacttctacacagcaatggaaataattaacagagtggagagacaacctatagaatgagacaaaatatgtgcaaattattcatccaacaagggattaattttcagaatatataaggaattcatacagctcaacagcaaaacaaaacaacaacaaaaacctgattaaaaagtgagcaaagccttgtagcatagtttgaagtcaggtagcgtgacgcctccagctttgttctttttgcttaggattgtcttggctatacgggctcttttttggttctatgtgaaatttaaagtagctttttctaactctgtgaagaatttcagtgatagcttgttgggaatagcattgaatctataaattgctttgggcagtatggccattttcacgacattgattcttctttccatgagcatggaatgtttttccatttgcttgtgtcctctcttatttccttgagcagtggtttgtagttctccttcaagaggtccttcacatcccttgtaagttgtattcctagttattttattctctttgtagcaattgtgaattggagttttctcatgatttggctctctattattggtttatagggatgcttgtgatttttgcacattgattttgtatcctgagactttgctgaagttgcttatcagcttaaggagttttggggctgagacgatgaggttttctaaatatacaatcacatcatctgcaaacagagataatttcacatcctctcttcctatttgaatatcctttatttctttctcttgcctgattgccctggccagaacttccaatactatgttgaataggagtggtgagagagggcatccttgttttgtaccagttttcaaaggaaatgtaaccgaacagcatggtaatggaaccaaaacaaatatatagaccaattgaacagaaccgaggcctcagaaatagcatcacacatctacagccatctttgacaaacctgacaaaaacaggaaatggggaaaggtttccctatttaataaatggcgctgggaaaactggctagccatatgcagaaaactgaaactggaccccttccttatgccttagaacaaaaattaactcaagatggattaaagacttaaacatacgacctaaaaccataaaaaccctagaagaaaacctaggcaataccattcacgacataggcatgggaagacttcatgactaaaacaccaaaagcaatggcaacaaaggcccaaattgacaaatggtatctatttaaactaaagagcttctgcacagcaaaagaaactataatcagagtgaacaggttacctacagaatgggagaaaatgtttgcaatttatccacctgacaaagacctaatatccagaatctacaaggaacttaaacaaatttataagaaaaaaataaacaaacccatcaaaaagtgggcaaaggatatgaacagacacttttcaaatttatgcggccaacaaacatatcaaaaaaagttcatcatcactggtcattagagaaatgcaaatcaaaaccacaaagagatatcatctcacaccagttagaatggcgatcattaaaaagtcaggaaacaacagatgctggagaggatgtggagaaataggaacgtttttgcactgtttgtaggagtgtaaattagttcaaccattgtggaagacagtgtggtgattcctcaaggatctagaactataaataccatttgacccaccaatcccatatacccagaggattttaaatcattctactataaagacacattcacatatatgtttattgcagctattcacaatagcaaagacttggaaccaacccaaatgcccatcaatgttagactggataaagaaaacgtggcacatatacaccatggaatactatacagccataaaaaataatgagttcatgtcctttgcagggacatggatgaagcaggaaaccatcattctcagcaaactaacacaggaacagaaaaccaaagaccgcacgttctcactcctaagtgggagttgaacaatgagaacatattggcacagggaggggaacatcacacattggggcctgtcgcagggtgggggacaaggggagagatagcattaagagagatacctaatgtagatgacgggttgacgggtgcaacaaaccaccatggcacatgtatacctatgttacaagcctgcacgttctgtatcccagaacttcaagtataataataaaacaaaagtgagcaaaggatgtgaatagacatttatgaaactaaaacatacaaatggccaataagtatgagaaaaaatgctcaagatcactaatcactggaaaaaaatgcaaatcaataccacaatgagctatcacacctgtcagaatggctattatcaaaaagacaaaagataagtgttgatgaggatgtggagaaaaggaaaccattggaattgttggtgggaatgtgaattagtacagccattattgaaaacagtatgaagtttcctcacaaaattaaaaatggaactagcatgtgctcctgcaatctcactaccaagcagttatccaaaggaaaggaaatcagtctattaaagggacacctgtaacttaatgtttattgcagcagtattcacaatggctaagacatggaattaacttaggtgtccatcaacaaacaaatggatgaagaaaatgtagtatatatacactcaatgaaataaccttcaggtataaaaaaagtatgaaatcctgtcactcacagcaacacagatgagcctggaggactttatattaagccaaatcggtcagtcacagaaagataaacaccacatgctgtcatttatatgtgggagctaaaacataattgagttcatggaagtagagaataaaattgtgggtattaaaggcacaaaagggtaggagggaggggacgatagggagaagttggttaacagatgcaaaattataactagataggaggaattagccctggcattctgcagcactgcagggtgaacatagtttaccataatttattgtatatgctcagaaagctagaatagaggatttggattgttcataacagaaagaaatgatgaatgttagaggggatggatatgctaattaccctgatttgatcattacacattgtatatcacatatggaaatatatcactgtgtcatccataaatatgtacgactattgtgtcaactaaaaataaaaggaaaaaaagtaaaaataagggaaagtatttattttaccttcacttattctctgatgttgttccttcctttatttagatccatgtttctaacttatgtaattttccttcttcctgaatagcttctgctaagatttcttgcaaggcaggtttacttgtaacaaattctctcaatttttgtttgtctgagaaaggctttattcctccttcacttttgaaggctaaattcacagagtacataatttaaacactggttttttactcttaacattttgaatatttcattcctctctctttttgcttgcatgatttctgtggtgaatttggatgtaattcttatctttgctcttctataagtaagttgtttcttttctccactttgcattcttttctagatattttcttcatcccttgatttttctttttctgtctcttctccttttttatattcccattacatgtatgctactccttttgtagttgtcccacagttcttagatattctgttcttttttatcagtttttttttttttgaatttttgcttctcagttttggaagtttctgttgtcctatcattagactccaagattctttcctcagctatgtgaagtctactaatgagcccatcaaaggcatattttctttctgtttttgatctttatcattttaaaattatttcctagaattttaatctctctgcttaaatttcctatctgttcttgtctgttgtctaattttttcattacagctctgacagctctgagcatattaatcatagactttatttattttctttttttgagacggagtctcgctctgttgcccaggctggagtgcagtggcacgatctcggctcacagaaacctccacctctcaggttcacgccattctcctgcctcagcctcctgagtagctgggactacaggtgcccgccaccatgtccagctaattttttggtatttttagtagagacggggtttcaccgtgttagccaggatggtctcgatctcctgacctcgtgatctgcctgccttggcctctcaaagtgctgggattacaggcgtgagccaccacgcctggcctcaatcatagacttttaaaaagatttctgttctgataattccaacctcatggccataggtaagtctagtccttatgcttgctctggctcttcaaactgtgtgttttgccttctagtatgccttgtaattttttttttcatagctgattataatgttctgagtaaaagaaactgtgataaacaggcctttagtgatgtcacaatacggtgtggaaaaaggggatgtgttctataagcctgtgattaggtcttagtcttttggcgagcctgtgacctggactgtgaactttcagtgctgctcttttttttcccctccttaggtggtacagggcagccttccaacatgtgaaaaactagaggacccttgagctgggtatttttttccccaggcagatcagactctgataaaacctcagaaggttaggctctggtaaaatagtcacccttgagtttaggccctttaaaggagaacagactattcagctttttagaaattagtattttttttttgagacagggtcttactgtcacccaggctggagtgcagtgatataaatcatggctcactgcagccttgacctcctgggttcaagtgatgctcctatttcaacctgagtagctgggaccaccagcatgtgccaccatgcatggctaatttttttgtaattgtttgtaaagataggatctcactatgttgtccaggctggtctcaaacttctgggctcaagtgatcctcccacctctggcttattttataatagttttttcccctcctcctaccagaagcacaagaggactttctcatctgatacttactgtgaggacctagtagttagagctcctaaagatcaaactcataaaagtatatagcccccacaactatgactgggtacccttggagtttttaattctctaagttgtttcacactgagccttcagcaatttgccaattacagtttaattttttctacccccacaatggttgctatggaggtttctgctcatggatctctgcttcagtaagttgtggttctatctgtttctctaatttggggatcctctctttctctccaactttagggcagtggtttgccctgtgacctcacttctctgatctaagaagagttgttgatttttttttaatgggtttagctttttacttttaagtatggattggcaacttctaagcttcttatatgccaaatggaaaagtagaagttctcaaaacaactattttatactaatattttattgatttatatagtattaagtattataattaaatgctaagtataacttagtgttaaggaattgacttagtcaataagcaactgaaatggtgggagaaaatatacacgagtacataagaaactaaactactagtttggagtcttcattgttctctgggcattagtgaatatgttttgacagaaggaatagaaactattgatcatccagaaagtcagttaaatgacagttaaacttctggtagataagtgtgttcaagtgtctacatatgcattcacatttaaatataggcttctacatagtacctttttctcttaatgttttattatagatttaccacttgtttatgaacattacctgaaaacaaatatatctgcttaatattttattttattttccatcatctattttaccattccattattagctttcttttctattttagctgttttctttatgtagataaattttgaacaagactcaatttacttgaccttttaattggcatttactatggaccaccacttcctcaaaacaatccattctcttggctttccttctaactctctggctttactatttgtctatttgacatctgttcctgaatctttgaaagtcagctcaaacgtcatctgtttaaaacctaacacataatttatacactccacctcttcttctatttcctatctcaatggcaacacaatactgatggtaaccagcttaccatagttaggcttataatttttgaatttacaatgggcttattggaatgtaaacccattgtaagttaaggagcatctgactcttttgttgtactcaccagacaactcaagaatgatccttgatatgtccatcttgcttaatttttattttcaaatcacattaaatttgcttatttctcaaatctattcatgtatttctagattctctcttactatcaagtgcaataaataattatgttaagcactgactatgtaatagcctcataaagattcacccatatactttcttgaatctctccaaaccatctggcatatggctgttaatatgaccattgaaaaaagtaaactagaaaaactgttcccatgtttgtaagtacaaatacattaattattgcttttaggattgatacaaaacttcttaaaatatccttaaggccacacataatttggtctcttccagctctggctttatgtcaaaccagttctgtctcttcctctctcagccatattcctactttcccttgctctcttctttctagccacatacaggccatgatccctctctcttcaaagtagtcacctatactatttgctactgaatcccccttttccctaaggtacttatgattgagatctcttgtgaagtatccttctccgggaagtattcattgaggtttttaagtaaaatcttcttgtataggcttcatggcagcatatatcttgtattcataacagttctcaagttgggaattgattgctgttattggattaatgtttttgccaccaaataataaacttcttgagggaaggagccacgtatgattttgatccctgttgtattcctaatactaaatggcacatggtaaatgctcaaatatttgatcaaagaataaatgactttaatttaaactaagaattaactaataagtcatactataatctgctaagctacctgacaaatggtaaaaattgtagcaattgagatagaattccaggaacaatatacacctttttcaaatttcatacagagtagattttctaaaaaataagcagcgcattttaaaaggccccctaaataaggcttcagatggcacaaggccatggataggttgtcatagtgatgatcagaaatgaaaaatatttctactttacttgaggtaaggagtttgaggacagcctggccaacatggtgaaacccagtgtctactaaaaatataaacattagctggctttggtggtgcatgcctggaatccagttacttaggaagctgaggcaggagaattgcttgaacccaggaggcagaggttgcagtgagccgagaccatgccactgcactccagcctgggcaacagaccccatctcaaaaaaaaaaaaaaaaaaaaagcaatgaagtatatttctatagggaccaactttatttatagcaagagacatgagactgaatatattctatgccaaaactttccaatccttagaatcagccctacaaaaagaaagaaaaaagaacagaaaggaagcagcaatcagctatgagcaataattagacattcgtttgctagctctagcacatgtgaccatgaagagtaactgtgaaccatattgactttctctcctgaaaagaaaaatatgaaaaaaattcagaagaaaactgtcctatcacaaagaatacagaaattgggtaagaatgaacagctgtttcatttcattacctttgcccttttccacctttatttttggacaattagttgatctaaaaagcaatagttctctatcagtcagtttttgctacaaacacatacacacacagaaagagagaaaggcatacagtaatatgcatttaccttaggttcacaggtatgcagtttggctgagttcgattacctccatgtgtttcattctaagtcataagatggaaggagcagctgtatgggagttttaacatatgcacaaagatactccaccttacaagaggtacagcttaaattccctcctcttgagtgtggattagaattagtgactcactgcaagcaactgaataatgaggaaatggcagtgtgtgacttccatgtaataaaagacatggcttcctccttgctttctcttacattgatacttgggggaaagtcagcaactatcttggaaggatattgaagaaagcctgtggagaaactcatgtggtgagaaattgaggcattctgccaatacctgcatgaataggtcatcttgggaatagatcctctaatcctgatggagtccagatgactacagacatgaccaacatcttgactgcctcctcatgaaagatgaactagaagctcccggttaggcagcttccaaattcttgatccacagaaactgtactgaaagcatcaatttcttaccacatgtcttttggacaaactcaacattaatggacagaggagcatacttctctatagtaggctaaataatggccacccagataaaaaaattctaatctgaaaatgtataaggtaaaggaatctacagatgtgattgaattaagaatgttggtgtgataagtttattttggattatcttggtgggccctaaatgctatcacaagttccttctaagagaaaagcaggagaagacttgacacccacacaaagaaggtgatgtgaagatggaggcagagactggagccactaggccacaagccaaggaacactaaggaatgctggcagacaccagaagatagaagaggcaaacaatgcatgctctcccagagcctctagaaatgtgagataataagtttttattgttttgagcctccaaatttttggtaatttgttacatcagccatatggaatgaaaacatcctctcatttgttgagtttagatgttaaatactggctgaacaataatctactctactttagcatcttttcaaaaataatcacaaaatttaaaaggaaaattatgcactggtactagcaaaataaatgaacaaatgaattaacacaaaataggcaaaaggaaaatgaagtatctagaccaaagtttaattatccatgaaagcaatggaaaatgtgaagtctctaagaaaccaatgtaaaaagagctaaaaacaatatagtatgaaagaaaccagaaagaaacaaatgttctttggattttggggaaatacagagactaaaataaaaaccagaaatgaatactccattaaaacaggcatatgaaagacaggatgggtaaaaaccacacaaaacgaaattgtgtgtttgtgtatatatacgtgtgtacacacatacacgaaaagaaaaagttcaatagaaggttcattttttatgtaattagtgtttctaaagaagatacttaaaatgtaatttaaaaattcaaagatagaagaaaactatgctgaaattaaagaagatataattctacaaatgtaaagaacattatgtattttaagaacttgaaagaaaaggagtggggaagtggccaagatggccaactagaagcagctcgtgtgagtggctctcacaaagagggacaaaagggcgagtaaatacagcaccttccactgaaacatccaagtactcgcactgggactaatcaaggaaacaacttgacccatggagaacatagaaaacaaaggcaggacgacagcccacctgggcacgacacccagccaggtgaacctcccctgcccagagaatcggtgagtgaatgtgtgaccctggaaaccacactcttcccacgaatctttgcaacctcgagttgggagatcccctcttgaacccactccatcagggctttcagtctaatacacagagatacgggagtcttggcagagaagctgctcaggcacatgttggagaaccaggaactgtagatattccaccttcaggcttcccggcaaaagtaactgcaactccagaaaagcaggagattagatccttgtgcatacccttaggaaagaggctgaatccagtgggccaagcagcgatggtctgtaggccctacttccatggtgcctcaaaggataagacacattggcttggaattccagccagccaccagcagcagtgttgtgcctacctgggacagagttcccagggagaggggaaggccaccatcttcactgtttgggcaagtcacctttttcagcctgcagactttgaagagtccaaaccgatcgggcagaagggatcccccaacacagcacaattgctctaccaacacgtggccagactgcttctttaagcaggtccctgagccatccctccttattgggcaggacctcccaaccagggcctccagccatccccgctggtgttctctggcctacagagatttgaaaactccctgggacagaggtctcagagggaggggtgggctgacatctctgctatttgggtactgaacctgtccagcctgtgggctttggagagcccaagccaacaggcggtgaagcgttaccccagcactgcgcagctgctctacaaaagcatggccagactgcttctataagtgggtccccaatcctcttcctcctgactgggcaagacctcccaaccaggatctccagccacctcctgcaggtgcgttccacctggcaacaggttcatacctccctgggccagagctcttagaagaagtggcaggctgccatctttgctgttttgcagccttcactggtgataccttcagctaccggaaaatccaaggcaactagggactggagtagacccccagcaaaccacagcagccctatggaaaattggccaaattgtgccagggggaaaaaaaaaggtaggcaacgtcgaacattgaaggtagattagataagctcacagaaatgagaaagaatcagagcaagaatgctgaaacctcaaaaagcctgagtgccctctttcctccagctgacctcattacctctccagcaagggttcaaaatagccagtatagagaagtacttaatcctcctgatagggctgaaaaacacactacaagaatttcgtaatgcaatcacaagtattaatagtagaatagaccaaacagaggaaagaatttcagagcttaatgaaatatggcaggcagacaaatgtagagaaaaaagaatgaaaaggaatgaacaaaacctccgagaaatatggaataccatatcacaccagtcagaatggctataattaaaaagtcaaaaaataacatgctggcaaggttgtgaagaaaaaggaatgcttatacactgttggtgggaatgtaaatcagttcagccattgtggaagatggtatggcaatttctcaaagacctaaagacagatatactattcaacccagcagtcccattactgggcatataaccaagggaatataaatcattctgttataaagacacatgcacatgtatgttcattgcagcactattcacaatggcaaagacatggaatcaaactaaatggccatcaataatggactggataaagaaaatgtggtacgtatacaccatggaacactatgcagccacaaaaaagaatgagatcaatgagatcatgtcctttgcagggacatggatggagctggaggccattatccttagcaaactaatgcaggaacagaaaaccaaataccacatgttctcacttataagtggcagctaaatgatcagaacacatggacacatacaggggaacaatacacactggggctttttggaggatggagggtaggaagagggagaggatcaaaaaacaattaatggatactaggcttaatacctgggtgatgaaataatctatacaaaaaaaacccatgacacaagtttacctatgtaacaaacctgcacttgtacccctggacttaaaataaatgtttaaaaaatagagaaagaaaaagacactaaaaacatgaaaagatatgaaagcatataactcactgtaaagataaagcataaaattcaccataaagataaaatatagtcaaattcagagggctgtaatgaatttgtatgtaattaagtgtatactgtaattatagtttataagttacttttcctctactataagagttaaaagacaaaagtattaaaaaataacttcacctaaaaaaaagaacttagccaatgtcatgttttatactagaaaatactgcagttcagtcttataatcctggcttttctcttctgattttccatatttataaaatatttgaagaaatttgtttcttatgtacatcttgacatatgtgatatatgatttgtttctttttattttttatttttttctgagacagagtcttgctctgttgcccaggctggagtgcagtggcgtgatctcagctcactgcaagctccgcctcccaggttcaagcgattctcctgcctcagcctcccaagcagctgagattacaggcatgtgccaccacacccggctaatttttttttttttttttgtatttttagtagagatggggtttcaccatgttggccaggctggtctcgaactactgacctcacgatctacccactttggcctcccaaagggctgggattacaggcataaggcaccatgcctagctgtgatttgtttcttatttgcatctggacatatgtgacatgtgaataagaaacaattattgggactttggtcaagtaattctattctttgttaaatcaaaagatggccatctaagtttctttccaacaccatgtatctataattcttactctgagccattcttctgatagggcatgaatgaaaagaattttagaaagcaacagtaattggcaatcatatagatctatattagatgcattaataaaatgtactaaggtcgatgaattaataactgtgacctctataggagtcaaccttttaagggtatagtaacacatttacattccatatcaagcattaggtaaaaaataatcaactggtataacattatctttctgtggatctgccaaaaataagttttattaataacctagaacagccacctaaccaatatggctttttaaatattcatgtgtcatgcaatttgctaacatgttgcaagaaattggcattcattatgtgacatattgtctcatacgatatttttggtgaattggaagataacatatagagtagctacacgtttcaccttcttttttgaaggatgacatggtaaaaattaaatactctatgttttatcaaagaaaaaattatgtatgagttattgtccttggggtatggggaagtcaacatgaaaatgacttaataggcaaatattaattatccactaaattttcaggaatatgtacaatggcaatgtgaagatagttattgaaaatgtatcttttacacttgagatgtatgtattcagacacttcttgcagataaagctgatagtatatacattttaaaatcagggtaaacccagacatcatcatgcttttcacaggtgataagagtaatgaatacttttctgagaggcagatgaggattcaaagcccatgactaaatcctgccattgctccacttcttatcctgtttctctggagacattacataggctaagattgctttcagtcccagaagctctgatagcatggagttgctagtttgctggacagagctagtccaacccggtgcataagaaaatctgaaaccttaggaggtttttcctaatatcaactaaattattgatttagataatctctaccttcttctactacattccttgtaaatgaaaaaaaaaatagcgcacatatcagtctgctttctcactcctatgtttataatacacacatataattacactgtctcaggaaaattctacctcaaccatcccagaaaattggattgctaaaaatgttgtgaacaaatttcaaccttaattctcactgtcaatttcaaagtactaatgcagatggttttatattccttgcacatccaattaattagttgtgactgttgaaaatactatgttgattataagcctgtagtctcagctcaactgaaaagagtgtaaaacagacaactgatatgaaggggtaaagggtttaggtatgttatacatttgtgattctttctcttatgtgttgagctttgtatggatcccttcattctaatataaattccttttcttgttatttgttgatggcaggaaatttgactgaataacctcttaagttcatctcaacttaatgacttcacattttataatactttgtctataaagcataacttctaaaataggtacttctatttccctagatgagccagattctcttagagaattctgggattcaattatgggatctgggaggggctctaaatatgggaggatttgtgtatacacttatttatccttcaactatagaaaatgattcctcatgcttagtcagctgagccaggcaaaacttattttccttaaaatgcacatataaatatcagatattataagattattattttttataattacaagatattagaaaagtactcagttttaaccatattattttatgttatttattacaggacagcatgaaagaaattggtagcaattgcctgaataatgaatttaacttttttaaaagacatatctgtgatgctaataaggtaatgataattatttggagtttgtcattcaagcttgattttatagaagcttctattttttgtgcctctgttagacaattatatgaatactattaatatttgcagcctgatcacataattcccattgattaaatcatactatggcccaattttatatttttgttttacaaatagtcctgtgcttattaaataacaagttttttttgtttcaccattctattttttaccttgaaaatactagaattgtcgaattcaaagacacacctatctcttattttctttctttctttctttttttgtttttttttttggaggcagagtttcgctctgtcaccaggctggagtgtagtggcgcaatctcagctcactgcaaactccgcctcctggtttcaagcgattctcctgcctcagtctcccgagtaactgggtctacaggcatgcaccaccacacccaactaatttttgtatttttagtggagacggggtttcaccatgctggccaggatgatctcgatctcctgacctcatgatccgcctgcctccgcctcccaaagtgctgggattacaggcgtgagccacggtgcctggcctctaaatttcttatacagaaaaatacttgttaatgtgaatgcttgcacacatacaaatataagtcattggtataatttagttggaagcgtcttgaaaatttttctttcaatatttgcttatctctaaatgattaccacatctagttggtataatattacactttaaaaaacctaaaaagtttatatcatttctccctacagaaacaagtgtgctatttcatagtcttttaaaaactcacagtagctaagttagcctcatggcatctcacaaccataaattcttttttttaaatttcttaatttaaatatctgcaaaacttatgttttaggtgactacagtcctttattttcttattatcagctattcttccatagctcaaaagatgcaagaaatactaagaaaaaaccacacatacctcttataatacattgttgcttccagaagtcttctccttcggttatcatgtttaaaattgaataatcttctaatatgttcacacataagtgataagatcacataagcataatagagaaaacaaactttaaaagtcaagataattattaaaccaagttctaagaacttcatgctgtcacctaggagccaaacagttttagttctgttacttgtcaatcacatgattaactggaatagaaagctggggtggaggcggggcattacctagcaacatagctcaagctctaggctccttaagaaagcttataatttcttaatattttatttgaaccatggcccttctgactttttcctataataggaaggtatgtttttattccgtgctgctcgcaagttgaggcaatttcttaaaatgaatagcactggtgattttgatctccacttattaaaagtttcagaaggcacaacaatactgttgaactgcactggccaggtaagctaaggactatttactttgaataaaaatattaaatactcctgtgccaagataccactattctctgatgatcacatccattatcatagaatcctaagtgtttattatcatctaaagttgaagtatgtttactcaatcctagaagaggaaaggctcagtttggaaatacctatttatctcttggctagagtgaattgtttgtgaaaggggagtaaaaaataaataaataaattcttcattgccataataacttccaaggatactagggtgatatattgggtggggaatggtaaatttctatatctaaaacttattaatagctttaatccatatatgtacacatttacaagaactcctagtcaataaaacaggaaatcaaatgtatttaacaaatatctttataggcttaaactagacataaacatgtccaacaattttcccttctttaaataattttgatacaaatagggctaatattttcctacttttctactagtggttatgaactaaaacaacaaaaccaaatatggaagacatcatctagagactagacagcagtttccttatctacaaaatgcagaaaaacatatctacattgtgggatttgaaaggattaaatggcataacacatgtaaagtgcttagtactaaaaagttttcaatatttaatacagtgctttattttatttgtattatttacctctttttggattttaccagctgccacacaaaaccaaaagtttattttatggttttaaatattttcttaaataacatttttatgacttaaaaaagaattttgttttgtttgagcactagtagtttcccatagaaggtaaaatggtaagattatctttgaatcctattgacagtgataaaaatgtagattatctattatataacttggatagcctcatttatcattgctttatgtacttgatggaagcaagtctcctcttagtgtgctggatttgccaaacttatttccaaacttgcgtccttacgtttgtcccctagagagcatttctactttttttttctataaattggatctattttgttctatgccttcaaggctcggctcaagattcatgaagacttcctactctagtctaccatttcttcattcctacttaacagcggtttcaaagtactgtctaatgcagataggttttatgttgcttgcacatccaattaattagttgtgactgttgaaaatactgtgttgattataagcctccactcttggttcaactgaaaagagtgtaaaacggaaaactgatatcacctcttggtctactaagaggtaaaggtcttaggtatgttatatatttgtgattctttctcttatgtattgagctttatatggatcatcatgttccaaaattaactgtagagaaagaaaatatgcaaataatttaaatctttgaaattaaattatattacattgattaacttgatacaagtaacctttttcttgaaataacaaggcaagatgttaaagcagtcagctacactgaattttcttcatgagccaggcacgctacaagctttttactattgttttatttcattttgtttctgataagtgaagcttaataaaatgtatggccaggatttaacaatttcttgttaactttatttttatattgattaaaattcaagttttatctctgctagtataccctactatgttaatttttcatacctcacagtagttaacacagtactaggcagacctacaaaattatggattctgggtattcagaagactgaactatcttgcttcttcctttaccctgatattccatttctaaatcatattaatattttactttcttaacaataagaaatttaaagtagagtctcaaatagattagatgagctgaaggcaatatgaaaattagcaattacaaacaactggaggagcaatgaagaaatattcaatattataaatgtgactttgtttttaaggttaaaggaagaaaaccagctgccctgggtgaagcccaaccaacaaagagtttggtgagaataattgtataattttccttatggttcatcaggtttttactcaacttaattcctaatttttcattttgaattgtttccttcttatagctggttttgaaataatttattataacattgataaaaggagaagcgaggtgcccctcaaaaatttgattcctttaaattgcatttttaaacccactattttaaaatagaagctgttagggcaaatacaaaagcatgattttttttttttttagaagaagcagcattaaaatattgcagctagcacgtaaaagaaatgaacaaataatttatataggagaaaataaactagatgacaaatacatgaagaaaaaaagccatccctgttagtttgtaaagaaataaaaattaaacaataaggacttatcttatatatacctcttttattagtgtagattgtacagtataaataatatataatagtatataaacatatatttatacatatactactagacattattagataaattatacaataatatggaaaatatttatgaatgacttaataaggcagaatacttaaatggatctgactaaactttaaaatgatataggtactaattaagttgaggcatggaaaaatgagcacacctggttcataaaagtgatggattcttcttttatatttccattatttgaccaatagctacatggcaacatggaaattccttactcttttcagaaaagcaaagtgagcctgtacactctgagatttaggaaattctagggattctatgcaaagtggaacatctgaagtgaatacagaagctaaaagcaatataatcaccctgaaggcttttcactaagagaatttggaaagtttagaaaagaaaggttgggtgcggtggctcacgcctgtaatcccagcactttgggggtccgaggtgggcggatcacaaggtggaaagatcaagaccatcctggccaacatggtgaaaccccgtctctactaaaaatacaaaaattagctgggcgtggtgcacgcctgtagtcccagctactcaggaggctgaggcaggagaatcacttgaacccaggaggtggaggttgcagtgagccgagatcgcgccactacactctagcctgggcaacagagtgggactccgtctcaaaacaaaaaacaaaaaaacagagcaaaaaaaaaaaaacaaaaaaaaaaaaaaaagaaaagaaaagataacaactattttcccaggatgcaggggtaaaaccaagattctctgttttttactttttagtgaatgcttattctcggtgtgcaaggaaaagtatgaaattttcacatctgtatatttcaaatctgcttaggcaaatcaacttcaacttgtacttaaaaaaattgtccaggaccccctattgaaaacaatatgaaaagtttgcctttatatttccctttgagatctgttgtttaatctttgaaatgtattctttaaaaagtatgtgctagtgttactaaatacatgacaaaaagagatctgaatttgtggccaaattaaaaataggacagaggagctcaagattcagtcattatatttacttgacatatatttatttacttgaccttagcagcttatttatcttctttgcggatcagtttcttcatctgtgaaatgagttcaaatcatcaagttcatatgatgattaagcaaataaaatgaagtaaattatgttaaacactgagcacaatatatgactgagagaatacccaataacttgttatctaaattatctagttacccaataactagttataatagtttttatattgcttgcacatccatttacttgctagtgattgttgaaaacactatgttgattttaaccctgaagtctgggctcaactgtgaagagtgtaaaacaaacaactgatatcacctcctggtctaggaaggggtaaaagtcactggtatgctttatatttgtgatcaactagttgttatctaagtgaagaattactctaccctgcactattcccattctcacaggtcagaggactcagagaaatataactgagtctatacagagttactcctttatatgtctgttcatgccaagtatctctttcttcctacaggttgtacaggtagccctttttaagattcttgtcaggtgctaaaacctagcttatgaggcaggcatctgacatactctggtgaaggttagttgttggaggagaccttagggtacaagttccatcagctatatccttattatctttggcaaaataatctgagtattttcaatgttgattattcttcccactaaaaatacatttttctacattaaagaaactcaactgagtaacctacaattacctttctcatgaaattccaaacagtgttattatgtccactgttaaactgtgaaaatggcggtcagctgatatagctctttggagaatcctaagtctttaatcacaccaaccttgaattttctacatgtcagttatcacaaagatagttagaaatcatcgtctttaaaatgtcacacaggattctaccttttcattgcaccagtttttcagtataaagtaatatgatgaaaaatagtattttaaaatatatatttttgtaaaaatgtgaagtttaaacttttaaaactctattctctaggaagaaaataaatctttaaaggaacagaaaaaactgaatgacttgtgtttcctaaagagactattacaagagataaaaacttgttggaataaaattttgatgggcactaaagaacactgaaaaatatggagtggcaatatagaaacacgaactttagctgcatcctccaagaatctatctgcttatgcagtttttcagagtggaatgcttcctagaagttactgaatgcaccatggtcaaaacggattagggcatttgagaaatgcatattgtattactagaagatgaatacaaacaatggaaactgaatgctccagtcaacaaactatttcttatatatgtgaacatttatcaatcagtataattctgtactgatttttgtaagacaatccatgtaaggtatcagttgcaataatacttctcaaacctgtttaaatatttcaagacattaaatctatgaagtatataatggtttcaaagattcaaaattgacattgctttactgtcaaaataattttatggctcactatgaatctattatactgtattaagagtgaaaattgtcttcttctgtgctggagatgttttagagttaacaatgatatatggataatgccggtgagaataagagagtcataaaccttaagtaagcaacagcataacaaggtccaagatacctaaaagagatttcaagagatttaattaatcatgaatgtgtaacacagtgccttcaataaatggtatagcaaatgttttgacatgaaaaaaggacaatttcaaaaaaataaaataaaataaaaataaattcacctagtctaaggatgctaaaccttagtactgagttacattgtcatttatatagattataactgtctaaataagtttgcaatttgggagatatatttttaagataataatatatgtttaccttttaattaatgaaatatctgtatttaattttgacactatatctgtatataaaatattttcatacagcattacaaattgcttactttggaatacatttctcctttgataaaataaatgagctatgtattaacactgccagattcagttaataaatctcaacagaatttttaaggtgagatttttaatacttcactgctctttaattttctactttcattgaatatatgacctttaatagcctattaccaacaatgaatatgagacattaccttctatgttaaattttagtcttttaaaagaaacttgtctggaaatgtctgcagtcttcattcactgataaagggaaatggaaacactattctaagcaggccagaatctacaaatagctgtcagtttgcattgcactgaactcacatccttcatgctctctcagcctcatcaccatctagttatgtgctgatgggctttatttgatctacagaagatgctctggtgacaccctcagtgtgtgttggtaacaccttcctgccttctctcactttccttgacccatatgacatttcaccttcactggtgcgatagctgtatagaattgtatacacttccatacaatttactgaactgccccattaacaggactttgagtcaagtatttttttctgtttggttatcactgttaactccagaaagatgagttgattaacattttttagaagcaaatgactcttcaccaagctttctttcttcagatggacttttctaagtaggttatgctccttccatcataaaacatggtcaaccatgtggtacacctctaccctgattactggagatattggtaaaccattagttagagaaatgagggaatttacatttctaaaggtaaactcttgaaactgtccttgaaaatgtttccttcaaggctatctataatgttccctaacagtgttaaaaaaatatattctctctgatgttatggtaaaataagggtcaatattttttaaatgcttgtttaaaaacgctattaaaattttcttccttggtttctgtcatttgttatagtagatttgaatttttgagaaaaattggactcaaacagtgtactcagcttgtactgtgtgccaaacgtttggaaaaattacccacacacttatggttgcatttcccttctttgtttcctagcctctaacaagataggttggctaataatgatttgggagagtataagtatatctactccacaattagagatttatctcaataaacattttcttttaaatatatatttaaatgctttaagtcagcattttctaaagtttgccccaagaaatgctaatccttgtcaatgctacaaaaagaaaaaaaaataaggagggaagatacttatttttgatgtgagttaaatattctcttggaggttcacaattcttataagtatattaaaatccctaaaaactcattcatgtagctgtgaaaaaaatttaatagtaatatagcctttctaaaacttaattgattatataaaacatttttacattaaaaatccctaacctaacacgaggttaatataattcatagaattaaagctaatataacagcaaggagaatctgctttatacaaagagttacggttaaaagtattttaaaacaggttttcagggaatatgctgaaggaaatactcttttcaggaataagataattttcttaaaattgatccatgggaaaactgaactagaaaagtttctttgctttaggccatactttcattgacagccaacttaagaaggacattttgttaaccctaccacgccatataaatatttctctagaaacacgtatcttgtactgtaggtcagataa

SEQ ID NO: 14604 - DNA, 34531 bp, Human
  misc_feature (1)...(34531): n = A,T,C or G
tctttttagatctctagcagggatggaatctcattctcatgaaatcataaagtcatggaatcaacaagtcttgtagctccccatctcaggcgtttctctctcctatctaatgaggaggttgtcttaagtgctcttttgagatccctttcacctctgttattctgtgattcttaggagcctttgaacttttcagaaattctctttaggaattttagccatgtctacaataacttatgatacattattcctctgcccataactgacatactggagggagaccagaaggacctacacaccggaaagaggtgggcactcttattcaagtcagacataattgatttctcactctaagcaaattctcaagaatttcggaggactcacaactatctagcacaggaaaggcgcatattaggctgctttcttttttttagaggtggggtctcactatgttgctcaagttggacttgaactcctgggctcaagcgaccctcctgcctcagccttctgagtagctaggattacaggcgcatgccgccatgtccagtataggctattttcattcatccctgtgaaaaactatgaatgggagatcattaaatagtggctctctttattatcatttgtgatgggaagaacttaaataggtaatgagtcactgtgggttctgtcccagtagtgtacctgggacctgagttaaggctgagagatggaacatgttgatgctctatcactatcagcaaggccaagccactgaaaaaaacccttttgtggttgtacagtagtggaaggtcacgtgctatggtaatacataaatctcaggaaaagtgactaaggaaaaactagtgtagaagttatatactactgaattgtgcaatttacccccccattcatgcagttcctggaaaatgagaacttaacaagaccccaaaaccgcaaaagcacttaatgttcagtcagcaaactcatgattactcattatatagaagagtttgttgttacaatagacaggaggagagaaagggtagccatgtgtcctcaggcaccaggaggaaggattgatttgtaagagttccaaacctgagaggcaatttagaagaactgactgggggctggggatgtgtgaaagttcgacttttatggattggtcatgtagtacaatattggacttcctcagaaaacttccggtgcaaaagtttcatttagctaagaaatgctacagaagtagtccctttctttcacagaatgctggcacatccatttcaggccaagatcgagaaatcacaaaatgtactgaggaagtcgatctttgttttcaggatatctgattactttgagtttaatttgggatctgtaaaaatgtcttcatttatgagaattgcctggcttgtattgatgattgctttcataaccaaatcaggtgatcttcttacaaagtaaggggaaggccaggtgtggtggctggctcatgcctgtaatcccagcacttggggaagctgaggcaggtggatgatctgcgatcaggagttcaagaccagcctggccaacatggcgaaaccccatctctactaaaaacaaaaaataaaataaaatataaaaattagccaggtggtggcgcattcctctaatcccagctactcgggaggctgaggcaggagaatcacttgaacctgggaggcagaggttgcagtgagctgagattgcgccactgcactccagccttcccagcagagtgagacttcgtctcaaaaaaaaaaaaaacaaagttgggggaagaacaagaaaatccaagtccaccagcctcgttataaataggcaacttgcaacaagccagccaagtatttgcataatatacatcgtgagagcctgctggaggcctcttcattttgcatggtgttccgagcgagagttatgcagggttgtgtgcgagaaactagatgcctctttacttcttaccattgtggcatcctgtatcaattccctctgtgtgcatttctgtttctcaggaaggaacctcaaaatttgcaaacctggacagcagtgtgaaagaaaaccagaagcgtacccagaggcggctgcagctccagaaggacatggtatgtctggccctcgtcttccctgacagctcacagaggagaagggccgtgtgcgtctgggctcccacatggcactggcaccttcagtcaacagggcacccaggctttcagaaagggtctcccattctctaccccatttgttctcagcagccctgggaggtctataggagagagatgattaccctcattcaactagtaggaagtaagcactgggtggcaaatcctgttttctggcaaagttgttttctgaaggtgagggggagtctacagcaggtcgacttcctccctcttgcagtctcttccgccccctcctgcacttagaagctgctccaccttggcctgagggcctcctgagcttcctactgtagtcagcttctgatacatggtgaccaaggagaaagagtgtcttctccacagggccctggtccttgtactcagagatcttttcatttgttctaatctagccattgcccagctctccttactaatcccaaggctaaccaaatctttatagtttttcaatatttaaaggagcatcatgcctccctcctgaagactgaaagataggtattatcaactttagcttcattttaaacttctgactgttagcataaagtgtggaagaccagagggaggagattagagactgacaaactctaaatattctgctttaagagggttttctctttctttggaaagctcaacgtaagtaagaaatgtttttgaatgataggactcttccgcaacatgaagcctataaaacattcacagtgttacaaacttttttggttgttcaaagacaagctaaaaatagctgttaccaaaaaaatagattattttagtacaggatgagaccttgtacacagaatgggaaggacacactgcagctgacagtgagttcctgaaggacaaaaccctccttggtatgaacctcacaaagcagttctggctgaggaagcagccagcctcatgtcaagcagcctggctttaccctgtttgaggctttgtgttctgccaaaatttccagaattggcttgatgagatttaggataagggatccatggggaccgctttttacttttcctttaggatgtttagtgccttggtggcttactgaagaagagagatgattttaaaggagatttagtgaaatgaatatagtgtatccctgcagttgtaggtagaagtgcctccaccttcatttccaactttttattctggaataagtttagatttacagaaaagctgcaaagctagaagtgcagtttccctcattgttaacatcttctaaaaccatagcacatttgtcaatactaagaaactgacactggcataatactattaactaaaatctagactttgtttggatttcaccagttttccactagtatcttcttatctgttccaggacccaatccggcataccaactgcattttgttgtctgtcacccctgtctcttcaggtctacgacagtgttttcttgactgttttttatgaccttggttgtcttaaggggtctatccaggtattctgtagaatgttccacagtttgaggttgtctgctgttttctagtgattagactgagcttctggatttttagaaagaatatcacagagtaaagtgcccttctcatcacatcacatcaaggagtgaatgaatggtttcagcgtgacatctggtgtcatgttgatggtgacacgaatgatgttgatctttattacttggttaaggaagagtttgccaggttcttcctcagaagttactgtttttctctttccctcctctattatttgagagttagtcaccaagtctagcccaaggggttatattaatagtgatgccccatgcttttgtggtacatacttctctgtgtacaacagccaatggtgaggcaatgactatccagtgccatccccaactaccaggaatgtccccatgctctgaaagagaacagacatccttctcacttgagccaaagcaaaacataaaccccacagtcaacacttttgaacagatgtgtatgatctcctggctttgaggcttggttttcatgatttcacaagttagatattagatcatggagtttctatcctatttgtgtagaaatttaaaaaatgttattcatggaggttagcaccactggcccgcagttaggccttgaatacatccatttgctccagcttgaagattcctaaaacccctcaacttttcaatgacaataaagacagttttgctttggatgctcttcagggtgtgatgcagggaactgtgccctacctgggcaccttcctgactgacctgaccatgcttgacactgcccttcaggactacatcgaggtgagttccatgtgggtggtgtgatcgggcctgcagccttcccactggataccctaaagagtagttaacttctcttagtatcttttgaaggtccaaaagtacatggcattgtgctagctgttaggaggaatacaaagaataacaccaaagactaacaccagaagtggctcaaaatccagtggaagtaattaatatatcaaaataagcagtgaacgatagtaataatcgaaattcaaacaaatgcattgagagaacatgggagatgacaattattattatttttttgagatggagttttgctcttgttgtccaagctggagtgcaatggcacgatcttggctcactgcaatctctgcctctcgggttcaagcaattctcctgcctcagcctcccaagtagctgggattacaggcgtgcaccaccacgcccagctaattttttgtatttttagtagaaacagggtttcaccatattagccaggctagccttgaactcctgaccacaggtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaggctgggtgtggtggctcacgcctgtaatcccagcactttgggaggctgagacaggcagatcatgaggtcaggagttcgagaccaccctggccaacatggtgaaaccccatctctactaaaaacacaaaaatcagccgggcatggtgacacatgcctgtagtcccagctactcaggaggttgaggcagaagaattgcttgaacccgagaggcggaggttgcagtgagccgagattgtgccactgcacttcagcctgggtgacagagcaagaccccatctcaaaaaaaagaaaaagaataaataaataaaaatacaaaaattagccggtcatggtggcaggtgcctataatcccaactactctggaggctgaggcaggagaatcacttgagctcgggaggcagaggttgcagtgagccgagatcgtgtcattgcacgatctaggtgcccagcctaggtgccagagtgagactcggtctcaaacaaaaacaaacaaacaaacaaacaaaaaaccccacaagactttaatgttgagtaggactacttggtggggtagagagtcagtcaaatttgtgatttttcaaatatgcttttctttttgtattgctgcctgctgtggggtatttttctctctctctgtctctctctctctctgtccccttgtccctctttctctctgttccccctctctctacccctactcccttcatcccccatcttctctgaaagggaaaatacatgaaaactcagataaacaacttgttagtagcagcaataaaatattaagtgaagaagaaatttcaaatttgaaatgaaattgaaagattgcttgcatatttcagtatatactacccccttgttatcatatgcaaccagcctgcttttattgtatcttaattagaagaagtagaagttactttgcatagatctacctacctttggatttgccacagtgttgtggacacatttattcattttgcatctcctgacttctatgtctcttcacatcctctttctcagcttatctcaggaaacacccatcagtgttggggaattctggggagtaaccaaagatttagaagttaaattcagcctactgagaataggagctgaggggatgaagaattgaaacttaacttttcatgatgctatggagaaatgacttcccttttgataaaccgtatgagtcaatgaccatctgttttagttgcttttggtaagggaaaaaagtgtaatggaatatttactcaagcttttatctttactggttctgcaagtgtctttggatcctgatttgtaattatttatcattactattttagttggtttcagacatttcaagagaaggctttctgcttatcctgccttataataatactttttttaaaagcaaaacaggactctcttcttccacagtagtcgtaattataggatcattgataattgtgactttatcacccctttgatctattttaatgtgacctacaacaacatatggctgtgttttaaagtagcttggttgctcactctttttattaaaatttcttttagggtggactgataaactttgagaaaaggagaagggtaagtagagttgttggctgtgtttcctttgtctgagcatgaaaaaaatgaaagaaatggggacttaagtttttttgtagaggcagaaaaaaatgagttagcacctactggaacgtttatcatataccattttgcttggcattctcctatacattatcccccactagccttatgaggtaggttttatcatcctcaattcaaaggtgaggaagctaggactcaagagattaaattactggacgagaatctcttggtggcaaagccagggttctcatcctgtcctgatgccccaaagcccacatttcttccctgcccactccttatctcctttacaattagcttcagcaatagcaggcttgccacttaattaataacaatgtattttatacttgaagattactaagagtagactttaagtattctcatcacaaataaatatgtgaagtaatgcatatgttagttagcctgatttagccattccacggtatatacatgtttcagaacatcatgttgcacaccataaatacaaacaattttttaatttgccaattaaaataaaaaccaggtttaccctattaaggataaggggtttctgatgagtaaatgacatagaagagttaataaagatggtaaactctcgtgggtatactcgagagaggaaaggaaatggccttcgtcttcggtgtaggtagttattctttccctttcgtgtcagcataggaaggtgtgctcaacatcaatttcactcttcctgtggatagcacagttctgaactgtgctattcaagataaaacagtcttgaaatttttctgtgattttcatattcaaatggcatatttaaatagatatttaaaagactcaaaggaaaatgagtgagcaaaataataacttcaccctgtagtactctcgttatttttcagtactttcacattccacaaatattgactgtctacctaacatggggggggtttgggaattacagcagagaaagaacagagctgcctgccctcgtaaagttcacaatccaggagagaggtagacaaataaataggcagttataatacaacctgaaaagggtttgtgagcagaagtagtgggtgttagagaagtatataggtggggtatctatctccaacttgtagggccagagaaacttccaggagaaaatgacgttgaagttaaaaccaaaaaggcatagaggagctaaacaaagctgggcttatcagaacaagatactaacctggacaaatgtaaattttttgtcccatatagacgatacttttttctttagcatgatggtaaatattccttgaggatactgagaccaagggccgaggtcactggatggcaagttgagacttggagaatctaccagttcttgagttacttctgtcatgtcctgtaatgataataaattcagttattgccccctcagttcccctctctgtcatttaacttcagaataactgtggttggtaatctctttcctttttagactaggatattaaacttctggaaagtttgactgtaaaacctaaacctaaagcttatacccattgctgacttaaattttttttattgaaacatccaaataagtataaataattttcaacataattatgtacttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggatggggatcttgggagctccctgacttaaagtatttcttttcttttttttaagaaatatgaatagaaattaatatattttatgaagtacttaaaaccttaaaaatcatttttctattccaaggatgaaagtgaagaagagaaaaaggaagccactgtaacttaacgtagtgactagtttgggttgctttggtagcttgttttatacaaattgctttctcaaggagaaaagaggattaaaaattaaagcatacaaggactttggagagttctagttagaatttttaagagttagttagctcctttatttttaaggaagcagtatttcagaatcctcctagatggttttcttcatcttttatcctaatgtggtatattttcatgttgaaagattctatatttggttggccttattattcagtcttttttttttaatttttggtattctgtctgctttaggaatttgaagtgattgcccagataaagctcttacagtctgcctgcaacagctattgcatgaccccagaccaaaagttcatccagtggttccagaggcagcagctcctgacagaggaggagaggtgggatcacctgtcgttcatcggggtagaactgaagtgttggcaagaaaaatgctgcatttaatacctcgctgggtcatttattcaacaactatttagtgagcagctgctaggttccaggtccttggttttcaaaggcgcatggtgtggcaggaaaggctgagttgatagcatcaagatgtactttcagactcttgcttggccacttatttatctttgtaaccttgaacaagtcatttgttcttccctatcttaaggatgctcatctgtagaatgtttgtgaggcgtaactaagatcttatgtgggaatgctttgttagaatgcttgtcctcagcgttgtcaccaccaccactgtcactgtgtttgtcattcctgttaattgatggtagctttccaggaagctttcaacctagaggggttgagagactcatgaaactttgaaatatgatgggtaactacattcctacaaaacctatgggaagaattggggaaaataaggaaaatataaaggcattaatatttaggctggctgtaaaggagaaacaagattttgccataagaaccggaagagaacattccagaccgagagagaacacaagcaaaagcttggtggcctgacatgtttggcatttgaaggaacagtgataactcaggtgtggcagggacacaaagaacagtttaaaaatagtgggatgggcatagaaaggcatgttcacttgagtgccctgcctgctggctcagcacgtccctgtcctgtagcctgctcgcttgttggcagattggtctgcaggccatatgtggcccactgcctgtttttacatttttaaatgattggggtgggggggaacaaaaaaagaatattttgtgacacgaaacagttatttgaaattcagatttcagtatctacataaatatggttttattgaaacacagcccgttcatttacatctcatctatggttgctttcatgctgtaaagacagagttgagtagttgcaacagagaccatatggcccacaaagcctaaaatactatgtgatcctttacagaagaaattggcccatccctaccctagcccaggggatttctttggaagtttatcataagggagagtgaaattgacagcaaaataagtatttacaaaaaaaaaaacttgaggtttagagaaatatttgaatgaattaatgacagcatttggattcaaactcaggtctgcccggctctacagcctaagctctgaagatggctgtataatgttgggcacccttccccacctactcagtaacgaaatacatctactgtctacagctacaagctttcataaaaggcacttggaatcacatataaattcctcttgtgcttgtgtcagttatatctgcctggcagatagaggtctgaatctggagcatttttaatttaggaagttttggcaattaaaaatttaaaaaagtatttgtaggccaccctggccaacatggtgaaaccccatctctactaaaataaataaatatatatatatatatctttatcagtaatgtaattgcctatgtctgttcattgacgatcagatagattacaaaagtctcttcattttctttagataaaactaagtcatttgtgcatgtgcacaaacacacatacaaaatagtaggaaggaggtaatagagaagaaataggagggggaggtagtagaggaaggaagattcttccactggcctagcagtgggatgagaatgatcagaatggagttagtttttgatgctgccaaagtgcatatatccttgtatttgaaacacgcagaactaaatagcctcaatccatatgccagtggaggtgagggaggaagcacataagataaatgtgtcaaatcgggccgtgaagtcagtaccccctgacgtttatgataggacaacgtttgtatatatctttactttgaacaattagagccttctctaaaacaaaaccaggacatcatgtgaatttaagtgtgtttttcaattctctaactttgacctcatggagcccccttctctttctcagctatgccctgtcatgtgagattgaagcagctgctgacgccagcaccacctcgcccaagcctcggaagagcatggtgaagagactcagcctgtgagtgtcccctgggggttctggggctccaagagggtgccatcagagtcgtgagaggagatgtattcaacaggatgaccttgagccagggtgaaagtgaagagcactccgctcatttgttaagccgtttatccttctgtcatgaactcaaagcatttgctgagtccattcttctccactcccctctctgttgtgaatcaccattctctcctgcctgaatcactccagtaacatcttcactgtcttctggctgccccttacccaaccattcattctccactaaatagctaggttgtcttttaaaatgtacaccagattatgttgcttcctgtataaaaacccctatagcttttattttaaaataaaacccaaactctgtatcctggtttactaggccttacatgacttaacctgcagacttccctctcttacaacattgccctctgttcaccagtgttgaagacgtttgcactggctgtgcctggcctgaaatgctctttcttcatgactggctccttcaaatattagcaaaaatgttatgtgccaagagagaaccctttctaatgttgctgtccacccctcattctcattcatactagctgcttcctccagtggaatgtaagcaacctgagaacaggaaccttgtctatcatgctcgcagttgtattgcctgaggccaggagtttgagaccagcctggacaatgtagtgagatcctgtctctacaaaaaaatatcacttaaaatattagctgggcatggtggtgcacgcatgtagtcccagctacttgggaggctgaggtgggagggttgcctgagcccaggagttcagtgttacagtgagctatttttgtgccactgcactctagcctggatgacagggcgagaccctgtctctaagaacaaaacaaaacaaaacaacaacaacaaatatatatatatatttatacacacatatatatatacacatacatatatatatgcagtacctagctctcaatatgtgcctgaaaaaccaccattatttttaatgaaatgaatcagttaatatctttttgaggatttgggggggatcaggattctgactgtctttaatgggcatttgatatttccccagcactgtctctccacctacttcagtgagtcacattgagacacaggcagggatggcacatgaccttgagtgttgccatgtccccggtgtaacataaagacctctgctggatgtggatagcaaggtctcccaccatcagcggccacgcaggctgctatctgccatcaggtgatatgggtggtatgaggcattgtgggtgggttggaacatgcgctttagtagaaagcatctggaagatcatcctgtgttttgctcaccctctctttgttcagatgactgtcctggccctgcggaactctagatttatgagcttttggagtcagctcttgaggagaatttttcatagtatcttgctgtcttttcatctttgcagatatgggggaatgaactactgagataatctgaggggcctgaccaagccttgtcagctggtaagactggcatgtgcacagggaatcagctccctgatagaggagtccagacatgcaggggatcctgggtgtccactctgctcactgaggcagcagaaggaattgggagcttctggacccactatggcagtcagaggttcttaaggaaaaaaacaaaaattctcaatgcaggcaggcctaatcctgcgtcctgctacctctatcctcctgccttctccccatcctcatttctatgctactgcttctctgtactcctctccaagcccgggatctatatgttttgtggtgggagttctaatacccctggatcctctgtcttcactgacacagacaagtggtcagtcctatgaaaacatttactgtgaaatccagagagggcaggactgtgagggtgctatgcccttcacaaagtgtggtaggtactcagtacatctcttactagtaaaatcttgctgggataacccttggtatctgcagttgagtttgggcatctattatgaaagcagttcatatgcccccatcttatttcttgtacatacaagggtgtttgcataccattatttttcaaaagatttcatgatcttcttagcatgtttacaaatctgggaaatgcatttttgctgttcccacattcaatggctcatcattccaaagaggttggagaaaactttgggtgcttaggcctagtttgaaagttagagatgcctactactgagccagaatgaaccttcacaacgcaggacaaagcaggaccttactgaattgtagaaatggaagaaccctagagactctgagataatggatggaggaccactagttgacatcctttcaagatctacctttgtaatttatgaagcagtaagaaagggcattatttttgcttctgtgatcagagtttagctcatacccctatagtccctgtaatgctcctgtaatgcttgaagggtcataaaaggaagacagggaaaatggggctggagatagcagggtagagataaggcagagcaaaaatatgcttgagctcttggaattcaagcatataattccgaaaatatttaataaaaaatcaagttcaccttcattgtttctattattgttgttattttatagtcagtacttgtttaggttcagcccacgtgctagttgccttgcatgccgttccttcttaatctgactcccgccctccttttaccactacttgtggtgtaaatctgttaacggtaaaccttctcagtcttagtctgagaaagtctttattttgccctccttcttagaattatattagacgggtatagaattcaatactgactgttactttcactcagcactttgacgatattattcagtgtcttttgacttccatggttacttttgagatgtgtggtatctgcttaattactattcctctgttttatgttcccactcctgttgcttttctttcttctttccttccttccttccttcctcactcgctctctttctttcaaaagagttttgctctgtcgcttaggctggagtgatcttggctcactgtaacctctgcctcctgggttcatgcaattcttgtgcttcagcttcccaagtagctgggattacaggcacatgccaccacacctgggtaatttttttgtattttggtagagatggggcttcaccacgttgcctggagtggtcttgaactcctgaactcaggcagtcagcctgcctcggcctcccaaagtgctggaagcactttgagagccactgtgcctggccccctgttgattttaagaatttcttttgtctttgatataccagtttaagtgggagtttagtcttaccctattcaggacatggctcttggatgggaggattcctatggttcaccagttctggaatcctctcagccaccatctcttctgatatgggccttcttccatcctctccatgtcttctggaactcctcctacacatacctggggctttcttactgctttctccatatcttttcactgttctttctatgtctttatcttttgatgatgatttttgaggattttcttcagatctgtcatctagttcatgatttttttcttcaagttatttaatccttccactgaggttttagtttaagtcaccacctttttcacttagaggtgaaatgtttttcaaattatcttcttcctttattaggatgtcttgctctgagctccggttttcaatttcttcttttatgtctttaatatttcctaacatacttattttgcagcttggcttatagtagacatgcagatatttgttggatgaataagcacattattagttttgttctgacagttctcaaatttgaagttctcaggagtctaagcctgctttttgttatgcctgttggctctctctttcagtggaatatttccttgtgtgtattttgtaattttgtatcacgagtttatnnnnnnnnnnnnnnnnnnnntttatctttatcaggggattctctgaagcctgggctgaaggtatatccctcccgcaagattttctttttttttaagaaaaaatctagtttactagcggtgtcaccggttgagagtttctaaccccatagaccacataaatagcaaattggagtgaggcacagacccagctcacacatgacttcataggagacatttttcttctttccatgctcaggcaagaacagtctccctgttgtcttcctatgctagtagaaagatatttttctggcctatctttttagtaagggtatagccctttgtgggccctggctgtatatagttttggttctaactcctcaccattcataaacggaaaccctcatctttgggccctgggtgtgcattaaaacccatatcactattttgccaagattggggcctcccactcccccaccagagcagctgcagaactagctcgcgtgcttctggttttcagttcctttttcacttaaggcctgtagggatttcccttcctatcttgcaagctcaactaaaaagagtttttaatatttcttatctagctgttttatagaggaagcatttaggatactgtagttcacagattgttggaaatagaagtcttcctccttggtttcttacccaaagcagtgccatcccttctttgcctgtgaagatcattttatggtaggaagtgatgggggtatgctgatggtatcttgatcctgccaaggtggtccatagactgttaaaatgtagaggaccattgacctagaaagacttcagattagtactgaataatctatgtgttctttgaagttggaaatactcttttgggacaagatgtttactactatttgttagaaactttatagcgaatgtcctcctaaaataataatgacagaacacacaagactgaaaaaacatcaagggcttaatcaacacaaaatatttgcctaatcatggattccagatttgtaacagcccaaatgcttggcattctgtttttttccagactgtttctagggtctgacatgatcaccagtcccactcccaccaaagagcagcccaagtccactgccagcgggagctctggtgaaagcatggactctgtcagcgtgtcatcctgcgagtcgaaccactcagaggctgaggagggctccattactcccatggacacccctgatgagcctcaaaaaaaggtatatactcaacccttctcataattcctaatgcaggcacctacatgctctttgccacaccacagcaaggaatgtctgtttttaagtggatcactctatagtattttgaaagtcatgttttgaacaggcatcaaaagaagagttcaatttggggacatactactaatagaaacaggtgtaaaagcactaagcagtttcgtttattcatttggcctttgaaatattgttctatacccacctcttaaggcactggagttatttaggggaagtaggacttcttagaaagagcaaaaagtcagagatggagatgtgtcaggttcttggtgccatgttttgtcttagccaagcatttatcacaataatgttgcattgcatgccactccaaaagtcagtgagttaaaacaaccactatttatctctcttatgtatctgctggttggctgatctaggttgggcttgacactaggccacagatttggtccaggtctgttccacttgcctctcattattgttggagtaacgggctacccagggcatgcccttagcatgctaagacggacaagcaagagggcaagcccactcgcaagcatatgtcaagcctttacttgagtcgtatcaaccaacattctattggctaaagtaatcatgtggccacattccacataagtaaatgaagcagagaaataggctccagttttagtgggaggaactctgaaatcacagtgcaaagggcacagctgcaggggaagatgagggattggtaacaaggatacattctcccatgttggaaaaaaggaaactgatgagaggtgataaaagaatttccgtcgagtttctattttctgtgactgcataaataaaaatttaaaaaccaaaatatcttaatcttaagatcttaattaagaccagtcttcttttttttttttttttttttttttttttgagatgaagtctcactactctgttgcccaggctggaatgcagtggtacgatcttggctcactacaacctctgtcttctgggttcaggggattctcctgcctcagcctcccgagtagctgggattacaggcatgtgccaccatgcccgcataatttttgtatttttagtagagatggagtttcaccatgttggccaggttggtctcacacccctgacctcaggtgatccacccacttcggcctcccaaagtgctgggatgagccaccgcaccccaccaatatcagtgttaatcttctgtacacatctgcttcaatctgttggttgaagggtttggatcagaaagtcaactatgacataactagaatttgcaccatttggggaaggtttctggctaaccaagcttactcaatagtgacttctggctccttagcttatggttaggtcagtaaggtagaatgttggcaatggtttcatcccttggtttatatctgctgctcttcaaggggacatgtgtgttgcttcacatggtgttaaaacaacagtggtaatcctggaaccctcaagtgactttgtcataatgtagccaatccaggaaaagcatcatattcaggattcatcaaactgagatgactaatttgctgctctagttggatttcttagctttctgctttgaaatccaggggatacaatcattcatgctctaaatattgaaagaaagccttcgtggacacctacggactggccatgctctcaaaaggcatttttcctcaacccgggatgtagtcattcttcgtgacttgacatacaaattagctttgtcaaaatctggaatgcagtctcatcattcactttttcacagcctctgaggttttataggctccatttctgatggtagacattgtaggaaagtaataactgaggtattgcccacattattgtgggatttctccctgtctctccaggaaggagatggaatcacagtcacaccttgtggcatagtggaaatgtacattggtccaaatggtaccttttaaaactatgcagaagcccagtgtgctttctcctgcacatcccttgcttcatcttttttgtctcatccctcatcagactggctttttaaattcttgcagaagtcatggctctttattctttggatgaacctttctcagagtcatacatttcttaaacatcagtgattcacttggatgcaagtagctcctggactgcacaatccctgcatattagctagaaaggctcgtgattctcctgcttggcacatagctggactgagctgacctccacacttccttcctgacctgagagcctgtgacagccgccttctccaaaagtcctccagactgtcattcttccttttccacaggctgcactgtgaggttgctcttaagggtgaagtgtaatttatttgcattcctttcttcattccccgatcatgatttctaaatattgatttttgcacttgctcctcacttcttaaattctcaataggaatttgggggctcatcaggcagtctgtttagagctgctataacccaggcatattctaggctttatcttaactataaatgtcactagaatcatagaaaaatctaacaaaggaaatagagtttggatagaggaacatgaaggcgaaaaaattgaatgaataattggaaaatgcacccccttaactaatatatctgcaaagaaacttatgctattaacttatctatcatcagttagtcctcaaattgagccactaagttgattcatttgggaacataaggaagaaaaaaacccaaaaaccaaaacaaaaactaaaccatattatgatagagccacaatcagacccctacccatgagaattgtcacatcagctggctggctgtaaactaactgtgcaatagaactgaatgtataattatgccacaggaggaaatctacaggaaataagataatagactccattttaatcagaagcctgataaccagaaagctcaacttctatactgtttccatggaaaggcagataaatatgaaagaaatgttatttattttataaatgacttccagaatattttataggattaacatggtataatttagcttaagtcattccgggaaattctttataattttctacaataataatgggtattttaaatggttcaatttaatgatttttaaaagtacctcttccaataacttctttctttggttattggtattgcatggatgagaaatgtgtagttaatcagaaaagcatattaactgtagtactccatttcttaattgtccttgatacacatcatgaaaatgtatacagttggctctactagcaaatgtggaaagtggtgaagctgcttaaaggctgtatttcccttgagcaagtcacttttatattctgaatcttattctcctcgtctttataatgctctgcattttgttcacaagacagttgtggaattaaaatgggataagataatatgaaagttcatgataagcctcacagtactaaacataccgaggtagcagcatactatgttgattcatcttattgtcatcagccacaggctgagccttggccatgtgcttgctctgggaactcgacagtgggaatcagggagcttgggttcctgttctaggggtgctgtcaactagctgtgtggacctggagccccagttttctccctgggtctcaggttcctcagcagaacaggtatgggactagttgatgtccaaggcctttctagcactaatattcaatgcagagccgtataatctggggtacttctcttagaaacttctaaaaatacagaactttctctctcactacgaaatctgactgcagtaggactgaatcaactgcgttggcaaggctttcctccagccccgtaagcttctgacttctttgggaacccatattgcctccagtttctggtgtctgctgccacctgctggttaacttctataagaacagctaaaacctagggaaatagaactgctttgcctcacgtgcttatagagtgattaggtcacactgagtcaccgataggcatctaccactgatggggactcagagtacttacaccagggatgagacacatgtgtgctgtgggctgttgtggaggaaataactgcagtctatcagtcttgatatctacctctgctttgaaaattgcaaagctgttggccagcgttctaatctgttttcttctggggtgtgtttactcttccagctctctgagtcctcctcatcctgttcttctatccattccatggacacaaattcctcagggatgtcttccttaatcaaccccctctcctcccctccgtcctgcaacaacaaccccaaaatccacaagcgctctgtctcggtgacgtccattacctcgactgtgctgcctcctgtttacaaccaacagaatgaagacacctgcataatccgcatcagtgtggaagacaataacggcaacatgtacaagagcatcatggtgaggagcaagccctgacccaggagcgggtttccatttagattgtgtgtctgtgtctgtcggccgctcagactaatagccctaaatatgcacactcaatattagcatatacatatatgcattcacacagaagggatgtgtgtcagttccaggtctccctgggcatagatgctgaatgatatatgtatataaaatatatatacatatatatgcacacacatggtgtatataggatataattttcacatcttaaagaaatgctaaaacttattcgtttaggtcagtattagccatttgaaaattctcaatttgggtgacagtgtaaatgtgctccagggaggatgacacaacctcacacatttttggaagccttcctatggaattatatgtctggttttatcattgaatttccacacattcttagcagtgtactcccctgatggcagatttttgtcatttagtcatttggatcaaacctagttaataaagtggatgatcaagctagaaatacagtttgggttaatgaggaacgatgcctataaaatgagactgacctttttgagcttcttgtaaaatctgtgtgtttctgaggacaattgcaaagatatttttaataatggcagtcttttgggaatacacacagagcctctcatggcgataaccttgggtatgtgaggtctggtaggtttatcacaagaatataaactccttagtttatgggagataatcatgtattggaaatcactttatcctttgcagcaaaatcccacagctaattccacatctctcctcatctttatcactcgcctctttgaaggcacactcagtgcttacaagctcaggtctgaatatggcataagtggtatggaggctccacataaaagctttgctaaagcatttattgagtcaacaaaatatcaaacatttattgcgttctagtcattagatcaggctttggggatagggagatgagtgagacatttctgcctttgaggaacttttaattagaaagggagcccacaaagcattattcacaatgtgcaaaataatagagccaagatcaggtggtaaagggccttgtggcccacacagaggagtgtgttaatcccgcaggcaatagggtcttgttgaaggcttttaagtagtgatgggatttgctcattaagaaagtcatggcactgtgtttgctggagtgtcggggtagactggaggcggggaagcaagttaggaagctgctatcatgttccatgtaggagaggataagggcttgaatgacggtcatgtggctggagatggtgaggatttttgaaagcttttgatgaggtagaattgtagaatccattcatttagttaccaactttttggttactgttgtggaggactagaggctgtctgggtagttggtgggtctgtgagatatgaactaccagaggaggatattcagggacatttaaatcagaggtaccagtatgacatcagatggcattgtctgatagatggtcagaaacatgggctggtgcaagggctggtgctgagatcaaatactggggagttgtcaaaccccacagggggggacgtggtctcgcgagactgagtgtaggatgaggcagaatgcaagtggtaatgagggaggggctaataaaggagcacccgagaggtagaggaaacacagggaagccaaggtcctccatgtggttactgcctgctcagcatggtctgttcacctggcacctcttacctgcaccaatcagagagaatgtccactgcataactctacagtgtctctgaattatagcatggatttgtacaccaaacagttatgttttgggacatgcctggtcagcgtgcactctgctcagtctggggggaactgtgagtggttggactgcacaaacctctactgcccaggaggagtcacaggttgtgcatgctgtctgagtgttgggagggtagtgagcagaagatcccctgccccctgctctgagattcctccttccccagcaaatgggctgcctctgtgagaatcacctctcctgccaaccccttcctgtggccctttatattgcaccaggtggtggcactcacctttcatgaaaatcctgccagcgcatgtcacaggcttattctggagagacgacacactgctctcgtgctctcattctaatcgttaggcctctcaggagaaaccttgctcacaggacgtacctttctgaaatgtattatgctgtgtgctgttgaccagaagatggaaataaatcagtccaggttcaggcgagactagcagttctcaaactttttgttctcaggacccctttatactctgaaacagcattgaatattccaaagagctccagactatgtgggttgtatctgttgatatttaccacattagatatttaaactgagaaactttcaaaatgttgattaattcatttaaaataacaataatgaacacattgcatgttaatgtaaattttattttttaatgaaaaatatctatttttttccaaaaattattgagtgagaagtgtggcattgttttccatttctgaaagtctgttaaaatgtgagtgagactggctttgttttgttttgtttttgtttttactgtgagtacagggtactgaagaatacagtgacagctagtagacttgtagttagaaaccactggaccgatttgtgctgttgtgccagcaattccatccaccatagcttctgcaatacctatgcaaatgtcaacacaaagaaaagacaaacagcatcttagtattatcatgaaaataattttgatctcatggatcccctcacagatttcagggaccccacgggccatagattgcacactgagaactggtggcctagagaacttgctttgcaagagcaactaatgtccctggaatccaaggcccttccatagaagaagagacagcaattagcccttgtaaaattacctcctcagtgaccatggaaaaatgtcttctaccactgaacccatcactctttcgaaatgatctttctctccattatgtcaatcacagagtcagtctcccaagatcccttacacagggaatgcagtatttctgtcacaggaaagtcaatgagggcgacaccaaagcatcgttcagtaccgcgcattcagtacagcagccactggccacgggtggcgatggagcatttgaaatgggaatactccaaattgagatgagctgagggtaaaatatataccagattttgaacacttagtacaaaaaagtaaaatactgcattaacaatttttgtattgattatatatgctgatgtaatatttggggtgttcaagttaaatatcacctttcaaaaactttttttttttttgaggcagagtcttgcactgttgcctgggctggattgcaatggcacgatctcagctcactgcaacctctgcctccctggttcaagcggttctcctgcctcagcctcctgagtagctgggattacaggcacccacgaccacgcctggctaacttttttgtatttttattagagacggggtttcaccatgttggccaggatggtctcaagctcctgacctcctgatccacctgcctcggcctcccaaagttggtgggattacaggcatgagccacctcacccgtcctaaaaactttttaattgtggctactagaaacttaaaatgaaatatgtggctcacattcgatacctatgagtgctaattcagtctatcagcataaggatgcacgcttgagctgtgaatactcattgtaatcataagtttgattcagcatcgctttgatggtacaaagtaataaacacgcaagggaaagcccttggtcatcttgtcttcattgggacatacctggggaagtttaaggaaaggagaatgaaggtagcctggctgtctcatatgacttacccaccttagcctgacatgcatcccctgaagggaggtcttctcctttagctttctgctactagtccagtgtgacccagctttgggagtattttcttcatactatcaaaaacatattttcctcatttagaattttgtgtgcacctacttttcccttgtaaatgaatatgccagatgttttggtaacagacacgtgaacaagatctttgctgcttacaaggacccctttgtaatgcacattgtttatggaatcacaaacaccagctgctgccccagatcagagtgaggcatcttggcactgccatcctcaggcacacaatggcagtttctgggaggaaatgagacttctgtatgtgtcgaggggggtcgtggggggctttctttctatagtcctcttgccccctggtgagaacagcttttatttttaagtaagaataatctgagttttcattcacttctttcaaacttaaagaaatcacccaaggtatggtacataatttagctttcttttcaggttgctctgcacaccctgcaaatagttggctggcaggcagtgaggtgaagggaagaacatcagaattggggacgagggaaacctttaacttgtgcttttaaaacacttacaagctgatgtttattgaagcataatttgcatgtagttacatatgcagatcttaaatgtttgattctttgagttttaataactatatatatctatgaaactactaccccaaatctagataaagaacatttccatcctgcctgccagattccctgtgccctttccaatcaatcccctcctaacctagaggttcattttctaatgccacagattttgtttttcctttttttgaaagaatagactccactggtatgtaatcttttgtgtccggtttcttttgcctaagatgatgtttgtgagattcacctgcattgttgcatgtgccagttcttagttcccttcagttgctcagtaggattctattatgaatatactacgatttattctcttttcctgttgatggagattcagattgattcagtttttagctattgtgaataaatctgctatgaatgtttgtgtacaagtccttttgtggacgtatgtttttattccgcttggtaaatgcctaggagtgggactgctgaatcacagggtcacctgtactttttgaaatggtcaatgggcagaactgcgaccatttttatcccgtgggttgtaaccagtgccatagaagcagttcaacatgggaggataattttgggccaggactaataatgctttgcatttttcacaattccctcatatatattctttcacgggaacttcaaccactgtggaggagataggcaaggaaagcgttctctccattttaatagcggatgacgctgtgactcagagattaggtgactcgcccatcatctgtggctgctaagggtagaaccaggactagaaaccagggatcctggctcttggtccagttccaattccacgagtccgttctttctggaaaggcatcacaacacaagacagcaagaatgagagggtcaggagaactccctcaggaaacgtgaagctaagtactttacaaacctgttcattgtctttgcagttgacgagccaggataaaacccccgctgtgatccagagagccatgctgaagcacaatctggactcagaccccgccgaggagtacgagctggtgcaggtcatctcggaggacaaaggtgggcatccttccgagacaggcatgttccttcccagggcaggtggctagcacatgtccacagtgctccgcgtttagaaggcagaaaacggatacgtattgttttattgggacctagtggtggtttttgatagtgcaagggtgaacaaccgtgccatcacctcacttgtggaattaagtatctcaaaccgctctccgattccccagctcttgtttttcctgcgattttgatgagtatttcttctgcccagtctttctgagctcttcaaacacttttctaggaagaagtgtctccctgtgccaggaggcagagggtaggggagtctgttgggcattgcaggtggccacacacctcctttacccaagaatgtgtttctaagttgtgtgtgaatctgaaatttagtggttcctgtaataatttctcatcatttcaattaatcatgtatgaaaggtattttctttattcatgatcaattttaaaataacacaaacctctaacttgaaggttatttacctcacatttattgaggcaaagaactggtaatctatgaaaggcttcaatatgcctgggaacatattatttaaagaaatctcttttatgaaatactttttgggggaaataatcacccttgcatgtatctgtctgctaatatgaatttggggattgtatttgttgagagaaggaaacaggctggtagaaaactcctctgtaccttgtcacttcacagacagtgactgtcaggataggtctcttctccaagtgcagaaggagcagcaaatattgttgaccgaagccaaccctttctgccgccagaccccaaactgtccattgcagccaccttaagtagtcctctgctcaccaacaagcagtgtcccctataagtgagaagcattccacaagctaggctatgggatcagcatgtcacccagggctctattgctggtttagaggagagtggctgaaattagaatactaccttctcctagagattaaaagctacagcctctgggaaaattctttttcagtttcctcttggaagatttctcattcattcagctgagccttaggctgtggggcaacactttctcagttataaccttttgatgtaattataattataattctaagcctaaaagatggtctcaagttgtaccattttgcttacaacacagcactaaggtgaggctggtgggtctaaaggtccaggagtctcgaggggtagccaggacccagtgttgcccaccagctgtgtggtcctaaatgcaagctgctggacccccgggccttggtccttaattagagacaataccctgctggttcctcatatatcacagggcgattctgaagataacaagaaatcgtgtacctgaacatggggagacactaagtgatatataactgtgaggactattattactgacctgtgagtatgtgggcagcagcatgggacactttgaggggattgttctccgctgagcctttgtgcacagaatgtacaggagtcacttggaacctgctcatatcagtcttgttgttggatatcaatgtttgaagttaacttaagactcaatttgtccagttttacaaccatatgcctctctggttgcctccccgaccccactaccacagagctagacttgcacattttaccttttttaattctgtttgttttttcaaatactcattacacttgagtgctaaatactgtataccttcttgtggcgattactcaaggatctagaaccagaaatgccatttgacccagcaatcccattactgggtgtatacccaaaggattataaatcattctgctataaagacacatgcacacatatgtttattgcagcactattcacaatagcaaaacctggaaccaacgcaaatgcccatcaatgatagactggataaagaaaatgtggcacatatacaccatggaatactatgcagtgataaaaaaggatgagttcatgtcctttgcagggacatggatgaagctggaaaccatcattctcagcaaactaacacaggaacaaaaaaccaaacactgcatgttctcactcataagtgggagttgaacaatgagaacatgagaacacatggacacagggaggggaatatcacacaccggggcctgttggggggtggaagactaggggaaggatagcattaggagaaatacctaatgtagatggcgggttgatgggtgcagcaagccaccgtggcacatatatacctgtgtaacaaacctgcacgttctgcacatgtaccccagaccttaaagtatagtaaaaataaaataaaaattaaaaaacaaaaataaaagtgaggctgggcatggtggctcacgcctgtaatcccagcactttgagaggccgaggcaggtagatcatctgacgtcaggagttcaagaccagcctggccaacctggtgaaacccgcctctactaaaaatacaaaaaaatacaaaaaaaaaaaaaaaaattagccgggggtggtggcacacgcctgtaatcccagctacttggggggctgagacaggagaatcacttgaccctgggaggcagaggttgcagtgagctgacattgtgccactgcactgcagcctgggcaacaagagcaaaactccatctcaaaaaatataataataataaataaataacttaaataaataaaataaaactgagtcaaaataactttgctttgatgatttcatattacacttggaacaatccttgttcaaaaattacagatgtctagttgggaatcattgaaattgaaaatagtttaaatattaaaagaaggggatatttgctgcaatatttgctgctccttctgcacttggagaagagacctatcctgacagtcactgtctgtgaagtgacaaggtacagaggagttttctaccagcctgtttccttctctcaacaaatacaatacccaaattcatattagcagacagatacccaggaaggggagcatcacacactggggcctgtcagggggttggggaaaaggggagggagagcattaggacaaatatctaatgcatgcaggacttaaaacctagatgacagattgataggtgcagcacatgtatacctatgtaacaaacctgaacattctgcacatgtatcccagaacttaaagtaaaatactataaaataaagatatgcacgttcagcacatgtatcccaaaacttaaagtaaaatttttttaaaaaaatatacatactttcctacatgggaaataaaatactcgtttgacgggattacttcaaaaaatatttcaatatttcaagtagaattctggagtgctgtagattttctgttttttctatgtcattggattctcttagtctttgagaaaatctgcatactggggtggaaaatggactgcaggagaaacgaaacccgagttcaaatcccagttctgctattcactagctgccatcttgggaattttctttaacttttcttggcctctgtttcctactgtactttttttctagttttaacattttctattggaacatttaattcatggagcgaatttctaaaatctcatttgtactaattttttaaattgggattgagaagctggggccaatttttggggtagtgatggtgatcactgtctggttcaggtcacattccagagatgaagggccgtagtcccgttcttgtgtctgggcaaggtttacagctgccgttgtcagtactgagctgacctccacaagctgaccatcttatctttccttatctttttcagaacttgtgattccagactcagcaaatgtcttttatgccatgaacagccaagtgaactttgacttcattttgcgcaaaaagaactccatggaagaacaagtgaaactgcgtagccggaccagcttgacgttgcccaggacagctaaacggggctgctggagtaacagacacagcaaaatcaccctctgaagggagggaccagtggccccttgtttgccaaaggcagagtggggctgagaaacaggctgcggtgattgcaattaccatccggtgttcgaggatcattggtgaagtcagcagatatttattgagttcctgtggtgtgcaaagcattatgataggcaccgtggggaaactggaaatgaatttgacatgaaaaggatgaacgattcactgattctctttgactcatttgagactaaaatgcagaattaccaacatttaaaacatatatatgcacatgtatttggtatgcatgtgtatctatataaaaatatataagagggactttatgggatagtatggactatggaaaaacaaatttgcacaatggcctgggaagttgaggtcactttttacagggaaatagaagaaactgagaacctagtctcgtatattctgagtaaatggaatcagtcctgggaatagagagtgtcctttgtgccagtattacaagaagcccaaactttatttttataaagggagaggatgactttctcaatcaagtgccaccagataaaaacaactgcagaggctggaactgccacaggctgtatgaaaggccactttggaaagggtttggatgagctggtggccttcaacctctgcctgcatctgccactttctgctaccctagggaggccaggaggagcttcggaggaccatcgccccactggtctagccatcatgacacctctggaggtgtcaagctcctgaaacaagctcatttcagtttctggcaaccccgtgtatttccgttttccccctaaagaacatatcataatcattgcacaaataaccatgttctttggtaatgaagccagaaaagaaagcgcaaaagaatggtgactcatttggactcttatctgtcttggaatgtcactgcttcattgccttctctgattgccttttgcatgtaaaactatgtgtctggagtcttttgccatctggatcttagtacctctttattatgtgcaatttattcctcaggtgtggaaatttctactgcaattgactacgtttgattattttgagcttgtgaaagatttctgaacagtgattgtcccgttaatagcccctcagaagatgttccctgctgataacagcatcctattttacttacttttatagcattactgtgcctagtcgtggggaaagagatggggctgtatagattatctgaatcatttgtctaagaggtacattcttccagatggaatcaataacttttttttttccaggttcccgtgcttgctatcacagtatcattgttaagtgacacttttgtctctcataacaccatcacactcttccttccaagtctgagctgtgctggggtttgaactaaaagccatatgtggaatattgacatgtgtaagaagcactttcagaatgttgtcctttttaagaaatgattctcaaaataccagtttttattccaaaaatttagagaacaaacccggaatatgaagtgcagattgtaacatggagctatttttttttcttaatcccataatacagctcctaaaagttgtgtgggatttgcgttgcataaatagccatgtgaattccacaagaagcaccagggaaagtttagagatttgcggcaatggaccgaagaacgggccaggaagtcctccaatttcctttggtctttccaggagattggactacacattgtaaagactgactgggtttcaactagtcaaaaagcactttcttctgttttcaatccctgttcgatttgtgcttctgtgcttgtaggagagatggccagggtggcagccctcatgcaggttgaagtatatgtagcctcagcctgatattcttggtgcgaaggtaaaaaaaaaaaaataaataaaaccattggcctggttgagggcgtgaccaccaagacatatatgttgtgcccgtgttcatcctgtgtatttatactgtatatgtagagtctagatttatatactgcaatgtaaaatatatatatatttaccttttttaaagacaatggaaattccaagtagctaaaacttagcttcatttatttaatgccactttaaatgtcttaaatttgnnnnnnnnnnnnnnnnnnnncttaaatttgtttcctggtggacagccgggtaatgcttttagctgctcgcatgcttgtctttctgcatctccatcatctgtttaccttttggttaaactaataaactagtttgggacttggctggcatgtgctgccagacccaaagggattgtatctggattattaaccaggtgggttttgggttccagtgtgtcagtaagcttttgggaagcccgctgaattggttggaggagcacagggaaagccagtggcagagttaggtgggatcctccccactggcaagtgtcacaagcctttgggggaaagaatgacttccttaggagactgcagtcagagatgatgccgttgctagattgctgttcttagggatggagtctcactctgtcgcccagactggagtgcagtggtgcgatctcagctcactgcaatctccgctgcaccagttcaagcaattctgcctcagtctcctgagtagctggtattacgggcgtgagccaccacacccagctgatttttgtatttttagtagaggtggggtttcaccatgttggtcatgctggtcttgagctcctgacctcagatgatctgcccacctcagcgtcccaaagtgctgggattacaggcatgaaccaccgcacccggcatggggacacttaataatccaacttagagtgagggtccaagttagcattttgtcacctttctgagagcctttccccgcattttgtgatggataccacctgcataattcttgaaaccgcccatggtgccttggaagccagggggacctccatggagggaggaaaggcattcccgaaagaattacacttgaaatccttttaaactgatccatgcagtttccccaaaggcattacgtctgaggccagcttcactggacagatgcacagtattgtcatttatcatactgttaaaaagttcccaggattattttctagtagatttctaaatggatccaaattatcaaatgttctgtgcccttgtggaatttttagaggaagccaagtagaaattttaataataggaaattgataatatggggtagggcagaaaaaaaagggaattttgtctttggtacttgttttttcaagatcattctaaaagcctgtttcccttgttttgcctttttctagaaactgggcctggggacagtctgcctgaaggaataatgtcttaaacttgtcttctttggaacgtttgtaaattctccctgcagcgcaggatcattaggaggcatacaatactgctttacgtgtcctgatttcagggggactgaggaggttcctgactcaaacctctttttcttcagatgcctacatttccactaggcaaagttatttccattgcattttgcattgcttttccccctagacatctctcttaaaattaaatacctttggaagggatgtgttaggctaggctaggctggaccgaagtaacaaaccaagaaatttcaacagcttaagaccgaggtttattttttctttcacgggacagtgtaatgcaagccaggaaactccttagtagcttttctctaacagcagctcacagatccaggcagcttccatcttgcaacttcgccatctcggtgtttcccttccagtcacagtgatgataaagagagtaaagagaactcacaaactgttcccaactgccttagaccaaagcgacacctgtcacttctgttcacagcccatcaaccagtccccgggcccgatgtgagtacaggggaggtgggaaatgcaggagaaacctggaggagttgatgaacacgaccacctctgccacagaggggtaatgccttctcctagggtgcacgggtttgttcaccgttggcagtcatcagaaagtgtttggaagagatggcagtgaggacttgagaggaggctgcacagaacagaggaagagttgaagaaagagagatgctgaaaggagaaaatactagaaagaacaatttaat

SEQ ID NO: 14605 - DNA, 9482 bp, Human
tagcaaagactgaaactgaaaaaaaattgtaaaatctttattctaagttatataacgccattcaccatagtaatgattttatactttggtatatggctttttaaaataaatattgccaacaggtaaaaatttttcctttgctgtcttaaggcattcctaagagaatttttaccagtgtgtgttcataacttgaatgttaatttaaacaatgttacttctatcacctaaatgatatacttatagaagagtggtttaattgggaacagaaaaacaccacattgcttcttcccaagaaaaagggatgtattccattctcgaggtctctctcccactctctatttatatataatatactgcatagataaatatacacacattatatatgtatttttttgaacttaaagaagactggacatatgtatttacatgtatatatccaacaaatatttaattttgagatctctctccctcttctgatttattattctcagtatgattctcaaactgtacggtctttcacatttcattcattcatcaagcatgtatcgagtcccttctgcatgcttagctttttgtcatatggaaggaagatacaaaagaaaaactgtttctgcccttcagaatctttccatctcttctaggaaggagataaaacaccatatatcattaagaaatttataagactagtcccaaaaccaatggtacaagcaacatgcattttacatttatgtagaattttagagcttggaaacactttcgtgatatataatcctaagaacaatcttgtaaagtgcacattattagctccatttcagtgatgaggaatctgagacagaattttaagtgacatgtctcgttcaaacattatgagtggaagagtcaacacttaagcctgagttttctgattctaagcctagtgctcttttcaacacagcactggaaaccaaagattgtggtacacaacagggcaacagccagtcttctgctcgaggtccaactaaactggacccataccgagcagtgtccagccaaatgtccaaattaattttatcctgcaaatatttgttcttcagtgtaatacacacagcacaactaccatttccttcgtcttagtgcctttatctcctacattccagaaatggggatgtcaaatatttttttaaatctggcctagatggaatcatataaatctcaaatcataatataaatcttaaaggtctggtttccaccaatccttccacattttgttttcccccagcactagagagcctaacctaccctcacccctttcgagcattcttgctccaaacgaccacctattttaagatgtcaatgaccctttcccaaattctacaaattcaccccagttttgccacccgaccccagcgcctgcccggacacgttcccctccctcccaatagatttgataccgagttcaggttctgcagatcccgttgcgatgctgtcacacagcactgacagataagatttgacctttcgactccgtccttggggacttcccgctggccaagaagggtagttccaatcccaggaaacgggcttcctgctcaggaacgcagcctctagcagcgcacagtctgaggcaatgtctccggcaattagaacgatgctgggcgcccgggtgtgcatcactctgcctcatactcctaccaactgcagggcactcggtccggcagccagtccatcccacccacagccaagtcccagccagccggaccttacgcaggaccccgatgataggtcgttgacggctgcagcaaaagccaaggccacctgccgctgctgcccatccccgccaatctgagaccccctagactggaccgcagaaaagcgtttctatgggaacccccccaccgagaatcacgtgacgcaatcggacgaccaatcgcttcttacctctgcccgcggtccagcttttggccctccctctcgcccccgcctccttcgcccagccccgccccttgcctgcggagagcccgcgcctgcgcgctgtgtcctgcgcgctccttccctcgcgcgcgctctccgtggaagagcaggggcagcgtgggaggcgccaagggagcgcgaacctgaggaggaagaaacggggctagcgcgcaggcccagaacggtccgagccgcggcagtcggcgacgcctcagagcggaagagggaagtgaatcaggcgccgggtagtgggttgctgggctgggcttgctgaggtagaggcagcgccaagaagaggcctttgccgctggtcgggattgggatgtcgaagaacacagtgtcgtcggcccgcttccggaaggtggacgtggatgaatatgacgagaacaagttcgtggacgaagaagatgggggcgacggccaggccgggcccgacgagggcgaggtggactcctgcctgcggcaatatccttgcattcaccgccctccccaccccagcccagcccagcccgcccttctcctgggacccgggagcctgcaggatccgcggggcaccggcgcggagctgccctctcaacctgcggcttaacctgtctctttgggatcgcccgctctgagagggcaagggggaagcccccgtttcctacccagtcggcaggagacgcgagggtcccactcttggaagcctgccctcccccgcgcgccttccacgcccccagattcctcaggttgcacccgagtgcctgcctgcctcgggaactggtcccgccggccgcgccctcgcggcgctggggaaggcggccccggctggtggggaaggctggtgccgagcgccttagtttttcttcctagaactctgatttcctggggtcacattagctccagaaatttctgattgtggggaacctgcatctttccttagtggttttgttttttgttgtgtttttgttattggtagcgttaaggtagtttattccttaccggggggcggggggagatgggactgttcgaaaattgagggtccctgtgctttcagcccattggcctttttaaaaaaaaaaaaaaaagaagaagaagaaggggatttggcaaaatatacattgtacagaatttgttaactgggggaggggaatgaatacaaaaaatacaaaactcctagaaggaagcttggagccttttacctgctaagaaaaggacaatagaaaaaacaacggggaatgcgtgtggagaatccttggaaatatttaaaataaaccccaatgaataagatagaagatgagtcattcgtataaagcagaatcatttttgtaatcctaaaattgtttccattttagttaaaatatggcagtcagttcccggtttctgtttttgcatatttgaatattcataactttggcttcgcatttgcattacatcttttttagaaaaatgtaaatgttgcaaaaaaaccgaagctgtagttttagaaaatctcagacactgaatttgtatgcatttctaattcttgggtgtattcataaggaagactctcaacaatgtcctgttatagtggggaaatatgagagtgaaaatatttaatggcaacaatatccttttttaaaggcacctaaatagagcattagacatttatcaatatatagatagtgctttgccacaactttcacaattaattagctgttgctcttttgcattatttaaatacttaagtgcttggagttataaaaaatgagctaatctacatcaggcatgcttctctagaaatccctgcagccttgaaaataacagcttgtcaaccagagattttgtgtaagaactttttctttagaaaataaatggtgaacatgcttcctaaaaacattatttgtgatggatagatggtgttttatgaaaccccagtgtattttaggtaatttgtggtgacttttaaatggtactgctgtatccatatcagtggatctgctttttgatcagttcatcttaaaatataaagatactgtctcttcttaccgttacatacagccaggaaagacagccctagtggtggggtactagagttggaggaacaagtgaactctgtggttttccttttaggggaatgtttgtacattctgacagtctgattggccttctgtttctcatgcttgctaactcactagtgctttcaaagagagcctgaatttaataggtatggtctaacacagtttgaataacctttgtgaaatatgagagaaaatatctaaagcaaaaaattaagctgccacctaagggacatatgaattattacatcttctgtgatgcctcttttcatcaatattgagagattgctaatgtgtatcattcagattgctaatctgccagcatgttctaccagcatttcagataatacagaatatggttctagcaaaagtttggtctttattttttcaattagaatcacaggaaaagacatattttggttgataataggttatttcatttgggggactaataattctgatatatattttaggatttctttaacaccactctaggtaatgtttgcatatgtatctcactgggaaatgaaagactatcaaggtgttcacttgatagttagaaccaagggtgaaacagtctttgctttattaaaaaaaagtctaatgttctattttgcttttgatattttgcctttgattaacatcctggaaaccaacacattgaatttccagtattgaacatagtgaccaaagtaattttctttttatatgtaaatcaagtcataagaaccagtggttataatgctttcctgggggccatcctttgctgttacacccttaacttccatcacaggaaacatgacagctgccctacaggcagctctgaagaacccccctatcaacaccaagagtcaggcagtgaaggtgagtcgcagactacaacacagtgatctctgctgatatcttattcttagtaaaatcctctgcagttgcaaaaaaaaatcaatattttaactgtttgctatctttgacatagaagagtttataatgtagtttgataggtaaaaatttcacgtgaaaaaatagccctataatgtagttatgataatgctgcatggtaagatacagtaagttcaaacgatagtgaaatcatttgtgtgtgtttttagaggagaccactcaggctgaatttgagcaaaggtttgaaaaataagttaaacctttacaaaaataaacagattgtaattgctttttaaagattttttaaaaccatacaaatactaaatacttattatagaaagctcagacatatgagaaggttaaaaagatagtggtttgtggtcccagcacccagagataacagttactactttggggccttgctgtattgttacagagttcccttttgtttttttaagaatgaaattttataacgtgctttttcagctatatgcaatgtacatgagctttccttcgcaataagtttatagcatttttaacacttgtatatggataagctgcagtgtatacataactaatcttttgttatatatttagactgactttttttttcctattgtaaaccactgaaatcaatattttttggtaaatttttaattgttctctttgagtaaattgctagcagtgaattactggatcaaagaatgcacttttttttaaggcttttggtatgcagtattgccaaattgcccttcagaacagttgtgcaacttacattctctgcagtcttttactaattcttaacctatttacgtatttatttaaaatgatgcccatagcatcaaccccgttgtccatagctattcatacatcctaggagcttcaagaatctcaattgaatagtagtaagtaataacttaggtaaatgcataataattatctaggtaacataattttttattggggaaaatttctttggtttttacaagttgtaaagattgtcgttgaaatttcatttttaccgtggatgcaaagatatttttctaaatctggtaattgcagtctttaaaccaaagataacagtaggtggtagaaacattctgtgaaatcctgaccagtaggaatgctggaggtatcactttgtgttgaatggaaggagaaacgaattgttgaaaaggtcagttaagtgtttcctttgcttggccggatgggtaagaaaataactgcttttgaagcaggcttttgccaaagaaaaaagatcattattaatgaacatcactatatttcatatctacagtcaattcatataaattacagtcaattttcttttaagacagcttggtttattaaaatttttaaataaaaaagtttttaagaaaaaattacttctgaaggataattcaaggtgaaactgcaaatctgcctccttgttttgttgggaattttttttttttttttttttttttgagacggagtctcactctatcacccaggttggagtgcagtggtgcaatctcaactcactgcaccctccgcctcccgggtttaagcaatcctcctgcttcagcctcccgagtagctgggatcacaggcacacaccaccatgcctggataatttctgtatttttagtagagacagggttttaccattttggccaggctggtctcgaactcctgacctcaggtgatctgcccatctcggcctcccaaagtgctgggattacagctgtgggccaccacacccggccgttttgttgggattttttttttttaagatcaagacataaatttaaatgttgttttaataaattgttaaattatcacattgatctgttagcaaatcctctcagctctgccttcaattatgttaatagtctgtctagtttcttaccacctccactgctactatgcttaccacatccagcctgtattattgcaattgcctcctaattgctctccctgcttctaccttatcccctactcccacagcttattttctgtaacatagatgccaaagcaatcctgttaaaatgtgagtcagattatggcactgctcttaaaaccttccaatgtcttctcatttctctcagtaaaagccaaactccttacaatgcctgtaggccttacacgatctgtcctcccataacctctgacttactcacgtgcttttctcccaccaatccactccaaccacattgggtttttttctgttcctggaacacactgaacacacactaatagcactgttctttcctctgtctgaaacactttcctcagttatcccaagccttctttcacgtccttcaggtccttactcaaatgtcacattcatagtgtagactttctgaaattctaaaccctcctcatacagatatgtctaaatgttctgttatttattgacccaccaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggtaagttatgaattataaatctatatgactggttcttttacaatagggaatgacaatgacaacctctctcacctaaataaccattttgatttgttgtacatttttgttattacaaataaaatgcatgaaaaggatagttcatatttatgtttactagccttggtcttaagagattctgattccaacacttgtgtttattcaacaatgattattagtaattaaacataatcttgaactctgaattaaatcaaaactttgtaaaagaaaataagcaatacaaatcaagaattctttcacagtgaccaaaaggtgaaaacaacacaaggatcataacagatgaacagctaaattgtggtacatacatacaatggaatatgattcaaccattaaaaggaatgacattctgacacatgctataacattaataaaccttgaaaacataccaagtgaaatgagccaaacacaaaagaactaatattttataattttacttatatgaaataatctaggataggcaaacacaaagggacagaaagtccttagaggttactaggaagtagggaaagcaaggaatagggagttagtgcttaataggtacagagttcctccttggagtggtaaaaaagttttggaaacagatagtggtgatggctacagtacattgtgaatataattaatgccaatggattttacacttaaagatggttaaaatggcaaattttgtgttagatattttacaacttttttaaagaattaggagtttggaggatcaagaattcttaaatcatgtttttctattttcatgtgtatattttgcaatgtaagtagatgctggtacatcatctgtcaaaagagtataagtgattttgagctttgggtaaaaaactggataacatgtaaatagaaccagtcataaaaatattgagtgtttgaagtgtatctgagtgaaaacacaaacataagaaaaaagcacatagtaaaacaatagttcccccttttactctaaaatgcaccaatttgggtagtaatttatatggcaccctattcatggaacactttctgttgccaggtaccatactattaatgttttatttaacctttacaacaaccctgtgaagtatataaatatctttatcatcctcaatttacagatgaaaagctagctttaaaacccaagcagcgtagttctagcatagcctcaagattgcagtgaacattgattacttattatattccacatattcttcaaaggactttataaatattaactcatttaatcctcataaaaatggagggaaatgcttgctattattcctcttttgtcactgaggaaactgaggcatgtgtgaagtcttcatttcttccaaatgtcagtcaccagtttttaccaatcttcgaagtatttctgaaatctatctgttcaagcgtatctaatgcagctgttcacagcatctctcccagtctgttgccatagcttcctgactggtttcccagttaacagttttgcctccttcaaatctgttctccacccagccatcaaaatgatatctttaaaatcaaaattgcccttgtcagtcacctgcaggataaagtcaaagttcccaagtctagcttcatcttccatgtcattcttcccctcaggctatagcaatgccagcctttttcctgaatgcaccatattgtttcacacctccatacatttgctcatgattttctggtgttagcctgtcacctactcattcttttaatgtgtcatttcctccatgaagccttagctgaaacattcctctatactgttaatctgggtataagcctctccctggtgctttaatagcacctgcagcacaactctcatttcatacattagattaaaattacctgtttatatgtctgtctcctcatgctagaccagaaaatgctgtatttgttcacttttgtatccccagcatctagcacagtactcagtatacaaaggtattccataaatattttttgaacagaaagaaaccag

SEQ ID NO: 14606 - DNA, 83178 bp, Human
cacctgtctgaaatggaattgaatctcctaacttcttactatttttttaaagccacaaatcccttttaaaatgtccgtttaaggctgctaaactcacattgttatagagtatattttatatacttttcttccttttaaaagatcatatacacttttctcctggcctctaattttgccaaatattctgccataacagcaagctcacagaacacaagtatttgcttaaagatatttaaagcaaatccccaaagagttttctgttgcaaatgtattttaagacataggctgaggagctgagtattcaaatccatgagttctgacactgatgttttattaggcctacccacatgaaaattagtgcttacttgcacagttatcttatttaaaaatacatttgcaaaaagagaataatttcattttcactgattcaaaggtctatcttttcgagtattataaacttacatagtacaaaaagattggtaaaagggatgagaaaaataaagggcaatagtaaggtgagtaaggaaagcaaaattaaacttggagacttgggttctaaatatagcttgtctacatcctagctgcaagatcttaggcaactcaactaacctctctgaacatcacagataaaatggggaataataacattatctagctcaagggtatcgtacaaattatacaatatatgtaaagtgcaaagcatagttcctgcacatagtaagtgctccataagttaaatataataataatcatagtaaaataatattcttaactacaatcttattaaaaggttattacctagagtttaagctgtggggttatttccatttgcacaaagtgtgatagaaatttggctctgtagttcctagcagccaatgtaagagtaaaacaaaaaagtttgtaagtatcaaaagatttatttacttaaatataagaaccctacaataatgcttccaaactagggtttgcagaattaccacaagggctctgtctgtctaaaagtcccccaagcattatctattgttcaaataaatgagttgcacatgtgtgtacttttatttttaaaggcatatagatattgtattaataaaaccaattcatctaattgtattgttgaatttatactttttgccagtaagcattttcctaatagatggacttaactaagaacatcagaatggtgaagagcattgtgttaatacaattcattgtcttatttgttaaaaaagttgaaaaagtattgctgagaaaaaggaaacaagttaacttttgttaaaggtatctcttggttttcactgtcctttccctcatcagtagcgccaagaacatcttaagtcacagaaacattagtttttggaagcagggtttgctgtaactatagtagaaatgacattctgattccactcctagcttcacaaggatatctgtgaaagatttggggcaaaactgttaagctgtctgaaagtgcttttgcataagaaatgggttttactgctaaaactgtcatattgctgagttttgaatgccctaatggtaaatgatactgggttgccaaaaataaccagattagtagttttttcattcatttggccgtctcagtaagtcaaatattgatactttctactaagtcatcttgccaacacccattttgttatacttatgctgaatctgtttgtcatctcttaagtaagaaaattattgattattttgtggggatttaatttaaaaaaaatggtaatggatactgtaaaggagcattatttggatggtttaaaaacatcttccttgatgggaaaatcttttaaaaggctttctaacttggtgtaattacttgaattaaggaagtgcaatgccattctactgacttagaacaacttttttgacttcctgcaaagaggacccttacagtatttttggagaagttagtaaaaccgaatctgacatcatcacctagcagttcatgcagctagcaagtggtttgttcttagggtaacagaggaggaaattgttcctcgtctgataagacaacagtggagagtatgcatttatttatttacttttacatttttgattcgtttttacagagaaaaacttctacagagataacaattattttgcttttcagaaggacgcatgctgtttcttagggacacggctgacttccagatatgaccatgtatttgtggcttaaactcttggcatttggctttgcctttctggacacagaagtatttgtgacaggtaagtacaaggatattaatattttttaaattattttttctcttttggaggaatgtttgaaatagacataaaaataatttaaatgtgttggtaactggaagtgagaagcctgctgtaaaccatcaagattgttgtctcagggagacatagctagttgtgtgacagaatacattgtttctgtttacaaagacataaatgtttcgggacaaaaaatacaattttaaaaggaaagcaatgtctatctgtatctttatttacaactgttcaaagatattacaaaagcaacattattacttaacttccaaagtgacaataacacacatttataaaagcctgagaattttttaatgataaaataagtgagtttttattcttttaacaaatttgatcttttaaaaagtcataaaacagctttggttgtatgtaagccactccctcttttcagacctgaagtttgcttcctcaaattttgaatttaattgacatattttattgaatacttgggtatataatagttcaaaaatatattgagatatttagtaaaatattaactttctgcaatttttatcacagaatgtattttaaatcaagtttttagtttcttgttaatagttttaatacatttttgctttagaaattcttgtggagccaccgcccttcctgggtggtgggtaaatattacagccttgatgagatagaaatatttaaactcttaaaaatcatgcaaatgctgtattcagtaggaaaatgcaactagttggacttccagtgcctattaaagtttgaaatctttgcacatttatggtctattcaatggatagttcttgagcggcgtcaatatgaatcatgagtacatttcaatagattatagaatgtaactaataattaatatttaatatttctctttatgatgtagtatctaaaaggacattgaaaataaaatttttgtagaaattccaaaaagtataaaaagtattttaaaacaacttgcttattacaattcactttgaagtctttttttgacttttaccgttcttctttcctctgaaagtcagggaagtagctacctcttgagcatgttacattgacaatttctatttggagaggaaagaaagaggaaagaaaaacaacataagatttttgttgttgttgttgtggctgttttgctttttattgcaaaggtgaattttttaaaaatctatatatttgcagcatttgtcttagtacagaaaatgtttatcaagttaccatccctttaaagcttatgataataaaaagtaaattataaagaataataatctcaatgaagtgatatatgtatattatcacaaatcagaacagattttcatttaaaattcccactcaggaaatgtcgaaaagcatttttaaatgagcataaagaaatactgagacattttgtaagccagaatatttttcttctcttcatattcatttaacttctattattttcttcaggtctagctccattgctttttattccaggcaaacttcccaacctcctgaatagaccaaatatcctattatatgcttaaatcagagtgtgaaatatttcctttgtgaataaaaattcaactcattctattacaggatgtttttttaaccataagacacatctttgaatttataattgaaataatatgatggggtctagaaacctttatatcaactttgctgaatgatttataccatagcaaataaatggatatacataaatttattttgaaaactcaactttatcttcagttgctcacataaatattgagagcaaacatttttctaaaagacatttgtagactccctgagatatatgcttatttgtggaaaaacatatacagatataatcatttgtatctgcaaatattgtttataatcctttcaagttgcaagaaacattttgtgatttaatgtataatttggaaaattcttaatgctttaaattatttatttttcttttttagcaacaaatgagttggattctatgtttcattttaacgtgttaaaattagtttagtgcctacaggaaataataaacttttggggaacaaaatttatattgtatgctgtaaaggcataaagaaatagagccaaatgtagagagccatcaatggtaactctatgcataattcaaatattttatttaatatctaaaatgcacacacggacaaggccaaagttaatctttgccacggcaacaaccaggcagggttcagttttactcaagacttcctaatcctcttgctctgtgcctctttgccatggcaactggaagccaaactttgtttagaatttctaaataatgttaggggacaatgatggttttaagaaggcaggtgaaggtgagtgttctctggttctaataaagttgtaatgccaggcagatctaccacactatagcatggcagttaggagtatatgagttatggtatgtgaggtatatgatgagttttgttatgagtcataacagttaagactcatttcctggacataattcttcatttttccatctgtattaaaaatatatatctcatgttataaacatggactgtgccttgcacatcacagacattcaatgaaaattatttaattgaatttggtaagcagtcctattaagttctaaatactccataatttagagatttgggaatgtgattagaattacttattaatttgaaaaaaaatgtcctactaaaaacctgcctgtgacctttatcattgctaaagtttgaaatgtactttgttacaggaaagactacggctagggcctatattatctttttctcttttgttctgtgtaagtaagtataggggcagagtagttagcttgaacttagttctttctttgttctggactatttgctatcctctcaccagtgacaattaaccagtatagaaatatagatgtttctacattgttcatatacttgaacatatatttctttatgtagatactcacacataaactagttatatatttgtgggttatatatactagtcaatctatctatctatctatctatctatctatctatctatctatctatcagttctccatgtttgtctatttggcgttcccatgaacttcagaccttcgcctgtgttctcttttctccatttggttacgtatcattgcctactatgtgttgatcactctgattctccatctctagactcatccctcagaaacacggaacttactacctttcctaaatccagacattaacatgctccccaagtcctgaaattttgctttgtaataatctctaataacttcttgctttgacacctccattgccatcatcttaattcatggctttattatttctcacctgtaaaattgtaatagtttttttaatcagtctgaagtctcatcctttttttaatgtaatctacagcttaaaaagtaaaataaaaagtgaagggttactgatttcttctcattgcctttggtataaattctaatcttttttgccagagaaactggttccactaatgatctgggggctaggcctggagctgggaagggatcttttttcttttctttctttctttctttctttctttctttctttctttctttctttctttctttctttctttctttctttcttttttctttctttttcttctatgattgattaaaagaaaacaaacaggaggtagttttaacacccacctctatactttctcaaggtgtttaaggttctgggcaaatcctacttcttctattatgttctcttatgtcacttttgccacaaaatatttccattgaattgcacactttttatcaccttttcttggcatttttcaagtcatttcaatctgctcttttttgtgatgatgattgatgatgatgatgacatgtgaattagtggatttcttgacattgtaacctacatgaaatcaggtataggagacacaaaaggcataaactcatagttcccatacctaatttttcaccagacactgaataaatcatagattaaaaaaataaaactgcatattgtagtgacaaaggaaaggaaaattttcaaagagggaagtcaaaaagagggagaatatgagataaaaaaattaaccagaggcgaagtgggaggatgaagacagcaggactattttgtccagattaaattaagttgattttggatctagatgtttacagtcttgcctttttgtttttgtttgtttgtttgtttgttttttctttgctccctttcttactctccttatctcacctctcgtctggaaagagcctcctgacttcctaaaagttcatagtttgagaatgtttttcctaaattttctttgatctgctctttggacattctaggtaatgtaatttggagggtcaattttatttttcagatacacatacccataggagaaaaagcaaggaatgggagggaaatacaaatgtagcggagtgataacacaaacagatcaggtccagtcatggcaattgctggtttgaacactgatgctagtgctctgggattgcttgcaagggcagatggaatatggtgcaccctaggtgttgcattatttgcacgacaaaagtttgtagagagctgggaataatttctttacagacagtgtggtgatgaatgtcaatctgagtaggtaaggggcagagatttgtactgaggttgattcattctcttggtaaatacacaatgttcacaaaggcaaggtttcatcttcagaccatgtgtgtatatgtcaccttggtgcagagagagaaatttttcatcagtgctgacctttgatttttttttctagacatcttatagatttatgtagttatttacatgggaaacaattagaatggaaatttaacatatcttcagtttaaaattaatttctgtctagtctaaatatctttgtaagtactagatactcaatcccatagcagtggccttttaccaaaggcttagtgctatgacttttgcatacataaagacctcactttttaagatatgatacaccagaaaaaaaatatggcaagactttagcaatatgatttgatgcctatttctatataatacccaaatatacaggaataaaaattatggcaatcactggattttgtgtacctggctctaaccaatatttatattagaaaatatctaattattgtctaaaatatttaatcttcattcctgtttgtatgtcagtgtgctacttcaatatcagtctgttaaaagagtctaggaatgactactataagcagagaattatatgttcaggaatcacaacaaaaaacaagaacaaatagagaaacaaaagctttcctactctttcatctaggacaagaataaatacacataaagtcaatattagtgaagtaaacaagcatcttctatatccattcatagtaccttcaattgattgatttcttaacagacaatcagcaaaattatcagtttttattagagattttagtagagaccgagcttaaacaaatatattctatggtgcttaactctatagtatttaaagattcaatatttatttcctctaaaaatgagtcaagtgtctgaaaggaaaaagccacctaactgaaacttcagtttctactatacagggtatttattataaaactgtaattacaatgcaattatattgaagtataaatgatcatcattcatttatttaagaatataatcaaaatttgcatacctggaagaaaaccatccaccctccaaaatagggatttgctaatgtaggagtagaaggcaaaagttgagggtaactcaggtaacacactcatacgtattaggatatgaacagctggtatagcaaacttgatagaaatcactgatagacaagaagacattctctgcattttaaattaaagtacaatttgtctgtggtcattcaagagatagtttagagaaacctatacaaataacaatgatgctaagagacaatatcaaaatcacaataaatatcatggcaatacagtgtggccactatattttaaacacatccacttgatgaaaaatataataatttactgataaaacatattaagcataatagaaaatgaggcagaaaccactccaagctgggaaacatcatgacatctgtagtgataaatattttgaaaatctaactctatgaatcttgtgatttttagctaaatcaattttcacccttgagacccaatttcctcatctataaagtgttgtaagcattaaaagttataatatttgtgaaaatgctttgaaattatgtgatactctgagaagtaaattttttcatgtgagcccatgaaatcagagcacatagccttttagcataaacttgattccaaatgatatctcttcctttcagacactgtgagcagataaagggatagtttaaggttaagtgatagaggcataatcccttataggcctttgaattcttttaactttgcattctttatttcagagatttttcaggcttctccagattctacagtctaaatagtttgtaaatccacacacttctactttgccagggatttcttagtgtaaaaatatcctgaagtctcacctgccttcaatccttactgtgtccatacccaccattaccaggataatctttgtaaaaggcagaacttacctttgtccattcctcttttaaaagctcctattggtagaaaatatactgaacccgtgatttgataccaagtatgttttggctcaacttttatgaaaacaaatatttaattagaatataccaacatttatgagttttccttaaagataaattttggaggaaaaaaactccattagaccaatttaattccctgatgattatatatatattacctagtgaaatccttggcagtttttccattttaattttaattttactgaactaatgtttagcagcatcactttcatttaatttttacaataactattagattcatgaatccattttacccatgtcaagttctactgaatatagcttatgcttggaattttcctttgtgattattacttttctaaaggtaattcttcttttcaaacaatacagatctaaattttccaaaaccatttaaattcttctctttggccagaaacattttctgtgtgtagttttggctaccgctagtttagtttttttaattggttttgtgtctcaatgctacaaaaaatataatttatgtaatttttcatttttgtcaaacttaaatcgggcaatattaaccattctcaattttttgttgtgttgaaatttctatcagtgacattaatgtggagattgacagctctttgagctagattcattttgaaattttaagactttcgattatttcttatctagccaatagaaactttagaaacacttttaagactgcttgatagcctggaattattatgtttgaattctcattcatttgtatggtattcctcttattagctttcacacttagtaccaatttcttattcattattggagcaaaaagtaaagagaagaatcaaggtgataagtttaaaatcttctcaatgtaaaatagtgtgtggggaaagtgtcaaatcatcctactttggtctttgtgcatttaggaaaaataaaagcaattagcattgcacacacatatgtaattgaatctcttcagatttgtctggctttatctctaaccactttgtgactctttttgtaacttgcatttttctaaaaatgtgaccttgtttggtcttcctactgttggccatgctgtttttccttctctccacatctttttatcaatggtgcaaattataaattgtattcaaatttactgtaaagatcatgtcctctagacagcccctatcccacttgtataacccttgctcttcagcccctttcacacctgcataggtattcttctgctgtgatgatcctttgaataattctcttggagttctctttaccaggctctcttgcagcaactggtgagctcatgtaggctatcactgggtctctgcttatttgccagtgcctgcaggtcctcagtacctgtttgctgaacaaacgaatggtctgtcagcttaacccaactctgtatgtagaaggcacttaataattcttaaaaacaattttgattctgtccttttattgttatttatgggaattatttatggtaaaaatttctacataatagaaaatttggaaaatgtcaagaaatagaaggaaaaagaaattgcttagagcccatgctaacattttgtttttcttcctctatcttttgatcacatgctgtgtatgaaatttcatgttcaattttttcccaagtaaaccttgattattctagacaatttgaaaaatatagaaatgaatagaaaaataagaatttcaggtttccagttctcaggatctaaaaactttttgagtatttcatttgactaggacaactagatctattcagttatttattaacttattagttcatttgataaacaactattttgtgagtgttttccatgtaatttgggctgaggacacctatcccatgaagcccgtattttctatcagtggcttcttggagatggtgttttaaatcttccaaaatcttcatcagcaccccaaaacttcctcctcaaagtaacaacataccttgctacagataattattggtgttatcaatgttttataaattataaatttaaaaatcactatcttaagatctatatataacatattaagtaaaacttatattcttacaagacttcctccaggtccctgttacaaccagattttctttgcagacttttaaattatggaagttctggtgctgccactgagttgtgtagattattattagatattcaataaataaagttggtagatgtgaagaggtactagacaatagtcctattttgttttggtttgtttgttttgtaatttattctgaaaaaatgtttatgtggagagaaaagggaaaacatacagaaatacacagcacacaaacaaattcttacttttttttggtagtctttctaattttccaaggtcaccagctaatagcaaatgagagttgtagggggtggggtgaaggctggggtcttaatcggggtctatctgattctagatagaccagattctagattttccactcggttactcaatcttcttagtggtcagtttaataacctggaatttaagacatgactgtgtgatgatgggcaaatcacagcaggactgaatgggagctggtaatttctcagaggttgtttgtgtgacatatgcatgtaagttcattcacctgatttagctacttacatgaaccattgtgcactgagctgcttctatatctttagcatattctgtatctatgtaaaattcacataagattgtatgacttttataaaaaacaaaaagacatctttgattaatttgtcttcactatgaatactgatgtgatgtgttacaatcatcctgaaaaggaggctaacaaaggacaggactgagtctgtcttgaggtgagtgatatgatggaaagaatggattttcccccacccaactcatttttgatattacataaagtgaaaaacattaaataattcaccaaagtatctagatttttttttgtttttgaagtgcaagggaagtaacttgacctttgttaaacactttgatcatggaaaacacataaggttctcatcttattccaggaagtgtagacactagataatcttttcatagtcatccaaaaagcatattaagtgaaccaggtaaatccatcctacactttttattccagagacaagttggctaaactttgaggagactaaaacaaaacaaaaaaaaattattgtttggttcatttgataaatgtggattccaatcatataatttaggccaaatattatactttgacttcttagacttagatttccagatagtctggtttataaaataagattttaactatgcttactaaactctatgtatttctactttccaatgacccatgttcttattttctgaatttacttattgatgctttaggtatgataaaggtatgtaatggctaaggaaacataaatgaagcataagacatcagttgagagttttgacggaaaggaagtggtgatatgaaggaaacagataaaccaaagaaaaaggaaaaggtcagggagctgataaaagtaacttgaagaaactttagtgcaaatgttggattcagacaatcgctacttttaaagtacttaaagaagtcagtctttgaaatcttgcccgtattccattccagtttcatcattggagacttccaatgatgaaaaattggggaagaattaccttccaaagcctcagtttcctcgtgtgtaaaatggaaataatagcaagagatattaaatgagatgattcactcatcgattcatcaattgtttatagagcccctgctaagctaaaaactgttttaagtgttgacacagtggtaaagaaagcagaaagtgtaactacttttatgaaactgacttcctagtggtgagagataacaagaaaacaaacaacaaattgagataacttcagttatagataaatgctgtgaagaaaattaagtagtgtaatatggtagagtttaatctggccagacccagatttaggggtgaatgcacttttagacagagtgatcggggaagatccttatgaagaagaatcattgagctacctgttggctgacaagaatatggggatccatgtgagggagactggcaagagtaaaggttatctggcaaaaccaaacaaattggtaggttcgaggcacagaaaggtcaggcatctgtagtatggtgagtaagaactgagcaggttgtggtgaggctagaaagataagcagaaggcaggtcccacagggccttgatggaaatggaaagagcttgaattttacctgaagtataaagggaaggaaccattttaagttcttaagtacagaataacctaatcttctttctgtgttgaagagatcactttgactgttatgaagagaatagattggaagtaaggcaaagcctggaagcagttatgaggagactgaatgggaggatggagaaaggggatggtgatctggaccaagtgttggcagtgcaggtggaaagaaaggaaagactgacatagaattaagagaagtggctgcatggaaaagacaaagacattttagagaatgactttttttccccatgagcactgggatgggaaagagccaaattagggggtcagaaatccagagttatgtttgggctgttattgatgtctgattttcattaggtggtagagaggtcaagaaatccgttggagataagaggctgaggcccattcagtaggtctcaactggagacataaacataggagtcattgcattcagatggagcttaaagctaagggactgcatgtgacagtgtaaataaacatgtagagagtagcagatgactggtttctgagccttgggaaacttcatatttggaagagacacaaggaggagctaggaaaagatagtgagaagaggtagccagtgaaaaaaagtagaactatactttgctttgaatgttgaaaagggttggcattatagtgagaattcagtaaattccacataaaaatctgaatttatgtctcccctagaaaggttggttgtgaacatgcaattggtaaatatctctattaactttaatattgttacaaaagtaatattaaggaatttataatatttggaagaattagatgtctttacctaatatatcccttgctagcttaacaattagaaaaagaaagaggtacatcttaacataatttgttttaataaaaactacagaatatattgagagactaaagaattagaaatttaactgaaaatttcatgcaaaggtaatgctctgttgaaccattttgtagcttatgttttgttttgatacatattttaaaatattgtttaagacaatacttgaacagattgggattgtgtgtgtgtgtgtgtgtgtgtgtgtgtgtattggttaaataactggtttatttttaaactgaaattaaaccttccatttctttgagaaatttaaaaagtagttgttatcaatgtggcagatattaggtagaatctaatatcgtgaaaattaaactgcacataaatagatataaatccttttgtcagtgtgtgtatatctctgtgtgtaattttgatctcaggcttggcaggtttccttaaaacttttttttagagctacttaattttgtacttactggtggttagctaataagaaaaagctaataaaaaatagtgcttactctgtgccaggcacttctgttaacattttataaatgttatctcatttaacaagctcatgtcattgtatagtctagcttatacttgtctttaacataagcaaatttgttaatttgtgtttcctgatattatcataaaatttactggttgtcatatcctaaaagggaatagttcaatttaattttccttgttctaattttaaatacagtactaaggttgagaaagaaggggtcaggaaagggaagtaacattgagtgtctcgtgtgcctggcactccatatgatgcttcaatgcacaccaggctattcagcctcagatttgtttctacattgcttctagttctacagattattcaacgaatgtacaatccttggtcactagtcttaatagggaaaacagaattatggttaaaacaaaagagtaagtaacttaaatatgatctatcggtatttattttgtattatgatattttgcttaagttgaaaaaagggcgcatcaggtgttttggcagtttactgtgatctcaatagtgagaatgtattgaaaaatctcagtacaggagaaagctgtgcagctttctcttcctgtcgctgcttaattttcatgtagatataaagccgcagtttaagcacatctgcttaatccttatttaaaagactaggagagaactagaaagggagggagggagaggaggggaagggggaagagattgagagaaatctctcccatataacacaaacactgtattagtgtgtgagaagcagataatcgtgcatgtaggcactatcatttgtgaaatcagaaagcataatttactcccaatgctgaataatctagttgtgtgtaagcaccagagagatatttaaatacctatccaataaaagataataaaagcctagcaaacctaagtaatccattttcagatgttaatccaattacgtaaacaaatattacccttttttttttttggtcattgtttcaaggataaagtgtaaatgaaagaaatagcattccatctaggtaaaagaggaatcagcatcattgaaatgtgaatagctgtgattcctccttgctgaatggtaactttagaagagagggaacccaggagtccatccagaggctcaaggaataagaggttctcacccataggaagatgaaaaatactttcagggtgacccatgagggaaaatcaccaaagcctttgaaataaaagattttcccttttctaagaataaaagatggtgttatgtcaagggcggctcgatggtgtggatgaaagaactattgggaatggctactgaaagatcaaaggcaagtggaacctcaaaattctggaagtagaacgagtcagatacaatataagaagtacttcaaaggcaagaaaataagaataataaaaatacctttagttgtcaaatgtaaaatttgtgccagttttgtcacattccatttttcaggaacactgtaaaggtattttctattaatatcaatttaactgtacatatcttcccatctatcttaattagtcacttttcaagaacaaatgtgttatgctcaaagcatccaaaggacttttttgttagccttaataaaatgctttctcttaaactaaattttaatttagtttacatgtctacgtataaggtggttatagaaaatgaatgtaaaatcacttcattaagtgtaacaaaacaaaataatatgaggaattgttatactgtttaagcatttgaaaaacgataaaggagtatagaaattttgttaccactactatgattagtttctcatttggtttttcactttaagaattggaataaaagttgaaatcttgattaaaaaaacaagaaatgattcacaaattattttacaaattgaaatactgaaatacagaatgttcaaccactgtcaacatgaactcctattctgtaattaatctattctataaacatctgtatttgctaaagagcaacagatcaaggaaaagaaaaaataatccttgccatccatagagccatgatttttgtggaatcttcgctccagtttaagttttgtcagtgtctggaagaaaatacttcccatggatcatctttttgctaaagagtattctttacattttaaaacatatgaatatttacataaaggtgtttgtggaaaaggaaattatgtgccttttattttaattcacccattattctattccacatgtaaagtagaaaatactactttaagacaaaagtaaagcattatttatttaaagatctattttgtccatgaattttatcagaggtaacgcttcttaatgttattcagtgccataacttgccttttttctaggcctccattttatgaactgaacatctggatttgatggcaagaaaacatttccttccgctggcttttctaataactccctcttacagatatgcatgcctcatgtttgttaataaaattgacgtgattttaatatctggtattttaacacactgtgaattatggaattttcagtggctttatttaattaaatgcattttaaaatccttacaaaaaaatattaagagtaactctaaaatgtattagagccacagatgttttcctttatagtgttaattgatttaaggtccatcaaaatgctgttaaaatgtctagaggttaacaataacagtggcacatgggtcagattaaaattctttttgagtaaaataaataaataaatgacagcttattttcttctgatttaaaaaaattagctagtggattgaaacaacaatgtgatagctaagatttcattctctcactttataatgaaaggagatttaaaattagggattatatggtacacgaaaaatttatatacacagattacaagtactagtttttttagtgaagaaaatacaactatatattttctctttttatctgttgtcctattttacaattgtagcaattaatctgccaaactctttaatcaataaaatatggtatttaacaaccaaatttggcccctccctccccttaaatatatttccaatgctccttgctccattttaaacctgctgtcctttataagagaataatatattttgtaatttgagaaaatcatgcaaaggaaagtttctcaaaattcacattaatatgtaataatagtaataaatatgtataaccataatatcttagaattttacaatattttatagaaaacatgaatattaaagtgaaaatttaaacacatcaatttttcatgttaaaattactaagaatgaactacagattcatgaatactaagggcaacttttatctcaggaaatatatcagtggactgaaaatgtcaaatcaattcaattaaatcagtaataacactttgctgtttatgtggctgttttttcttctatttttattgtcttagattgcatggatacaatcaaaataagttaatttgtatacaggatataaatggaccagagaatgtgtcttctattaaataataacaaataagaataccttttattttgtgatggtctttactatttactgagagacaagtattgttcaagttgccgtttttttttaattagctgacatatttcctgcttttatttgagttagaattcctgtaccaaacattttaaaaagagaaaaaaaattaaagaaagagaaaaggaatttggaaactactataatgtaaagtagcattatttatacaacaattaattttagagaagcaagagaccttagaaataatctatttcaacgcatctattttacaaaaaagaaaattgaaactcatagatatttagtgacttgtcctttgttacaccaaaaatgagggaacttggtctagaattcctccagcatattatgaggtatttgttctgtggcctgatacaatgaaatgaatgttggattaggcattttgggacaagttttgaatcctaactctattactaattcctcttcactagactgagattctggtatgtggtattcaataagtgacttgacttctttaagcctggtttctttttcagtgagatttacagcttagactagtttctgaatcttgaccctgtggacaatctagttggagaactgagatgacctgggcattgtaggatgtttagcaacattcctgcctctgtaaactagacacagcagcacatttacccaacctgctctgactgtgacaaccagaaatgtctccaggcattgccaaatgtcaactgagggcaaaattgcctaccctagccaccttaactgaaaactacaaacttcattgaaataatttctttatggctcccagcagtaacactgtgctattctagaccagttggttaaactactggatgcttcatcagaaagcacccactaagcatcactcaccatgaagttcgttgggtactctatacaatgaacaaaggagatatcacataatttttaaaaaacttaaaagattcacaggtgagaattttgtagtaacaattaagtattaactattagaaaaatttaagaagttttaacaaaatgatataaaaatatattcactataagtaggatgtaatttttgtcctgtaagagttatccatgtatttacgaattgtacctaccagaggttacaaaaatttggtcattatttgaaagattaacagggacttatttccaatcatagatgttcactatactattctaagacatttgcaactgtgtaaggcagtcatttccagtaagaattgctagaacaaacattaagcatttcacagtgaaaagggtcataggtatattttcatcctttgcatatagaagaaatagcaatctattattctcagtttttgacttaaaaggtattgttgcttccctttctttccctcccctactcaagtttttgcccatggatccagatacctacaagggcctaatacagggaaagtgcactgtgtatgagctatgaaggcacaatggaagcttgcctggcaatcagtgccagaacagacagctagtctgatgaattctgctacacatcacagggctactagttttttgttttttgttttttttttttttgtcatacattactgcaagttccctgaggaagtttactgatctgtagttttacgagaaatgcacgtcatggaggtggcgtgggggagcgggtgaacaaggaaactttagttgctataaaacaggagctgagagctcaagcaggttggttatgttctgccagatggagataaaactgtggcagccacatcctgtgactagaaattgtttaagtaggcagacctgttggaggactaaagaacattaggcaaggagattaaattagtgtaggaaaaaaaatcagttttgtttaaaacgaaatatctacttgtgttaatagaacattctaactccaccataggatggaatcaagaggttttttttttaatacatatagtgtatatatataaatatatatatacacacacacacactgtatgtattcctatgtagattaaatattttgatttacctctttctagtaaagcaaagttcattctgaaatccaaaatattcacttactagagcagaaaaaaattagctgtgcatttatgctgatcacagtgtagataattaatctttaagaaagtaggtttttctgtttatagttgataaagtgttagtggcaagaactttttctgttattgaatattatcatcagattactcgtgctttccattttattcctttaaaaaaatccaacttttgtaagccaccactattttctgaagattttatttctctctaagctaagaaaggatgtcaagaataaaccattttctccttttaaataaaaatgcattcactatagatattcatttgaaatctcaaacatacctgaattaagtatactcagttttgtgagtgaaaattaattattatttaaaacaaaacaaaacaaaaaaaatgttcagtgttttcattttacttctcttgctgcttttgggctctgactgggcccggaagcagaagttgcaaaacattatgagaaaacttttgctcttttcttttttttcttcaatctccacccatatggaaataccagaaatctgaaaccccattcttgctaaatattcttctcaggattgtatctctactgcaggtcttctatgacgttttacagctggcctctttccattcagaattgctgttcatctttgaatgtctctgctttactcctgaatgaacacaaacacattttttttaggtttcttgttgacattggctttctttatagcccataaaaaatgcatttgtggcatctcttccacagacaaaaatagtataattatgattcaatactcgatgaatgtgtgttaaactaaactgtgcccaagctctgtgcaacagtacaggtttttcacctttccaggggagagatgtggagcacatatacatttcagccatcctacatgcccacagggacatctttctggtctgtctcattggaatacccttccttatttggtttttagtttctttctgctttaagcacctttcagagagagagagatgttttcctttgtctttgtataggcagtgcctatcgttacagagtagcctttaaatacatatttgttgaattaataatgatacacatgaactgatgaggctctataattctatgagataatctggtatcgtgggaatattttagcatgttttgtatagatagactgacactatgactggtaatctgatagtaaaaatggcaaaatattgagcctgagtattattttattatgttgctttcttatacaaggagggaataaaataaagtgatgtggactgtaattgtgctcatgaaagacacaatgtatacatacctccttgagacggaatgataaggataacgtagaatgtttaccatgatttatcaatctctcctatataagaaaaatatttcttgtcctgaagtggtaactttggtgaagtcttttgcttgctcttttacagactaattaacaagttttctatgccggctctgtcctttcctctcctctcacccctgaaaagtggttaaaagtttggcatttgttacccagaatactaaatgtaacacatatgtggcaagatttgatggaattgcacttctgttcttattatgttcctttctggaaaattatgacaatttgtgtccccttagagagtgtagcacagttttctggttgctcctcatgataatccaaaaaaaaaaatccagctaacccttaccttttagagtaagaatctttagaagaaagagtgctttcatcaaatcatttgagaacgttaagttgaataactgatacggtactaccctacagacatgcgcaggaagtatctgcatttctgtggcgttctgctaaggaaaagaattttctttccagacaagatttttcaaaatcatattttaaaaatatcttaatgatgaatttgaagttgagaaccaacttatttcaagtaaaattaaaattttgagagataagagaatatactttttttaaggttagaactcagaggccattatgacaattaatgggctagtggagacacctggtctctaagaaggagacaccagcttcttcatgttttgatttctgccttgttctcttgtctgtcaccactagacacatactattttatagtaattacttgcatattttgtagaaaaggcagctgtgttttctacaaatatttcacaaatgttagtattgctctatgccaaggaacagaagacaaatttgtggaaaagatacatgtggcccctccccaggtgggatttcttgtgtaggccccatgcagtggagggacagagggggccagtgctcattttgaggacacgatagttcggactgtctgaggaaatcgacagtgtgtgtttaatgaccaaaccaacatggctttgaagaatacatatatatttttttttttgctttttttttttcattgcccaggctggagttcaatggcatgatctcagctcactgcaacctacgcttcccaggttcaaggaattctcctgcctcggacttccgagtagctgggattacaggcatgcaccaccatgccttgctaattttgtatttttagtagagacagggattttctatgttgttcaggctggtctcgagctcccaacctcaggacctcaggtgatctgcccgccttggcctcccaaagtattgggattacaggcgtgagccactgtgcctgaccaagaatatttttcttaatttttctgtaaaactagttgttttagttttcaaagaaagatattttggtagtttttctttaaaatgcatatcatcatacagaaatcattgtccacgtatatggacatatatatctatataaatagattatatctatataaatatatagatatatttgtccatatatatgtccatatatatatatgatcttttttttgatatagtgtcctagacctggaattcctgtgttaaaaaatgaaaacattttcagtctcttcatatatattgacaaatggctttcagaaaagttgtttcctctattctcttcctaacattgtatgagtttcctttcacatacttttgtcagagtttaattttatcattttcaaaagtgttacttttataaaaactggtatttcttcaatttaccattttgtgattaatttaatttttactgtgttcagggttttatcatatgcttattatttacatttcctttgtgaattgtgttcctatgatttgcacatttatcttttgtgcagctgtgtttaaattttgaatataaagttatatgaaagaggaaatatgtaatttacataaacacacccaaatatatgttgtgtgtgtgtgtgtgtgtgtgtggtgtgtgtgtgtattctgtgttgaaataaatggtagaaccaggacaacaggtagaggttatgaggttgtcatctgtgacacagtctagaggagaaactgtgtgggcatctatcaacttacctttttgaaagaatcttaactattagtttctggaatattcagagaagacttgtaaggccaacatggactctagtttccatcctcctgagaagacattccattatgaaatctaagtaactttgacagcaaacccttcagtcttatcattttcattagataatctaccaccaacacaatgatccaaaaatgcattatattcttgcactggagttcttcactttttgcttcaccccaaaactgccgctcctaaccacatgcttagctgctaactttcacaccaggcttatgagaacagtattttcagtaagctctcttttcaattcctttcacaatggagctgcagaatctttgagttgaaagaagccttagaggtgactaggatcaatgtatatatatccctcttaccacacacactcactgaatattttctaaaaactacattaagaaaaaaagaaaagcctaatttagtgctgaactgctgaaatattttgaaatttgtggtttcaaaatcttaacactgttaattgaaaccaatgtttctcatgccttttagtctctggactcctttttaaacattcttaaacataaacctaatttttagcataattgtggaatataaagaggttttgtctatgtgggttatatatatttattgtaaaataaactagatagaatttaaaaatatttaattatttattaaataataataaatcaatatattaatataaatagcacatattgtatgaaaaacaaccagatattataaaacaaagatttaataggaatagtgtcacttttttgcatttttagaaatcttttaaatgtctgtctgaataatagatagctggattctcatatatgctttaatattctctatctgttgtaatattatataccatatagtttctggaaacattaattttctactaatgagagaatgagagagaagaagaaaaataacttcttagtactgttaggtaaataataatactcataacacttaattaatattattttgaccttgaagaatctttaaaaggttcttggggactatcttgagtctccagaaaacactgagaaccactgatacgccaacaagataaaattcttatccttaccgcagcatggaataggaccatactttcttccttataataatacttcaagtatttgaatgtatttattgtattttcatctatactattattttttaggacaaaatagacttctttaagttttccgtatttgacacattatcttgctcccttccccactacctacctccggttagcctcctctgaatactcttggatttcaatttcatttataatgtgtgatattctggactggacacagcacttcagggacctggtatcttgaatcaacaaagacttgtcttccaaacgatggtgattaagaagccaccatgtccaactggtcagccagtttttatattgtacaaatcagcaatctcagagtcaacctaaccagatttaggcaaggcacttccatgatgtattgatgtattggctattttattaatagtaatatcaataaaaataatcattaagataactgataatattcaggacttcatatgtgctagatgctatgtttaatgcatacatttattcactcttctaattcttaacaactttataatgtatatgtatttcttattcttattttatagataaagaatctgaggcatggaaaatgtaggcaatttatttgagattacagagctaataagaggcagagccaatgtttgatctgaacaacttgattctaggatcattttggctgggaattttctgagagctgtgtgtgtgtgtgtgtgtgtgtgtgtgtgtgtgagagtgtgtgtgtataaacatgagaccatattagtatatacacaaatgtcaatatatattttaaactggaatgttttaatagagtggcttatatgatagaaataagagaaatagaggaggatggaaagggacaaaaaaagggaaaagtaattaggaatattgaaaaacctaaaatgtagttctctccatattctggatactcctgcctttttcttccactttccacacattgaccagtattcctttctcctttcctaaaatagttttacagatactatagatacccttagctatttgacagttatgtttctgttcttttaacatgtctgcttctataactgtcacacttaaatgttttcataggaatcatgaaaactatagtttttcctccaacgtaaggatctcatatcacgctttcattctgaactaaccattccctctctgcagttgatgtaactgtgccatgtgaccattgtacacatgtgggagggaggagctgaattacgcctgacccctggccagagcaagagctactggccaaaggggagattgagcatctgtgttgtacttcccacgtctcttcacctaggaagtgcaatagatttctgacgagtctatgattacccactgatgaataaagacaatctccctgcacaattgcactgcaggcaagactgaacttatgaccaccacttctgtgtaattttgaatttcttagacctgaaccctgctgagtacacctgcttccctctattccttgctgaagttcattcttttcagtgcgttaatggagccaaaccaagctggtggtggtaacaatttgaataataatagtctttaactttttatcttttgaaaaatagaattctcaggagcacttttagctataagattccttcatccaattaaataagctttaagcttcatgaaaagtgtaaaagggcacaggtgcatttgtggaaatagaaggaagcaatcttgagcctgaatacattgaggtactggcaagcttctggaagtagttgaagaagacttcagttagaagcttggtcaaatggacaaagccctgacctggacattggagacctgtagccaccttctgaatccacagctgacctagtggccttgatatataatattgattgcaggatagttttgtgatggttaagattgcaggctttaataactagatttcttggatttaaatcccaactctgccacttactgcttttctctgggaagagtgattaaccgctttgtgcctcagtttccttatctttaaatgaaaataatttgagtgcatacctcacaggtactaaagaataaatgattggaaaataaacattattgaatatatgttagtaattattattttcattgttatgctattattatttttattattaatgtatgacatcatgttacctgcctaacaacagagtattgagacaaaagcaaaatattttttctatattaataatcataataaacaccactaatgtttccaaactatacttttttttaaccctacatgcctttagttcatggaaagaaaagtatgttaaagatgctatgggggtgaagagaatgataaatattattatttaagacaatgtttgctataatttttatatatcaaataagtttatatgttctcagaaaattggtctttgaataattgaggacagtgtgggtttttattctgtttctggaaggcggtgcctgtggctgtgagaaataaggaacagaccatcttcccacatttgagagggaactatacaaaaatgggaaaatatttgttttaaatatcttttggatgtgaattttgtcataattgcaaactgttttggcagcaaaacgaattatttcggtagcaagaagagacttaacgatgctatgtgggagaaaaactaagtccctactatctttctgagagcacgtctcagaggacatgatgtgatcctgtaagtttgtagcaatcttattgtgccccagtgcagacactccttcctacttccctgtagaaaacagaactgtttttttaaaattctttctcaactaccatttttaatagtcatgttacttgatgacaaaatctgatacagtggcctttaatactatatagtgaatgatttttgaaaatttggaaaactctaaccgaaatataccaggaactgctctcctcttcatctcagatgtctacttcctcttcagacctgtgtgtgaagctctagaataggctgtttgggaagactacaaaatctcctctccgaggtcccttataaccctgatagttgctagatttgaaatcaaggatttattctccccctgccctgagcctctcccttatgtccacataggctctagcattggaagaaatattttaagatctctttctttttgactttgtgatactcccatattaaaaatggcttatgacaggaaaaggacaaatatgctatattttttcccttaaggctaatgttctcgggactaccatgaaaaatccaggtatcctaatctggagggttaccctttggatctgaatgggattggagtcagtacaaggggtggggagtgtttttagaacatcccggcagcatttttttttttttttttttttttttgagacggagtctcgctctgtcgcccaggctggagtgcagtggtgcaatcgcggctcactgcaagctccgcctcccgggttcacgccattctcctgcctcagcctcccgagtaggggggactacaggcgcccgccgccacgcctggctaatttttctttttttttttttgtattcttagtagagacggggtttcaccgccctgctgccttttaaagcaatttaatacatgagttaaatatcatattttaaaaatagattttattttttattataattttgatgaatgcatttttgtcaaagttgtcaaagtcaagaagtcattattgagaccctgagggtaaggcaggagccaagtgagaacaagcagatgtcaaagatggtgaaaaaccagaacagccaggtcccccaggcatatacagagaagttttgcaatggcaggtccccgtggttgtctgacccagacttccaccttgaggtaactggggtaactataacgatattttcatcctgatctcttcatgcagttatatgtttccaagaacagataaactgtgaacttaatacaagtgtctcctttccttggattctcaccatctgggtggtaaacatgacagaaacattcaagtatgttcaatgtagtacatggtaacaaatgctttagcacagactagggagcatgtctggcaacatgttggcaaataattaaattggcacattcaggataaaatgagaacatggaaaaacagaatatgattctcttcccagccctggaaagacatcccaagtgtacgtattgtttatattatgttattagtatatctttaccagcaaagggcaggtcatcatcattcaatatgctcaaatactcacatttaaagacataggcactttgagaggccaaggggggagaatcacttgagcctaagagttcaagaccggcctgggcaacatggcaaatcccatctctacaaaaaatacaaaaattagctgggtatagtgcctgtggtcccagctacttgggaggctgaggtgaaaagattgtttgagtcgaggaaatggacgctgcagtgagccatggtcacaccactgcactccagcattctagcctgggcaacagagcaagaccctgtctcaaaaaaaaaaaaaaaaaaaagagagatgtagggagcattgtggacatctattcatggagggttaaacaatagaattagacaaccatgtgtatgtgtggaatcatgtgttttttccacacatgtaggaaggagaaggtaggaacaatgaaaagattcttttagtgatcatagtggctccaaaacagatgctttggtatatgtaatacccatttatcttataaagaaaataaagaaataataaaagcatttgctaaccatgttagatgctatagtaaatgtaaaaataaagggtctgttaatatattaactgagcttaatatatgatgtgatataacagcagccttcaaatatgcggagggctataacagagatcatgatgaacagacttttattctggcttagaaagactagacacagaaattaaaggcataaattactctacaagcaaagcaatcttaacataacactcctttcaaggtagactatgaatatttccaccaataatatatttattaaaatagattccttttcatttgtctttttaagttaaacataatcttgcttgaatgaggatgagtataagatacctcagtcatgaccttgtagatcactgcatcagccagctttgtattcagctatcaaacaaaataaaatgtgatcactagtggttcaaatacattggagttctacaactaaagatctaaaggaatgaaatccatgactagtacaaagacataataatgccctaagcaacttacgatattttgatgtttcttttctgacaccccattcgataggcttttgtcttcatgctcagcatctcctatctcatttgggatgctatgcgtccacacctttcatcacattccagcaaaaagaaagggaaggcaaagtggtaatatatttttcctagtgaggttttgcctctttattcagggatggaaaccttccccagaagcttttgtctacacttattggccagaaatttaacatataaccattcattgctgtcagaggtgggaaggagtccctgagaaagaaattattcttgttttccagcctctattgtagcatttaacaaggaagaatgggattatgaatagctttggaatgtttatcatgtcttctagttgccatagctcatagtcattttatatgattgaatctatattaggccttttatctgacaagtttcccaatgtacaaagactgaaaaaaaataattttcctcagatgggaataaagaatgtcaactggtctggccaagtgagtttggaaagctaagatttagccttgggtgcattattgatggacaataaaggagtaggtggcactcatccattcattcagttattctagctgtgctattgaatacttgctaactgcaaagcacagagctagatcctagtaagaatatagaaaagaaagtcacagtctctgccttgaaaacatatttattttatttctaggacaagacatctacacatatacaaactgtcaattcataacatgtcatggaaacataaaagaaggtatcagtgaaagtggagtgtttaaggaaatttccatgcagttgatagaattttaatcctataatttcaataggtagtagctgtgtctcaggcattctaggcagtgcacagcaagagaaaagattgagataaagataaaaactggaaagaagtaggcaatcagtcatatttctgcaaagcaatgttagaaaattgcatgtgttagcttgtatacacaacttagcttacaatgttagcttgtagctaactgaatacagatgtgagagttaaaatatactctcctaacagtagaataatgattgttagagtggcagggatgatcttatagaaataaacattggacaaccagcaaaaacagtgaaagccagccatatggctatctggaggaagagcattccagctactcaaatccaaagtggtatcatggtgtgatgtctttttttttatttttgttttagagacagggtctcactatattccccaggctggtttcaaactcctgagctcctgtgattctcctgcctcagcctcctgagtatagtcacatgccaccatgcccagctaagttatatataaacataagcacagagtaacatggtagcaaaaaataatgtcacccaaattagggttttgaagacaatacaggagttagatagataaagaagagagggaagggcataacacaaaggaacaggaagtattaaaatgtgcgtgttatggacttgcatacaaattgagtgctttaattttgccaagcatctttcataacactataaggaattaacagtatgagatagcataagtaagggggcctgagaacttacataaacacccttggtacatggaaagtaaatataaaatggtgctgataattctaattacatagtttatagaaaagatacatgaccaagcttgaagcaagaatgattgataaggaattaggtaggttctgtataaggaaaggtgatttcagatcccaaaagggcatggctgaatgtttagcctttcagagttggggaatccatttcttcctgtggaaggattagtctttaggtgaatagatatgtatcgaagggaaattaagagagcataagaaaaccccactttacctgccatctatccatggaagcagcaataagaccacctgagagctatggtacaattaaattgaagatatttgaacacataaagtaggtgtaatgtaacatataggctcaaacatttgaaagtgatgatatttggtcattgctggcctacaaaagaaatgattttatgtgattcagtctaatggtaatagttacaaaggattgacttcttcgcaaataaaatggttgaaatagtacccaaaactagcagattgggcaaaaattacaaagaaatatctaagtggttgcatagtaaccacaaaaatgaacacacttattttcagagttcaaaccgtggtagatttgagagtatgtttggaaatgactaatgcttagtgttgtttaccctgtcaccacattcctgcataaggctctttatctctgactggtcatgctcacatctgttttctgccagccttttctggtgcccgcaggcacccacctgcacccaatgtcctccttttatgctttctggcctcctttcatgtactgtgtggtccaccatactacctaatctgctatatactcacaaaactatttacttcttttgaaaaaaatgtattattagatttaaatatatgtatttatatttcccttcactttttaaagttttcactttatttttatactatgttttaagcttccctaatatcccactgctgaatcccaccgacatggaatccacggcatggtgaatccctgacttacccattcctactagaagtagagccagaatctaatccagacctcctgccagccactcccagaccccttctttcccccaaagaaaatgaagaacatattttttgtgcaaagagatacaatcaggaaatttttttaaaatcagcttttattttaactgaatagcttacttagtcctggggctgtaaagtcaactgaatgatggagtcatttttttcaaaatgcgacatcttcttacccacttctcttattactctcatcattatgaaaatcacatttgtgaaaggaaatgaatttatatcaggttttctttggcatcacccaaaggaccttagtaaagaaaattaatactaattttattttctattgtgagcaccttaatacggaactgtaagaataattactatttttaatgccaaatgaagcatgtaagtattactagcttcttttttgtattaacttctatacttatctcaggagtttttatagtgatatagacattttgtgaaatagatcatgagtgaaacatagacctggtatagcttgactggggcctactttacagatttgtccttaagtactgaatataaatgtttctgcttcttattttccttagcatttttaaagaaagtcctggaagccaaaaatctccatgatgaaatatttataattattaatcactgttatatgaccttattatgtatgaaaactatattcaacatcctaaatatgaaatgtgattagttctgattttaaagatttgtgataaaacaagacaccattgatgaaatacatagaaaaaggaagacaaaatagcttgggacacattaataacttacacaaaaaattttaaaaattaaatcttctaatagatttgatatataatataccccagaaatatttacattatattttcaaagtctagagcatttcttccatagactccaaaactatttgtatatattatcatcgaaacacaattttgagagaagttggaatggcagtgcagttagcagataaaaaaaatacccacttttctttacaagtctctatctaattcatactccctattgctctttcctgcttcacaaacttcttaaaagattttttcatgtggtgtgaatatttaaaatctgtcttagcaattttcaaatatacaatatagctggccatctgtatttgtgggttttgcatcctctgattcagccaaccatggattgaaaatattaggaaaaaatgacgaaatacaacaatacatcataaaaataatacaacttaaaagacaatacagtataacaactatttacatagcatttattttgcattaagtattataagtaatctaaagatgatttaaggtatatgggaaaatatacttaggtgatgtacaaaaactttaatcatttcatagtgtatacatatatcaaaatgtcacattgtaccttataaatactcataatcatttgtcaattaaaaataatttaaattttttgaaatgtaaaaaaaaaaaatttttctagcctcccagtctacactctcacttttcactaacccatttactgctttcttgcttgttctcccagcacaccacaaaaacaacttccatgcatacaccagtatcacccccctcacccccctgtttccaataaattaaacccaatggaccaagctaaagcatttattatacttcacctctcagaggcatttaacgctattgacaacttccttcttttcaaaaccctgtcctcccctaattttcatgaaacatgaaactaccttctagttctcttatttatctcagccatctggctcctctttctctattcccttgttacctattggtgttggtatgtattccattctagaactttgtctcctctactgtgatgctatcatttagggtgaaatcaactactcccattgcttaatttgtcttttataaatttgtgacttctacatctatagctccagttctgctgtcttttttgtattaaagaccaatttctccaactatgcactagacacttccaactagtatcccactggtatctcaaattcaacattattgaactcaaaaacttcttttgttaacttgccttgctgtcatatttcctgtattggtgaattatatcagcttccatagacttgcctgagccaatataacctaggacatattctccttttcccttaactcagcattgactgacaaagaacatgctaggaagtctgtattcttcatgtcttaaaatattcacctctgcttccattgccacagctttgatttgggccactcacatttctgcagtagtctctgagattgttatcatccatatctctgcatttttcttgctaatgagaccttcattaaaattattttgtaagtatttaattatttagcagttcatgcctttccatatgacttaaaattccattgggttttgcttttttcctgtaacctaaagttacatctgggttggtcaaagtgaagcatagtaactacattccctttgatagtgctgcaattaagaccaatgaaatgtgaaggagttttagggaagctttttcctcagtcttaaaaagagacaaaaggaaacaatacccctctcctgtctctggttcatatttgatgagaatgtggcacctagtctttttgagaccagtggggtagttaggcccacaccctgtggatgtcagagcaaaaatatggaaggaatctgggtcctgataccatcatcaaaccattgagctaattccgttttgtaagataataaattccttactgtttactctgttcgagttccttttttttctgttagttgtagctgaaaccattttaactgttgttttttgtttggtttggttttgtttaatacggagtcttgctctgttgcccaggctggagtgcagaggcgccatctgggctccctgcaacctccacctccagggttcaagcgactctcctgtctcagtctcccaagtagctgggattacaggtgcacgccaccatgcccagctattttttttttttttgtatttttttgcatttttagtagagatggggtttcaccatgttggccaggctagtctagaattcctgatctctggtgatctaccaatcttggctacccaaagtgctgggattacaacccactgtgcccagcaccattttaactgtattctaaaagcattttacagcctgctaatacataacctcatctccaaccttgcttcctaagttccactctgtgttccacaaatgggattaatcacctactgaaagctctataataattcctgtcacctgaggatattgttaaaacttctcagtttgtagaagagggccttcattatcagcatcacatttattttccagaaagatatctagcacccctctaccttacatcttgcttttcagccaggaagaacaactttttctttctgaaatgtactagaatctcagtgttgggccacattgcttttttttttctaaaagactaatcgtcttcctttcccacctaactcaaacatatccctcttaacttagacattacttattttggggaagtcttccatgattaccctaagaatagggtaggcattctttctctctgcttccatagaaagtaggaaactattgcacttactcattgtaatgtggctatattttgatcaaaataattaaaaaatactgtgtggattcaaatttttctcagctactcacaagctgaatgatctcacacaagttatttattgcaccttattgtgctttctttttctctgaaatagaggtaataattatacatacttcatattattacaatgattcaggaagctaatgtatatggtatacttacatatatatatgacctagtataacgcatgatacataataagtgctgtgtacatgctcagtcaaataatggtcatttgaaaacatttattgagtaaatgaagaggaaagtgtttattttcaatacattcaaagatattgttttggttatttccattacagaggcataatcagtttactattcagaaaaatgcaagagtacatttttactgctcctccagtgatactatggaaaacaatgttttagaaaaataaagaaggtgtgaataatgattaaagaatcatacactctcaaagtgaaacaatttcccaagaaatgcggtagaataagccttttggtttctgattttttttcttaactttgcttgtatgttgtagaaagctaatctaaatttaagaaattgaaattttgaagtattaataatgtacttctctcccaaaattgttttaatgtaatgatttttgccatatggatgaattatatatgcatctagaggctaaaaaccataaaaacaagcttcttcttagtagacttttgttgtttattttgtacagcataaagcagcagtcaaaaagttttccaaacaaattatcttatgtattttgactaaacccagatttatcttcttaaaatgaagacctttgttgtagttgcatttgttcctcatatgcagtagaatgacccagcctctttggcttagaggtagtgcctcctttttacgacacttggagcggcatctgatgctcatcacttcagttggataaggaatgctgtccagtcacagagactcatgagatcatgtccaatgaaggcatttaacaataaattcacaactagtgagtgagaattttataaagcagtttcaagtattaagtagataggtaggtaagctttattatattttttaaatgtgaaattttacaattgtgaaaatttacaattttacaattttacaatgtcaggatggataacattgcctttttagtaatggtagccttcactatctgcattatgactgtacaataataacatataataatatatatagcatatatattttatatatataacataatatataacatatataataacatataattataacataataactggggctatgattgcaaacatttataagatgtggtatgaaaatgtcccaatcacaaaaacactcaatttaaaaatgaaagaaaatgaatctatgctatgctttgcttcatctttctctgaactagttacaaacaaaccttttaaaaataagctttcaatttgggaataattttagatttacagaaaagttgcaaagatagtaaggaaagtccccatttgctcttcatttggcttcctctaatattaacatttgccaaggttacatttgttaaaactaagaagtaaccatgggtacaatgctattaaccaaattacagctttcatttgaattttgcccatttttccaatattgttcttttcctgctacagcatccaatctaggacctcatgttgcatttatttcttatgcatctttagtcccctaggatttgtgacggttttctgtcttttttcttttgaagactgttcattgcctctgttagtttaatgatcctctgagatgttattcacagtaaaatagcatgtgaatttcacctaactaaaaagtttatttgatccaaagccctgattttaagaatttgaaagaaaaaaatgactctatttttcccagttctaaacattttactagaataataattgtattctttcaacatggaattaatgttgatgagaagcaaacatctaaatttaaaagaaaatatagtttgttgagggaggtaatagacaataaaatgtatttattatagaaaaaattcccaaaactttctcattaaatgtgctttatctttacttcattactaatatttagcttttattcttttaaaaagcatatgccaatgataatatctcattaataataagaatccatctaattttagcttgatcttccccctgactaggtttgattggattaaatcatcataaagagacaaaataatgcaaaaagtgataaatctataagcctcccctaaggtttcccatagaatgatcaacccaaatgtgctctttattttatgccatgaaatgacatactgtgtcaagaactgaatttcatcatacatgagacgtaagactatttttatatctctgtaaattgggtatgaattataaaagtatgctggtaaactgatcacttgagaacataaagtcaactttccctggaagagtttctcattataaaagaaaggcaagcatcttcttcctaatatctagctttatcaggtcaggggctatattctcggaagggataagtaatttctgttgtatctactaatttcatttaaaaagataactagagaatattggaagcattattgtagaactgtgtcaaagaccgaaatatcattcctaccttagactgtacctcaagatcgaagctctggatgctatctggaattaaaatgtttgcattaagtttaaaactcagtaaaataaatgtttgaaatgaaaaccagaccaataatgaataattttacttagacctactctccaaatgtgctaaaagacttgtaaaagttgttgttgttttaataactaagtcaagccagttttatttaattcaatacatggagtattaatgcgctgtatgaatgccgaaggtagtattggacgccacaatctttaggaaccatgcttctgagttttaaaatggtgactagtttagcatagattcaacataagcattaggtgttcttttgacatttgggaatcagccaatcaacaggaggaatagtaaattgaatacgaacttgaaagagaccatgtctttttttcatccaactgtgaaaaactttctttgtacaattgttaaacttaagaaacagatggtagatctgtatcagtcagtgaggggtttctgaagtacttttctggatgaatgccaagaaaatgggtttctgagacttgcatggctctggatttgttctgagctgtttagtgaagtgagggctggcattcagaacccaggggagggggagtagtcattcccattgccttgcatagagatagaatcacaggtgacaggtcattggaaaatcacttcttgagagtgggtatctttattttgagttggtatctttttgagagttggccactcataagccttgcttttgataacatttctttaaattcctccaaggaacaaggggaagtgcaaaaggaatacgataaagtgcagcattgaatgagataagcatattcaacttaaggggcacactaaatactgtaatctgggagcataactcagatttcttttcttctttgctcagtataagttgcatgatcatagaagatttatgtagaagtcagaaatcaaggtcaagagggtaggcatatttagattcttaccctattcataattaacaataaaataagattttgtgtcctgattcagagaatggatggctcagtccttataacctcttaaattagttttatctataactggatttctgaatctcttttgaaaattactaccattgatggtcactgagtgaaaaaagcagaaggatagactggtgttaactgtaatgaacatttatccaacattacccgtgggcctgctatccattttaaattctaaaagcactttacagcttgctaatacatagcctcatctccaaccttgcattcctaagttccactctgcattccacaaatgggattaatcacctactgaaagctctataataattcctgtcacctggggataatgttaaaacttctcagtttgtgagagagggccttcattatcagtgtcacatttattttccagaaagatttctagcacccctctaccttacatcttgcttttcagccaggaagaacaacttttactttctgaaatgtactagattctcaatgttgggccacattgctattttttttttttctaaaagactcatcatcttcctttcctacctaactcaaacatatccctcttaacttagacattacttattttgggggagtcttccatgattaccctaagaatagggtaagcattcttcctccctgcttccatagaaagtaggaaactattgcacttacacattgtaatgtggctatagtatgatcaaaataattaaatctaaacaatactgtgtggattcaaatttttctcagctactcacaagctgctatccattttaccaagcctcctgcatgtattactatgtctaatcctcatatcaactcatatataaactagattttatgattatggctctaaaaacaaggagactaaacctcggaaatatcatttaacctgtacaagaccttacttggctgagctaggattcaaaactaggtcattccgaggagaatataaagtccagcttttttttttccacacagggatgtatatttccaggtacagttttacattttgttctttattgtatgaacataaatatagatacatatgaaaattcgaaagcacatgaaagtgccaagaggaaatgcaataccatcttatgaaatgagaaattacacatatcttacagtgagtttcaaaattatattgctcaaagtatttttactgtggaaccataggcacaaactatagcaagagtaaatccaaaaatgtttattgttcttctataaactaactactgtgtaggatacaagggatgctgatttcaccagtgcctttaagaaggacaaatcaaattaaaaagtcaaaatgactgaaggtgataatccagatggtggtaacaataatgactaccatttatagaactttttgatgttgttcactcaacgtttctatttttattcaattataagcaaacagcagaattaacccaacattcagcaactccagatcagcttttcttacccccatgaagagctatcaatttaacaaccacagttgtaaggattcttaataagctgtcaatgagcactgctgccggtctagatggccatgccccaacaaaagcaaagccactctccctaatgctttttccaggattgctttttaaaggcaccagagcgagatactgacgcctattaaggcatctgagatgcaccgtgttggggtttagcctccatgccagccagcctctggttgtctaggtgagcgacagcaccataaaaacacgctgcgtacaattctggtattaggatcacaaaggcagagaggtgacaaatcctttttctttttctttttttttttgtaacctcccttaaagattctttgatgctttgctctattactgtgggcctggtctttttttcccccccagttttttcttctttaaactctggattgctattttcatattaatttgatgaccccatcacagtaccagaatattcctgaaaatagagttccaatttgatcaaaacataaaccagagtgagtgagtgagtgactagaattataaaggccaggcagcaggaaaagttaccctaaaccatctgactgctcaggtcttgcatgtgcaaaggggagccggaagaggagaaatctattatacatgcaacactgaactggagaacacggcttggggcctctgggacagttcaggtccctgagctgccccctacttcccagacagctgctcctgcagtttgggcacatagtcgtcccactcagcctggtaacgctttctggccactggggccacgagcacgagctcgtacttttttttttttttttttgagacggagtctcgccttgtcgccaggctggagtgcagtggcctgatctcgcctcactgcaacctctgcctcccgggttcaagcaattctcctgcttcagcctcccgagtagctgggactaaagccgtgccaccacgcccagctattttttttttttttttttttgtatttttgtatttttagtagagacggggttttaccatgttggccagcatggtcttgatttcctgacctcgtgatccacccgcccccgtgatccacccgccccagcctcccaaagtgctgggattacaggagtgagccaccttgcccggccaagctcgaacttttgacagaaggatgccattttgaatttgccactgtggcctccagatccattgctgaggatgggctcgtcacacttcagcagcctgtcctgtttgtaaaccagccagacatagcggtggagatctgtgccctccggaggcccgagcccacgtaatggagatgactgggccactgctaacgtcattacccttcatgttgaccaccaggaaatgacgccattcagtgtattggggcttcttcctgccgggagcgtccgggtctgttaggaccaaggtgtagagtttccttgactcaagatcatcccatgaaatgctggtgggtctgttaacctaggtgggcgtcagcactttgcccagctcgtccaccgtcgccctggcgtaggcgacatgcagcgagtgctgcggctgcccgtccacttcctgcaggctcaagggcctggaccgcttgctgaggtccctggcatggctgtgcaagaacgcagcgcgcagctgggagtgccactaggcaaggcgcaggcgcagcggcgactcggcagcctctgaaaactagccagggaagccggggctcatttataggattttaaaaatattattaaaggcttcacaaactgtcttgtttaatagccacaacattgggaggccgaggcaggcggattacctaaggacggagttcgagaccagcctggacaacatggtgaagccccgtctctactgaaaatacaaatattagccgggtgtagtggcgcatgtttgtaatcccatatactcaggaggctgaggcaggagaaccgcgtgaacccggcaggcggaggttgcagtgagctgagatagtgccacggcactccagcctgggccacagagcaaaactctctcagaaaaaaaaaaaaaaatagatacaacaatctccttttaactgaagaggaatgatgtaaagttatataaagttcagaggaattgatgtaaagtgaatcgtaaagactttggaatctcctactaaaatattttaacaggaaagagacacatcagtgcattttacaagcagatcaatgtggcggtatctagcatgcatggggaagggatggaggaagttgtcagtttagaaactgagtataaacattattgaaataggacatgataagtacctggaccagggtaaaggcaatggaaaggaaaaggaagccacagaccacagataggaggaattcaaggactgtgtaccgaaattcaggagaatgatgtgaaatagatgctctgaatcctctattcccaggaggcagcattatggagttaggagaaaatgcaggagctttggattctagtagacctgggattgagtttttacactgttactctatattcgaagcaatatatttaaaccagctgtgtcttccttttgtcctttataaaacaagaataataatgcttatcacatagagatattatgaggattgtataagacaatgtatcaaatagtaggtattcggtaaatgttccttctttactaaagatagagaaaccattttctgatgtacaaagggatgaagagctggcccaatatgaattttcccaaagaagttaaatgaaaaggatctcatgatccttttcaggatttattatttacgaatgttaatatattattttaatattttctatcttatgaaataattatttggtcaaaacataagacaattgataggaatatacagcatggaaaatggttaccaactagagctgcagggtatcagggaatgtgacaaggcagcaaaatgtttctacacatgtctgttttttcaggcattatctttcttgagactatcaagtgtgtatttaaggagccattcaacttacttcagtgcatttgcttgcaaagggtgcaatgtgatgtttcctactggtagggtcgtatttcatatgtggtgatagtgttgctgaacaaataggaaatatccttgcctagactatattttatcatttcattatctagtggtaaaggaatgtgagttctatttacaaataaacattttgtcttacttttttctttgtgatctattttctccaagttgcataatgtaatgaattaataaagcttagttgctggccaaatcaatggtgactttttatgtttttaaatataatattaggtttaacttatttttgtcattaaaatatcatttgtgagtgcttttcaaaatgaagtgcttctgaaataaatcacataataaaactaaccttacttttgaaatacatttttattgaagcaaacacaaatcaatctgaaattcagcattttgtagcagttaaatgtatagtcaggcagcttcaacgtcaactagagaagttgtggttttaaccccgagatagggctgattatgctggtgctatggcaacctattgcaccatttggtagcgcctgtgtgcttaaccgcatgagctgcgcctcttcctttcctataaagactcagaataagaaaaacagaagtacaccgaagagaagaaaccacaagagcagtaaagacactgctgttagcttttagctgtgcaaacagcagtcttatgagaacaacacattgaaaacctcttctatttgaaagtgtagcttttcccattatgcctgggttcctttaatgattttgaaagtaagccaagtgtttctgttcagagttttcattaaagggaaataagaagaaataagcagtgcatttatcagcctttgcttttattgtcctcagctttaggagtgggaggcttttgtgcagcctcagcagacattttattctgtttgtgagatgggagattagtttctattaggtggactccctataatctagcatttattttctgcttttttttattatattgtagttagttcacaaaaaaaagtacaattttaattcatctcctggctcatttagaaagggttgtggttggtgctgtaaacacgtttctacataactagattaaattcacagacactcactgtcctagcactgtttattttctatggggagcttcatttacctattctttccctcaccccacttcttttacaaggtataggttgatcagcaaaggcttttgtatgttttcctttgtttcaaagtacagacataatataatcataacttttttttgcatgttctactatttttccttccttaaagatttgggtaaaaatactgaaggacagacaagttcatgctaccatttttgttaggcataggcctgttcacttttcttcccatttttctgaaaaataagaatctaccccttttgtagtcattgtccagcaatttacactttttaacaataagttttaatgtgtggtactctgaatcccattttgatggttatacataatatttactcatttttgagtccctaatagctctttagcacaaatactggatttagcattaaatattttttccttacagtgcaatgcagttgaacaagcatgggggtttttacagtcagacagatctgcatttaaatctagactcattttgctacaagttctttatttagccttgcatacacgtttttatgattttgagctttcatctgtgaaaagaagagaataccatctactttgtaggatttctataatgattagataaaataatatgtaacagtatttaggacagtgccattcacatagtacccgcttattaaatagtaaacactgttgatagcaccaaatacactaataaaagatttcaccacttatgcaaacatcttttgatgattctttgttctttaatgatgatcgtaacctatcctagaggaagcaaagagctacaaaaacatacacttactaagggattaatataattaaatggtttttgctatctgaagtatattgcataaatcaggtatatatccctggatttaggtaaatgaaaacagacattttcataagaagcaaaaagataattaatatgggaacaaacctattctggaaaatgtttaaaaagagaatatgggtaaggaagcatctttctcagttgttcttaacccttgtttccatcataatcaccatcagagctttaagaaaataccagtgcacagatcacgttaccccacaaacctactaaatcagattttccagcgctggagcccagaaatagtcacctttaatctaattcccagtcaggattaatacaaataaaggattgatattttttcttcctcaggataataatactggttacacacacataaatatacataactgataacaagccagaattttgtaaactatgttctcagaaacattgcagttacattgtacaaatgtcctatagtatgtccatgggaaaaaaatgggtttgtggcaaatacttttaggagatcttgagctaaacgaagtgacataagtttctatgcttttaatatattaacacactttataaatatctcaaaagggcatgtagcatgaattacttctgaaacaaatttgactatgggacatttaaaggcacacaaatctaaatcaaagacttcaatttgaccatcattgcacaggaagcgataaaattttccccctgacttgtagataaatagtttaagacagaaaaaaagcagtgtaactgattgttcttaaatggttatctagtagcctttattaatttttttgtcattaattgtttcgttaatcaacatgcctgaaatatataacatgatgttttaaaccaaatataaaatacctacaaatgcattcctagttttgaggtgtgtgtttgcaaagtcatatgtattcacaagcaaaaaacattattgtaaatattggacaccataagtcattgggagacagctagatatggttgctatctttaaaattttttaattatttgattttattcctctcatggccacaaaaatttgccttctttatcctcaatactgctttacatactgatatttttctttattatttgcattattatttaaaagtgtgtatataatttgaaagtttaaatagtaccataaggcctagagtaagtaagaacagtcttttgctcccacgactctcccctcccttgatattttgtgatttttaaatgttatcttttattgtagtgctgtttctttaaaacaaaaaaaaagatttttgccagtatctattgacttcttctcttgatcttgagatgttgctttttataacctcttgctctttgttcatgggtgcaatgttttctcatttctgaaaatatgaattgtagttggttatcctctcttttgctccttgcattgcctcattctcccaagtgcctcttttgtttatttgagctctatctttctttcttattagaggctttgttctagtgtttcttggatgtccatttgtatttaataaaaggcctcaataaagggatgttgaaattctttggacattggtggagctcataaattcatgtgctttaactagattgaatgaaatcagaaaggcactacactcactgagtcttagtttccttatatatcaaatgaactgcatgtcaataatcactaaaatcctttgcttctgtctgagtagaaatctttggaattattttctgatgataagcagaaagtcctttactcatgagattccaaaaataatattaatatacccaatattttaacataacgtctacataaagaataagaaaattattaaatagacactatttcaaatctagcactttcctcgtgtgtgcctgtgagcaatttactaaactcttttaggtcccagtttcattccctataaaaaaggataaataatgctaactcattggcttactgggatgcttaaaagaaaaaaaatacatatatattatataaagaggtgtgcatagtgtctgctacataacatttcagtaaactgttgccatcattattatatttactgataagctaatggagggtagaaaagactgtttcctgtggttctctgaaatcataatacctggcttgtcgctgcccagagtgcttactccataaatacttaataatttaatatgatttgttagatttattgtctgtggaccatatagcagatttctagcataaaaaaagtgcaattctcttatttttattgtgcactttattattatcatgcattgctaagaaaggaaagccatacatatctgttttagctgacccttattttttgtcttgatttgcttttttccacttttgtacaggctttatgtttatggaggtcaagtatgcattctcaaccttcaaaacatgctatcattcattttagggcagatgctgagaataagtatttatttaatctattctattttacccttctgcccttgtacttttcccagatttgcagaactagacaggtttaaattccctaggaaatagcatcccatttttttttcttttttttttagcggggagggagaacgggtgatatttaaagcccaagtatgtcttttgaaatgccgttttcactcaaattgattcctagtttttgctgaaatctctgatcagggacttaggggtgtgacttcaaggtaactttgatttgtgatcatttaaacattttgagttgtaaaagaaacatattgggaaaggtaaattcagtaacaatacatgtgttagaataacacagctttgaagatcaagtgttctgttatctacattttcatctgtttaatgtatctagtcaattccattggtgattcacaacaggattataatgggaaaaagagctcttagataatttacagttttttagtgctatggtgccacctactgaaatattactaaatactcctttgactaaataatgaaaacacaagacatttaagttttaaaaaatgtagaaaatttcatccctagaagataaaagtcaaagtgtagaatgtagtaactgtaatatgtggaacactagatatattactgtgttttattttatatttatttgatgtgtttatagaatttgagagaaagctcaatgcagttcttactttgagaaatagtgatgccttctctttattgtcacacacctacacatgtgccctcttaatttccattgctatgtcacatattttgctttacctattttccacactttcccagtattgttcataaagaatgtttacatatattgtagtgtaatttgtattaaacaatctccaaatattaaatatttattgtgcactggttataaaatactttatgcaaaaattttgtttgcttttcccagatctatttgactccactaagaatatattgttgcttttaagtaatacaggaaatagggtagagtacaaggctgtctacatacataaaacaacttaggtaactacatcagttcatttgttttgcattggacaagcacagtaatatttaaccatatactccagtctaaatggataggtcatgaagtagttaaatatgttatacaaccaatcttttgttgttgttgttgttgttgttgtttttgagtcagggtctcaccctgtcacccaggctggagtacagtggcaccatcacatctcactacagcctcaacacacactcatgggcgtagcctcccaagtagctgggactataggtgtgcaccaccctacccggataatttttgtattttaagtagagacgaggttttgcatgtttcccagactggattgcttggttcaagcgatccagctgcctctccctcccaaagttctgggattacaggtgtgaaccattgcacctggccacaaccaatctcatcaggtcttttttttctatcagtgaagattcagcacagtggcttctatctatgattttggtaatgtttaataatgtttgcacatatgaagtgcaacagacaattgaagtcattgctcatgtaatttaggaagaattaaaatatgatagagaattaataaattattgcagatatttggttttatagttttctctaaatagttaagtaccttcacctactccctaccttgtttcatatataaaggcattctccaccaaagtatttgttagtgttctgctaacgttgatgtaaaaatcattagatgactgggggggcggggtgtggggaatgtccctttagatgttacgtaggtgttttaactaagctattttatataggtcacatttagcgtgttcctactttaagactggtaaaatgtttaacattaaaaagactgaaaaatagatttatgtaatctagtgcacatggcttattaaaattgatatgttgctttaagttgcatcactctagtgcataccttatttccttaggggcattggcttaaattttaaagtagtttttaatttaaaatttttattttaaatagattctatgtgtttttttcaggcacgaaaacatttttatgtcatttatcatgttgactaaaagtgttaccaaaactaaaaatctgtttatagggattttatgaccatgagaacaagcaagttgagtcttacactaagtctaaacagtgatgctgaagtcttggaattttcttttaaaaagataaaatggtgtgtggggtgtgtgtgtgtgtgtgtgtctgtgtgtgtgtgcacgcacatatttgaaatagtatataaaaatgaaataaaacatagattacaatgttttagtgtcacctaaaaatcactcagtggaggaatttagaatcatatccagtgataaatcagtgtacaagcaaacacatattcaattcaagaggcctttatgggaagtaagcatgaacatagaagaaaggaaaatgttggctctttagatattatactgttttccaggatattaaattttgctgcattaaagatgaaaagattcgaggaaattttgaatatggagcgatgatgagatcagaaaaaaatgtatatgtatgcccattattctgtcctctagctccagaaacctcttaacatctaaacaaaaggtctgtaaattttaataattgtgcttgatattagtgtagtttggttgactttcctgtcaaaatagtattctgtaataaattaacttgacacacctctaaattttctctaatatttgtttgtaccattatagagcattcactcagcacattgtgatttaatctgcatatctatttttagggtcaaggttattttagcatttgtagcactactagtaatttacttgcagccaaattatgattaagatgcatttttacttagctcatgagtttttaataaacaccttctgtaaaagaattctcatgcttaaaatttcatatgaagaggaaaggctgtaaggacaagttgatgggaaaaggggacgcctgatgaatgagagcatggcctgtaaagtcagacaggctcaggttcaagtctggctcacatatactagactggccttgtgaacttggccaagacacttgacttttctaagcttcttagggtttttgtggtgcttaagaaagaaaacataagcaaaagacttagtatagtgcctggcacccagtaaacactcaataaatattaacaattaataacaataaaatattatttctaaattattctttaaaaaagtaaatcattagaaacagtcttctccgttttggtaatttacctcttgtccttcttttcagaagttagattaaaataatatacatcatgtatttcttttaaaaaacgtattgcctttggaccacttggaagtttattaatctctctgagacatggaacatatacgtagtctgatgaatagtgtactggttggaaacagttctagtatatttactcaggcattcacagttcttttgttaaaaaacaaatagcttcacatagtgtcccagcatttttcttctcatttctgtggtaaacagatgatgaattataattttcttttatgaaactctatctatagttggtgctacacattttggtgacaacaaagtagtaaatcagaacaacagaatataggggtctgtggaattagtggtgcaggtaacattaagatttctcttttctctgtcatcaaatttgctttctgatttctcctctgtattaactgatccaatggcttccgtcattctgaggaaaaagttcaagctccttttcaaggcctacagtgcttgctccttggctcttctcctaaagctgttatcatcagatctgtttgatttctcctttgcacttactcatgcttaaaagaatccagcaattacttatcaatcacttcttatacacaagactctttgctacagctatttctctttcttctcctcctcttcctcatcttattatgtgattcatgctgatgttgatgcgagaaattttgattattagtcttaatcaggtgtatccatgactaaaatgtcattgcagatgactagatatatgtgttttatgggttataagcttatccagggcaagggtcatgcttttatcatgtttgaacctagtctccaacagcataccagcaaaacaatgtatgtttcttgaacctaagtgaactaaattaacttgtttcaagttccaaggaatgaggtgcttgcatgagaaggggcatatcaacctaattttagatatgtaagagctcatgtatttctcagataaagaagagatatgtgttgtataaagtatgttcacacactcaaaaacaatttgaatattttaaatttggtgatatgttttgttcttcacaaacaatgaaggacacttttcctttcacttcaaacatgagagctattagttattgctatactaatatttttttcttattacctcttttgcaaatcaacacaattctaagactgtaatttacaaggaaataagaacaaataaggagagcggaatgctgttaatgggaacataaacataacaatagtttacatgaaacagaaagataaaagctaactagataagaaaagggacaaaagtacaaacaatatcaattaaaaacaatatttaagtatgaattattaagaaaaagagaaatgtaatgagaaaacaagaaagtcattatgttaataattatgtatcacccatcaatgatataaaaatatatatatcaaaaatgcattttacttcaaggaataagccagggaatgtcattgaagaatacggggtgatgctccttggatggcaactctgaaggaagaaaatgttttcacatcagtttgttctcagaagataaaatataaaggcagaaagtcaccttaagtaccagctaattcactttcccatctgatctctgattctctttaacaacctgagtttacagtcatttggaaaagaactttacaatcttttaaataggcatttactaagatgagggatgaaaacattgcacttcactgtagactgaatctagttcccatcatgccaagaaagctgctcttttcaacatttccacaaacccagatgataaatccagttgacccatgttaatgcaccatgtttatcctgcatgtgaatccccatattatttgacttcaaccatttccttctcgaaacaccctctactctttattcttgtttgctacagttttcctcttacttggaaaatttgattacctatgctggctctctccttaatattcactgaacttcaggattctatcctggacacttctcttttatgtagttcggtgatctccttcacctctgtagctgcaaaatgtatctatatgctgatctatagcatcagcccagatgtatgtcatgagctacaaacctctatattcaaatgctattatacattttcacatgaaatctcaagcaaattctgattcacctctctactcactgtttattactctcaagttcagtgaaactataactcactagcatgttaaactatcaatctagatattttccttattactctttctcctttattctcacttgaaaggatttacaaagtcttggtgattcttgagtgtttcataggtccttttcccccaacctttcttttggggtatactcttcctacgtaggacatcatctctgtctgttttgctttggttttggtctcctgattttcctgcccccacctttgctctttaataatccattttccatttcctgaaaggttgatctaaaattcaaatgtttctcctttaggcctccctttaaagacatccctttaatggatatctaaagcctgtaagataaatcccagcttcttattcttctgggaccaagctagctatatgcaatcctttaggttgtagcttaaatacatccaagaaaccctctgtatcaactcctttaccagccaaccaccaactctggaaatataaataagatgatcctgttatgttctcctttagcacattctgtatcacctgtcatcacactgtattgattgattgtttttgtttatatctcacactaaattgagctcattgagggcagggaatttttatatgttggtcatattatatccctagcatgtggcataatgtctagcacaaaataggtgctcaattaatcatcattatctaaataaataatgcatttgggaaaaaaaagtttcaaaagtttttcaaaagtcttttgcaggcttgaaattaatcccaatagtgatcctttagtctgttatgtttctgatttagcctggggattcaaaaaataaataacataattttgatatatttgggctttgtaaacatggtactaagagaggaaatatagtttcattagggtaaaagctactgaaaattgccacttggtgaatgttctatcatagacttgaggtacatataaaaatctaatatatgtttacattaatatgaatgaaatttgaaattttctaagagatttttgtttcttctttgcagggcaaagcccaacaccttcccccactggtaagaattaatatttatatttttactaattttattttcttgttgcaaagtttatatatttaactacaattttctattattaacactgaaattatttttaaggataaattttataatcatgagtgattcttgacattcacttgttcttaaactttctgcttatacgttatagagtttaataactacctaaacatgttattaaatttgtatatatattttgtgtataaatagtaacttttcccaaacttgacagtaaatcacacaacaggtttctactctcttttaatattttaagactataaaaaaatgcatttaaattagataacaaaattttatagtctgaaagcaggttaacagctgtctatgtatgttatagatatgtagataacagatttgcatatgtctatatttctttaagagtatgttgcttttttcaatggtatgcaaaacctttgagactattgagatatttttaaataataattttcaaattctactgaacacttcaatagtccttataaatgtcttaatcatgagataaatttaaaacacagagatgctgcaaataaattcatacatagtacatacaaaataagagaaaaaattaaattgcagatggttaaatatcacatcacttaactgatgttactgaaaatgtattttcctgcataatcatatggttgacagtatgcattaagaaggtaagtaaaacaatgaagacaattttgatttaatatggtaatgcacaattccaactaacgtacattcaacagatcatgaaattgggttattaaaatgaatatttttgtcattaaataaaaattccgtccaaatgaagaaaacaaataaccatgaaaatagtaacaaaaacacttctgaatctgcataagaactatatttccttatttttaaagaaggtctaacacaattttacagcgtttagcatggcagtgatgttttataaataaataaaagtcattcttgcatagtagattgtgattggtttatgccagctactcaaatgcaacttagtatctccaacttttacagaagatagattcatctcaaccataccagatggttatttttgcaggaaagggataggtataaggtagaatggggagtgattctttaaaatgacacatgactcatcaccttattgagggagtttctgttatctctgaattgactctattatgacaagcctccaagtgatgaaaccaggtaagttaaaactgttaaccaaaatgcaaaggaaaatggtctctcccaaatattggccacaacaatgtcatcaatggaaaccaggagaatttgcaaagtggaggttcaagaacaatgtggaattggcaattgagtcaggttttctaattttaaattcttatttgtgaaagggaatgtgaactgaacttaagatgtgtgcaaagatatgaaggagagtagttctctgaaaacctttctccctacccctgggactgaatttgcttggctagaagtaatctttaggaatgctactcatcaaaatagcgtggtactatgtattagtctgggttctctagagggacagaactaataggttagatgtgtatatgaggggtagtttatgtgattgacacacaatcacgaggtgaattcccacaataggccatctgcaagctgaggagcaaggaagccaatccaagtcaccaaacctcaaaagtagggaagctgacagttcagccttcagttggtggccaaaggcccgagagcccctcacaaaccactggagtaagtccaagagtccaaaagctgaggaacttggagtctgatgttcaagagcaggaagcagccagcacgagagaaagatgaagaccagaagactcagcaagctcacttctcctaccttcttgtgcctgctttttctagccgtgctggcagttgcttggatgatgcccactcatattgggtgggggtgggggggttggggagggtctgcctcccccagtccactgactcaaatgttaatctcccttggcaatacgctcacaggcacacccaggaacaatactttgcatccttcaatccaatcaagttgacactcaatattaaccatcaaatactattataaggagaatgttgcatgattttccttctagtctgtttgtaattcacatctaatgaaagagtgagagtggacgataaagggaacttgttgaaacatttctctcaaagcaaaagggatcattggaagcaggcagacaccagaattggtttaacctaaaaataacaaattaataattatcaagtctataatgatgacagtgacttaatgtgaatagaaagaattctaaactctctccttccttcctccctcccttctttcctactttctttccactccctttctcccacccccttttcttttcctttcttttctcccaccctctctccctccctttcttttattcaatgcatagtagttgaaaaaatctaaagttagacctgattttacactgaagactagaggtagttactatcctattactgtacttagttggctatgctggcatgtcattatgggtaaaagtttgatggatttatttgtgagttatttggttatgaaaatctagagattgaagtttttcattagaaaataacacacataacaagtctatgatcattttgcatttctgtaatcacagaatagttctgcaatatttcatgtatattggaattgaagttcaattgaattttatctgtatttagtaaaaattaactttagctttgatactaatgaataaagctgggttttttatttatcatactatttccattttcttctctagtaatattgcaattttcattcttaactctttcctgtcctatcatttctactccttttctagtttctctcattctctccctttttccatatttgtgccattgtcttttgcccaatcttgttgaactgatttaattattttttgttgtgtgatatagttcagtttttacctaattaaatatttaaatttttttttttgcttttcaaaaagtaaatatatgttaagcaaaaaaaaaaaaaaaattaaatacatctttataattccaacctccagagatcacatgagcttttttttttttaacacatttggtatatttttctattcttttattaagaaaatcacttttttcagtaaaagagcattaaaaaaactttaaaggactttaatcaacagtgctgatttgccctgcagaattttttttaccattgtacactcatgtcaactgtgcataaacttatttcactactactttgtcacatattttcctcttcttaaagtaaacttgagctgtggatattatttcagtattttaaattgtatctctttgttatcatgacgtcaaagacatttttgtagactttggttgtttgtaaacctagttgtgagttttgtttttcagtcctttacacacattttcattgctttgtttgcttttaatttattttttaaaaaatccatgaataggccaggcgtggtggctcacgcctgtaatcccagcactttgggaggccgaggcgggtggatcacgaggtcaggagatcgagaccatcctggccaacatggtgaaaccccatctctactaaaagtacaaaaattagctggatgtggtggtgtatgcctgtaatcccagctacttgggtggctgaggcaagagaatcgcttgaaccagggagtcggaggttgcagtgagccaagatcgtgccactgcactccagcctggtgacagagtgagactctgtctcaaaaagaaaatatatatatatatatatagatagatattttttcatggatatatatatatccatgagtaaatggaagttttgtcttttttttcccctggaaccctagccctgctaaaaaccttctaactttacctttctctatccttttctttatctacaactttttaatttttttaatcatctttaccattatgcttcatccttctgaactcaattgctttggataggcgagaagctgctttcaatttcatttccccatttttatctttagctaatgttctgtagcttgttttagatctgtgtctacatattatatgtatctctgtatgcatcaatatttgtatatatgcatgcatatatgtgtatgtatatttatgaatacatatacacaccatatacatacacttatgtatggtgtgtgcatatgtatgtgtagatatatgtacatacacactatagtggactggggagttagtatactgggaggagcatacatttagggtatgattcacatatttattttgtccttctcccattttccattaattaacaggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggttggcacacaaaagttgttaacttaaatatcagggaatgtcatttagaaaattctacagttatcagtacaacttgtctttaaattatttgcacagtttctaagtatgtgattttattcaagtgcagaaattgcaggaaattagtatctgtgaaatatagatcgactgaagtaattaatgcatgttgttagggagtggagagagaaaagaagggaagcaagatctccaaggacaatcaggaggggaaatttgttctagtatcctctgatctatacacactcgccatgattctcccgcttggcttcccgccacctggacagatgagaatttccctagttcagagattatcagttctactctccttggaaggtgtcttaaatgggagtcttcccatttctttgtttcactctagattctctttatccaaaaattgttgaagatagagaatgtattatttttaaatccactctgagaatcgacaacccaattttgttatttgagtttcttttaagagcatttgcatcattgaaaacatttttaattaaggttgtgagttctactggtaaattaaaggcaatgtagccatgttcccgggaaaaatcagattgatgcaagagatatttttgccaaggaggggcactatgctccttagaatactgatatatgtatatgctcatttaatgtttagcaataggtctgccagtgtattcagactcagatttaccatcagtagagtgttcatgcttttctgaaataatgtgttatgttgacttttttgtgggcaaacaggtttatagacatactctgataaaagatactaagctatttgaactgtttaacaatgccatttatcttcgtttgaaaaacaagcatatataataccatcacagaaattttgtttagggtacatcaaagtattttgagtaccttactgatgaagtttattggatatagtaagcagttaaataaatggtcagtgccttcctacagcaagtacaagactgtgtatttaatcttccatttgtttccctgtcaccatagcagagtagtaactaggacctgtctaaacactgtaaaaatttgaacacattgcccaaaatttttacaaaaggaatgcaaggatgaaggtgctgatgactaggtggaacatctcatgctattttattattttgtttattgcctgagtagtgtcacattgagttttccttttgaaggttctgtatttcacgtcacatgcacaaataaaaacatgcaacattcttttcattcccacatttttaaaacctaaaaccacttaagccataaatttacaggtagagcaaagtatgagaaaggtttaaagttgaatagattgaaaataaggatgaataattttaaaatactgatttgttctagcaaaataatactgatgttgaaattaccttgaaaagttcatgctttcaaataaaaacacactttcttttctagaaaataatcttttcatcaggtgatacttcaattatctattggaataaagtctatatgagttatttaatttatgattatgattgatttatactgctgaatgcagtcaatttttttcatttactgatataattgggggaaaatcctttaatctgcatttctaagaatattattacacactattcaaaattgttcatttttgaaaatggctacaatgaccatccatgtgcataacattaaatttaattatgtaattttattttataaagatagtttatgactatttcaaagcattttcaatatagatgggtatgtgtgtatatatatatttgtatatactgttaagtatatataaagtatatgtatgtgttgtgtgtatatattttaatcctatgtatacatacatatacatatatacatataggattaaagtatataaaatgtatactttatatgtacttaaaagacacacaatgaaaataccctttaaattctgttccttaaagatacctttttaaccattgttgtatatcctccaggctctcaacatatgattttgtgagtatgcaagagaccgtgtatgtaagcatggacatgtgagattgtttccacatgttttcaaacactagatattatcaaccttttaaaactctgccagtatgctagttagaaatatttcatgttgatttacatttaaaaaattgttcttaacactgaacactttttcatataccttttggcccttctgtatattaggtagatgtctgtcacatctcttgtccatttttaaatttcttcttttctttgtaatttgtaagagatactagtacattggaagattcctttcttattctccctacaaagaaatgtcccatctgtcagtttgtagagttgatggagaattcagaaagctcatagtgatgtgaaagtcaataaagccacctggaaacacgaattctctatggctgcatccagctcaggaaacctcccaaggctatgtaaatagaggactcaggtgcctgtcactttccagccaagcaaatttaaatactgacagacacattttaacagattcagttacttcacagtttggtaaactataatcgcaatttgctccttataacctcttagtaaattattcatctccagtgggggaagactgatgtaatgatctcactttcctaccttaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcaggtttgcgggtcctttagacttgtgcaaatatgaaaagtacatgacgactacctgtatttaagaatggtgtgaggaaatctaaccacttattcaatgtgcagctattgctagttgatgaatttggaatttcagtcactcttaggaatatgaaaccacagaacaaatgtccttttaacagagatgaaataatagtgagaattgtgagactacagcaaaaatctgctcaggaggaaagagttattcagaatagtctattttttatatatttcaggcaattaccattctacagggaaaactttttgttagaagtaagaaataatatgcataaatctttacttaaagactttgtaccaacaaacaaaagggtgaagagtgattcctattatcagtgaagggcagtgagaaattgtaaccacaatgaaactgttatttaaagaatgagaaaaaaagaaaggaatgggtttatttcccattcaaacattaagaatctttcaggatggcatctctgtgtttataacaacaatgcagaatatttcctcccttttcttttcaaaattagtgtccaaatcacttcttggtgtccttttatatgcaagaaaaacaagtatgtcttttgtcagatcacaaatccacacagtctcgtatataatttcagtgatctgagtgcttgaaagttaaagatataaatggtagacctatgtagctggtaggaacatggtcttgctttaggtaggaatcaaacacatcaaatagaataattattattttgcagtattaaaactgtgcccttggcataaaaatcattccaggcaatccacactctttaaacaagtgggagaagagccgccctcaccttcctcattccatctagtccagctgccatgggaaccacaataaaaatatttggagcttttagcaaacccacagatccagaaatagtggaggggcagaaactgtaaaacaacaaaaggggactgacccctggggctggttgtcacacagactagtctgctctgtcctgatcaaggaattcttcttctcaaagaagtggctaattccactgatgaaaaatctattaggattaatcaacctaattaaaattgtaaatgccgtccataaccaccactgagagtacctacataacaagggaaacgaagttttcaagtgaggaggagggaaggtaggaagtttcgggaggttgagagtggaagcctcaaaacagcttgggagcagggtctgctagagaggggagaacagatcaagtgagtgagaggagtgtggaaaagaaggtggaaaaaagctgatttcaaaactctgcagagggccagttctatgtctgaatgagttttttaaaggatgaataaatgagctttcctcactcttctacatattctgctggagccctcctctggggatccagagtggaaaacctcatgtttatgttgtttattctattctatggtttagttaaatttcgtggtttagtggcttttgaagactgagctgagaacccatgctcaattatttggaagatgcattttcaattctaatggaatgtatgtgtgaaattatagactgtactgcatttgtaattggtagacacctgcaagctcaaatcaaagccatgttcagaacgtgcatgcatgtatcactgcagaaatacagactctgcctgcaaatgtgagactaatctcacatcattgaactgatgaccccagggatcttgacagaaaataacccaacaagctcttgaatagagggcagctcatatttcttttgctttttccatggcaactagcatagtgctagtcatctagtaggaaccaaatgaatatacattgattgcctgtgctgtaattctggatgtgatgttgggcaaaggtgtaaaatacattaggtaatttgaagcctgaaaatggaaagttctaacctagtacaatgtgcagtttctttggctacaacactagattctataccaattagcaactatgtgattgaaaaataagagaatgatgccactgtaatgtggagtttgttggatttcaagccaatttgatttttcctggccagggaagcctgaattgtgaaagtagaattgtaaccttcagctggaaaggaagaaaaagaaaacctttgagctcatgctgtggcccaggcaggatcccattcagctctattttaagaaaattaaaactgagcacctgcacccagggatccctccccagagaggtgtgtgcctgcaaggctctcagcatgtatcaagttgcacttcctcctgtgccaaccttttacactcagagctctacctccatctacatggtctcagcaccactaagacagcaccagtctctactgctttgatgcattttttatattgcctaaggcagcctgcagcccagagtcttaggcttcttgggctgtccaaactatatatttttttaagttgtgctctgattatgaagctgcataggtttccagttgtctgcccctaaatgcatctttcccataagccctggtatttttggtacagttctgtagaatgcatgtgtcgtggtatagcagaagtgcttgaagatttgtttctctgccttatctttagtaattgtgtttatgttggctatctggctattgcccttgcgtgacagacacaagtgacagtgctgatggcccttctgattgcagatgtcccaggagagaggagtacagccagcacctttcctacagacccagtttccccattgacaaccaccctcagccttgcacaccacagctctgctgccttacctgcacgcacctccaacaccaccatcacagcgaacacctcaggtctgactatgctgctctagtagtgtcttcagttatagataatgaaatggaaactcaaaactttaatgtagctcttttattttgtgccagatattatttgtaggtttcccattttacaaatgttcacgtatcaacaccaaattatgcaaaagaaacttgccagtaagctttttctgggcatattttattttactattaatattataaaagtccatggcaaagaagaatcaataataggccttaatgtcatatagctctgggatcaaatccaatttcttcaacttcgtagctgattacagggcaaattactaatactttctgcatatcagatttgctttctgtaaaaatggacataataacactccttttttaattatgtcaaaataattaacgtgatgtctgaatatgtaaaaatctggtatgtaataaatattttaaaagagtaattgtgacgcttattagaatccaagtatggaaagccgtgaatgaaagggaaatgaatagtctgaggaagattgcatatcatcaactaagaattatatcaaggaatgaatagttttccctcaatttatacaatgtttagtttaaataacttgaaataaatctttgattcactttattattttaaaaacaagcgaatgtcaaatcaaacgaggactcctagagcaaagatgccaataggaaattatctttgctaaagagtttttctttcaccttttaatataacgaattaattagcttttattcttctattcattttcttgcagatgcctaccttaatgcctctgaaacaaccactctgagcccttctggaagcgctgtcatttcaaccacaacaataggtgatattaccctcagtcaggcagccacaccatccccatgtgcctggtgatgtgctctcacaagggccttccacccactctacctcgggctcctttctttaagttgcattaagtgtttgaatcctgagggtgatggaacagcaggaagatatttctctgcttagcagtgcaacagctgatgagatcaggatgtaattgttactgtcataattcatcagaaagcatgtgtgagaaacaaccacatctactagaactttttctcacaggggtttaggtcttagtaaggaaaagaacaagcccatcaaaggggctgtccattgcaagtggtgagcatcagacggctgatggcagagttcccgttaagcagtgagagggcgtggagataaaggaaagagaaactgaggaatggctgcagcaatggtggtatctgtgaatcagcaagtaagctgatcagagcttgcaagcccacaattctcctcaaattcttccaacccaaaatcaagatgagcagagatctcttagcttacacaaagcacatgttctcccaattattcaacttaaatgcctacactcacacaagatactgctaaatttgttgacagagcaatttgttaccctggatctagtagatgtgcaaagagcttacaaaagttaatctagagaatgaagcagtctttgcattttctctgacttttttttatgtaaatgaaaagtataaacttcgtactatgggggttataattatataaattaacattgagattaatcaaaatatgaagacctttaaaatatttttggctgtgtgaatcttcagccatgttgccataccgccaattagatgcgtacctaaaagtcttaatattgttaattgtatttattgggtatatttatgaaaaattttatagaattagctcattcctttataatgctttaagttttgaaatgaaaacctgtactaggcaaatccttcatattctgttaaatctaactagatagactttatgaagtagaagtattgtaaatcagctttcccaaaaatgacatggcagatattctaaagcaaaattttaataatttacattttttttctccattacagctactactccatctaagccaacatgtggtaagtttatttacttagaatcagcatacctcactttggaatagcactttaattacatctttctttattccaagctttcaggacccactagtaagctaaactcactggctctaatttctcaccgatgactagtctcaaattagtaaaaaattactagctacacatggacatagagttgggaatgatagacactgggaaatacaagagcgatgatggagggaggaagacaagggttgggaaactacctatattgggaactgtgcctacttgctgggcgtcgaattcaattttactgcaaacctcagcatcctgcaatatacctttgtaacaaacttgcacatataaccctggaatccaaaataaaagttgaaaactaagttttccagttagacaactttggtaaagccacttaatttaatttaggtatttgaaaaaaaaatggaataacagcaagtttgttggtgagggggagggggacaaggattcagtgtgatgataaatataaaatgtggataataccttcaaagcttatcaagaagaaaaatctctctttttctctctctttctgtcttgcttgttaggggctggctcaaagcagatacttgaaaacagtttgtctctctttttttttttctcattttcttccttgattctcagttgaagcaaagcggttcttcatggtcagggcttattcctccattcatttctaagtctaaccactggagtcactgccttcagtagctttccatacatttagtgtaaagagtggccttcatatgtctgtttaattaatatgatcttttgtaatccggttgtcattcatctctcctcccgcctcttgaatcattgcctccttatgttcttcacttaagtaatatggaaccactttcagttttcttttctttctttctttcattcgttagttctttctttcttttttttttttttttctcactctgttgcccgggctggagtgcagtggtacaatctcagcttactgcaacctctgcctcctgggttcaagtgattctcctgcctcagcctcccaagtagctgggactataggcacatgccaccgagcccagctgatttttgtatttttagtagagattgggattcaccatgttgcccacgctggtcttgaactcctgacctcaggtgatcaacctgactcggccttccaaaatgctaggattacaggcatgatccaccacgcctggcccacttacagatttgtaaacacatactgttccttcctgcctctgtggccactcctgctcttcctctacaattggaattctgctccaacctcatcccccaaaccccatgtctatttttctatttcctgctcatattttaaaacacaaactaagtcactttctctggaaatcctgtcctatacctccaaatggaacagatctctctctttctagtgccacattatttcctgcataatcttattttagaggtttgtatgtctcctgcaattcatgcttgtgtctgcctccacactggattatacatttctaaaagctgattatatctaacttgcctttgaattcctagtattggtgaccatgtcttacatatgacaagggcttaataatttttgttgaataaaaacaaatgaataaatttatatttgttgtaaagatatttttatcagtcagcagaaattgttgacactaaacaaaggtgctttggaggtatattatcaatcataattttacccaagttaaggaaagaatgagggcttctgatccctgagtaattaatgccccacatatatcaagaaacaggtggttaataactacgttttagaaaacaagaaaattataaagcaagaataaatttctcaaatgcatcatttatttgtgcatcaagtcaacaagtaactagtgagttcccattaatgatacatattatgcatactcctgaatttacagtgataataaaaatagcctagactttgctctcatggaagttccaagtccagctaggaagacagacacttatctggtaatcatccaaatataaatttacaagctgaggtccttgttagggcagtaaagcacagataattacgaaaaaaatgatatggaggcacctaatgtgttttttctttttcatgttttttggggatatttggttagttgatttgatattttggcatttgcattaatgtagttttatttattctggaaaaataacactcaatgttctattttcttttagatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggtaaatatcaatttatttcttttaataaatttataaaaacagtacacttttgtgtgtggtgttctccagtggtcacaggagctagtctggtgagagaacagggctgagggaaaggaaattccttggaaacaagtgggtgaactttctgctgtcttaaccaagtaaaaatgatagagtcaaataagccttctgtttacatccattaatcaccacttctacttatttaacagggagatgtttatgtgcactaaatatagtttatcctgctaagtgattgtctgcaagctttctttattctcctctacttaaatgaagtattaattatatatgtacatatatttattcttttaagtacaaatttatctgaaatatattagggagaaacataaaggatttgatgtgtatgggaagaaccaaaatacattcataaaaaggaaggttatggtcatgttagtgagatcaagttggttttgtcagctaagctactgcttggaaagaggagggggtgacaggcgtcgggcagactctggggaagcatctcttagccaaatgcattctggaaaagggattccagagccgtgtaatttttttaaaaagtcatatcatttaataattcaagactattaataaatttgttaacatttaaatatgttaacatcaaatgtattttgaaaataaaatccatttaatttattcattttccctaaatattactgagataaattaccaattaaacacagaagatgacaatacttaaaaatgcatttcccaatagggaaactcccaatacactttataataatcattcaattaaaagtaagtaaagagtaaacaaaaaatttaagataaaaacaaaaatacaaaatggaatgagtgttttttaaaatgtgcgaaagctacaattttatcaatatgtttgcttgcatttcattttttaacgtggtataacttataaatgaaacactaccaaaatatatggtgctaaaaataataaagtaaataataaaagaaacaaatccctagagttattagacttttcccatagcaatctcaatccttgccaaattctatgtcattagcataatttcagtggctttaactgacatgttaggaatgaatgagggcttaggatacacattatgaaatactaatcaagtttatttctgtatcttcttgtcaggggttgaaaagtttcagttacatgattgtacacaagttgaaaaagcagatactactatttgtttaaaatggaaaaatattgaaacctttacttgtgatacacagaatattacctacagatttcagtgtggtaagaatataacattgaccagagaatttttttttgtggcacaatgttgttctagatattatttaatcttactctctgccctttctctcttcctccctgcctctcttgttctccctctgtttgtcttttttctttcttgtctttttcttggtctgtggtatatttagagtcaaataattaaattacctatacaattcaaacaaattcacaaaataaatgaatacttttcatgaaaaataaatatctaaaaattgaaagtcaattaatttacaataattttcttggcaattgttatacacaggcattgttgaagagatcatgaaagaagggtgttataaggaaatgataatacacaaactctgttatgaagtaaggaaaaaaaatacaggattgtatggttcaagagtttactttttccatcctgcatcaacaaaattcatacacaagttcaagaacacttaaataagaagaaagcagaaaaagaacagcaagtgcatctagggatatgtttggatttgaattgaggcaactaataattgagatagtatttttaaagtgtatttgaatttaatgaggtgaactctcccaccctttgacttaaagccatctgccaggccatagctggcatgacagacagatgtgctcaggtgtgcatgcgcatgcacgcatatccacagctacacacatagaggatggagcattgcgctgggtgtaatcatcacctaatcaccatagtatagattcatggccatcaggcaagcagacaaggaaaggaagagcaatcatgacagaccaatgataaaatgttctctctagacaatctattagatgaagactaggtgaggtgcaatttcaactttaagttgtatttgctatatacagattgggcatccctaatctgaaaatccagaatccaaaatgttctcagaatccagtactttttgagtgccaacatgatgcggctcaaacaagtgaaaaattttacacgtgacctaaagtgactggtcatagtcaaaatgcagaaacataacacagaatttagtcagcatccccagagaaaaataaatgacctcaagctatgtatatgaggtatatatgaaacataaatgaattttgcatttgaacttgtgtcctcttcccaatatattgtatcatctaaatgcaaatattccaaaatctgaaaaaaaaaactaaatccaaaacacttctggtgccaggaattttgaataagggaaactcagcctgtattttcataaaagttgaatgtaaaaattatttttagggttttttattattttggtaatttccacagatgtttcaatctgataaatattaaatagagaattataaatgtgaaattagaaaataaatgtgtgcgtgaaatattgcatcgatatattcattcgaaatatttctttatttcaggtaatatgatatttgataataaagaaattaaattagaaaaccttgaacccgaacatgagtataagtgtgactcagaaatactctataataaccacaagtttactaacgcaagtaaaattattaaaacagattttgggagtgagtatgttacttgcatttatatgtaaaattgcttctctcttcatgttcttataattatttgagaatcataggaaatgaattgtctttttgctgtttttgatactttttaagcatatgctttttatttcaatgaagcgcaatttatctatttttacttcttttgcttatgtttttggtgtcgtatatgaaagtccattgccaagtcatgcagatttatccatatgttttgttctaaaaattttatagcattggctcttaaatttagctctgttacccactttgagttaatatttgtatatggtgtgaggtaacagtctaatttcattttgttgcatatggccatctaatttttccagcgccatttgctgaaaatactatttattcccccactgaatagtcttgccattcttatcaaaaattagttgaccataatgatgggtttatttctgaactttcagttttattttattgatttatatgtcatacttacactgtcgattactgctgctttgtagtaaattttgaaactggaaactgtaagttcccccaaattgttacttttcctcaagattgtttagaatatctaagggaacttggaattctgtatgaattttaggatcaacttttcaatttttataaagaagccatctgggattctttcagggattgcattgaatctgtggataaatttgggaaatattgccatcttaaccatgttagtcttccagttcatgaacacaagatatctttccattaatttatgtcttctttaatttattttcaaaatgttttgtagttttcagtgcattagtgttataattcttctgttaaatttatttctagtttaagtttattcctggttataatgctgttgttttcttaatcacattttcaggtttgttactaatgtacaaaagtacaattgatttttctgtattgatcttgcagtctgtcacattactgaatttgtttattaatgataatattgagaaatttttgacaaaacttataaatgtaattctaaattttgttttgttttgattttgagacggagtctcgctctgttgcccaggctggagtgcagtggcgtgatctcggctcactgcaacctctgactcctgggttcaagcaattctcctgcctcggcctcccaagtagctgggactacaggtgcgtgccaccacgccctgctaattttctgtatttttagtagagatcaatctcctgacctcatgatccgcccaccttggcctcccaaagtgctggaattacaggcatgagccaccatgcccggcccgtgattctaagttttatgtaaaaaggatagttgaaggctaaagaggctgcctaaatccttgtctcctcatacttctccaaaataatatatagctacaagaacagcaaataaaactatgtaaaaactatatcctcagcataactagaaaattttaatgtatttttattagtaccacaattattacattctttataatcaatgcaacaaaatagaaatcccagaaaactatgttttatatttgaaaacagcacaaaatgttttcagtgggggaaaaatagtcttttcaactaatgatcctggtatctctgtagaaaaaaaatgaacatcagctctcacctctcaacaaacacaaaaattaattcaaaatggattccagacctaaatactaaagctataatttaaaaaattctaatcaaagacataggagaaaatgtgtagctttagcaaagatttcctagggcacaaaagcaagaaacataaaacttttttgatgaattggagtgcataaaaattgaatattcctgctctttggatgaggccactaaggaaataaaaaagcaataaatagtttgtaaaaaatcaaaattaattttttcaacaacagaagtttttccagaatatacagagagctctttcagctgcaaaataaggactaaaacagctcaattgaaaatggacaaacatttttaatatatacttcacaaaagaggatacacaggtggttaataagcacattaaatgatgctcagcatcattagttaactgagaaatacaaattaaaacaacactgagatgataatactatacatccattaaaatggctaaacttaagaatacggatactactaactattggtcaggatgtgcagccatgacccaggaatttcactccaggtatttaccaaagaggaaacatgacaaagcagatgcattcatagtagccaaaacctggaaacagcccaaatgtgtattcactgttgaatcctaggtaaaatgtggtgtatctttacaataactactgataattttttaaaattctaactatgacacatgcaactaagtgaatgaatcttcagaacattacattgagtgcaatatgttaggagtgaaaaagtacttactgtttgtttcattttatttacatgcaatgggtaaaaagacaaacttaatctgtagttaacagaaagttgatcagaaggtacgtgagtctggtcaaaggagctgagttgactgggaagtaccacagaaggacattttgggatcacagaaattttctttatcttgattgtggtgttggttatgtggatgtatacatttgttaaaaatgcattaaactgtatctcaaatgggtacattttaatgtaaattttacttcagacattttatttaaacatttatcagtttttctcagtttcaaatgactagttactggaagcaatgacaagtgctactcaatgactgctaaatttattggtgctatgaatgccagatttttagcacagcaaaatctacaaattccaggatttttaggtagtatctgggcaagaatatatatgaataatgtatatgaaaggaagagggggttcttagatatcttcaagtcagtggaatgcttaggtttcacagtgccaatctggtgtgacatttactttgttaaaggaatttactctaaaacaaattaaatgagcccagatgcatttctttaaattttattttgaattcatcatttgtcaaaatatggttatcaataatgcatgcttataatatgaagaatgctttatccatgtcttatttttcatattacataacattcttattcttttaacaggtccaggagagcctcagattattttttgtagaagtgaagctgcacatcaaggagtaattacctggaatccccctcaaagatcatttcataattttaccctctgttatataaaagagacaggtaatttgtgtagaatttaatttcatcagaaaagagaaatcaagaatttgaaagtactagaaatttttattgagccagtgagtcacaaagctctctgcttagagactgcataggcatagtatactccctgatcttagaattgcttccactcattcaaagctttccagccccagaaatgactaaaatccagaacattctaaatatttgcttgtccttcttggtcttagtttaaatctttgtgctccaaagcctagagacagaaaacctctggatgacaacactcatttctgtcttgcaagtattatgtaagtgatttgactcactttgaactcatcattcagcctcctaaacaaaccaacaaacaagcaaaccccttgtaaaacttgtttcagctaataatacagacaaaatgttgggtgaataaaaatgaacatgggcccatgtagccgctggggccagtttggtgtaatcttgggagcatagttctaagtttagaattagacttctgcagaagtaatgcaattaaaaaaaaaaagaagaagaaagaaatgtgctatgactagttcactcatgaaatgttcaaatgagatgctatttaagagaacaaatatcttctggacaatttaaagtatctaaattgtttgtagaaagtaacatcagtggagtatctcagagcagcctcaatgcctgggatagccctttctctattcttttatccataggttaaaataggaatgaagtgaacctcatagaattctgtcactctgtgctgtggggaaggaaccagacatacacttcaaaacttgaaaagtgaaaggctatttttcttcattatgttattttatattttaatggccttttcttgctagtgtctttaggtcttaataatcagactactaaagcaaagttaaatatgcatgtagttttcaaattaacattcaaaggccaaggaaaataaatatatactatatatttgaggttatgataaatttaaaagttaagtctatgtggaaggaaaaatggaaattccaggaagataaaacagcagaggtactgtctgcctcattggacacctcttttacaaacactttgtgtagcttctatgggaacacattgttcattttttttttctcttctctgaatcttctattcactatccctttctgcattcctcaatgtctacactctctctactagagagtattgtcgatgtcagagtatatggtagacattttatgcatttatggctcttttatatttttacagtttttttaaactgtatttccactgtatttgcataattagggtaaaaaggatgtaatgagttagtagcaactcattacagcaactagcatgggtccttcttattgggcaactaaatagtgttacccaaatttaacagctgtccacatagaacacttaaacgggattgaatggctgagaaggggaggctagctatcaggctgtgtgttttcttttctccaaagctgccgattggtgactgaatgcagctttggaccatgccctgacactgcataaagggctctttggagccagctctactctaaacagcgtgctccgcttttgttttctccttcatctcaaacatatacctgtctcctctcccatgttacctaaggcaaagagagttgataggattatagtatcgttaaggcaacttaacttttctcaccattttaaataaaattactattaaaaatccacaggaagaaagtctatgaaatttgcagtttactttttaatcagatattaaatttcacttcattacttcacaatttaattttttcagtgtctctaaaagagagggattaaaagaggagaaaaaatgcaattgacattaatttagttttattggtttagcaggtttttttaattatgtattatttaaagattttatcaactattttaataactcagtggagatgtgcatacatatcttcatagttcatatgatgaaactgaggttaacagaaaatgtgatagatgttcaagttcagtagcttgatctgtttcctttctgctcttggttttgtttgtttgtttgtttgagagggagtctccctctgtcgcccaggctggagtgcagtcatgcgatctcggctcactgcaagctccgcctcccaggttcacgccattctcccgcctcagcctccctagtagctgggactacaggcgcccgccaccacgcccggctaatttttttgtatttttagtagagacggggtttcactgtgttagccaggatagtctggatctcctgatctcgtgtgatccgatccgcccgcctcggcctcccaaagtgtgtttgtttatttttcctcacatttttagcttaagatattttggagaactgcagttttatctcgttaacttaatgatggcaagtgacagtgaagcttcttggtaattggggaattggggaagagatcttttgtgctttattggatttaaaggattatttttcaaaagttactgaaagcaataggcacctttcaagaccaccatgatgttgctggaaattattttgtgtaatgccttttatttttttaagaaaaaaaaaacagaacaaattgcttaatctctctgtggctcagttttgtcatctgtaaaatcagatgatagtgagtaccaactaatagttgcagtgatggttaaattaattatttcatgtataccccttgaaacagtgcttggcacatacagtgagttattatttttaaaaatcgttattgatattattattactgttgctgctatccagaaacatgttgccactctaatcatcctctttcctgatgtcacttggctactcaaaaatagcagcagctggtgatttttttacttaacaagtgctaagtcttctgcctgagtgtgaaaacacacttagacactgtcctacctctcatatgcctccccagccagagctgttgtcctgatcaggtttgtcactaaactcaaaaacattccttcttccgtttgtaatattttcttttctcccttacatgtattcagttccacttacctttcaatgaacagctgaattccacttccggcatgaaactccctcattctcacagctcccgttaattactgtagtgtccaaattactatgatagaatcaacccaatgactgatgatcaaatggattctgcatctaacattcaaaacagtagctaataccgatgttcaaagtttggaggttacatatcagaaaaggttttctaaaaaagaatcattctgaaacatgcaactcaagacttacagtatacactgggggctgtgttttctcagaaacaaaagagatcgtcttcacaaatgaatctgaacttattaaatattttatgtaccaaattaatgatataaaaccataatttttcaatatttaattttaccaatgataattgagtttgttcaatacactggctgataattgtaggtacttttgagtatcaaggatgtacttatttttcaatcactcaatagtttggagttcacttggaacaatgtgatgtagagaccaaattaattaggtacgtggtagtactgacttttaacgacttactaattttttttcacatttttcctcagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcgtaagttatatgttttaatgcttctttccataaatggtaaaaagcaaggtatgaactttttagcctacaatatttctatctttattctagcaagcacatttacctggcacatttgttaacatctagggcttataaacacgtaaaatctaaaagtttaaaaaccgttatcctggattctctctcttcttcagatatagtcatagaattttaaggacaaagcataaaagcatcttaattggcatcagtttgtgcaatttcatgcagttaagtacttaaccaacttagattaaaacattcactgtttgctgttgtctttactatctggaaatattaattgtaatcagaaacctaacaatgtctcataaagcattagcctactaacctctgttcatctgataaaacatttcataaaatgtaatattttattagcattttcttctcttcgttaccctcaactacttactattctattttatgtcacattatccatttaaggtttcctttcaatggcatttggctcttgccactagtataatctctccatagtttccaggcccaaagttagatctgcttctggggcacatgttaacctccatcgaggacagggaagaagaaatgccgtgttttaaggcagcatctatagctccagagaccctaacgggcactagacttgtgaagaaatattgtgctatttggggctgaatataagacacttttaaggtcatttaggttttggtttgaaaagttctggtcctggagctctatgcttttgttgttttcctgagtttctgtatcacagaaaaagaagacaatttgtttctgttcctgaagaacccatctaggtgtttaccaggataacattagcactccgggaaagaagggtctagattgtgtaataggacttggaggtttcccaatcaacaacatttttcctctcctctccccaaacttccccctcttccccactcccttccctttttctctattctctaattctacacagtctccttcagggattgcaataactctcatggcttcatgtacaacctatatgctaatacttactgaataaatgagtgatttattcttcagggttttgatattgttttttaatttatgtactatcataacttccttatttataacccccaagctaacacttaaaatactttatactatatccaagtattgtcaagtaatttacatatgcatctattaaattattaataacaaatctttcttcattttgatagctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggtaaaagtatgctctctacattactatagtaccaactacattataatgattgattcatagtacttaaataactttaagaccactgctcacatgagattgagaagctctgatgtgtaatggaatcacacttaaagagtctcaaatatttgactctaaaatttttattcctatagctcaagtcagtggtttaaagcaaatgtttcattggaatattttagaacttcaatatgacttaattatagctaaattattgcttctgtgttaagaagcacaacactttatgcacaacagattattactttaccaaatctaccttttctttactttggctttttatctttattaatgtggaatttttcaattgcaaaatttcacaggtaccttgaggttaggaaatatttgaaataaacactagacaatactagtgagcatacagaatttaaaacactcattatctcactgtctactgatcgtattttgtacatgtaacttcataatatacacatttatatgcacttaacacgtattatcaacattctgagtacacagttttcaaaatacagttttaaaactgtatttttaatatatcactatatcacacacacctttctatgttaaatatttaactactatgtagtttttaatgcctgtataatattctatgtatggctttatcacattctattaactataactatgttggtctctaatataaacaacattccgataacacacttattggtaaagcaaaatttttgaatgtctttaataatttatgtttcataaattcctaaaaatgcatttattgggtcaaaatgtattttgaggctttttggatatgtaactttttttttctataaaatttaccaaattgccctggtgtatcagtgtatgaaatgactgcttcttgagaggctcaccaacactgaatacgcctttctttttctttatttggtggttgaaatatggtattgatatctttcttttaatgaagtttctttacttattgttctttgtgttattctttgcctcttttatccagttttctccggagaaatgccttgaatattaatgatattaaactctttgtcacatgcgtaaaaatgttatcagtttataatttgccttttagttttcttcacagcactttgtcttacataattcccctttttatttttaaacaaatgtatctgtcacttttattcctgttaaatagaaatttccatagttaattttttaatatgatgttgacaaacggcctcatattctttttttgttttgttttgttttgttttgtttgtttgttttgttgttgttttttgttttgagagggagtcctgctctgtcacccaggctggagtgtggtggcgtgatctcggctcactgcaacctccgcctcccgggttcaaatgattctcctgcctcagcctcctgagtagctgggattacaggcacctgccaccacacctggcaaatttttgtattttcagtagagataggttttcaccatgttggccaggctggtctggaactcctgacctcaagtaatccgcctgcctcagcctcccaaattgttgggattacaggtgtgagccaccgtgcccggcccatattctttatcacttaaagaagtgttttcatatttataaactttttgattttgtttttgaactggaaatgtcggttggattttatcgatttttagggcattatgatagatgatgccatagttgtgatgccctggtgtgattagtttaaatgatgcaaaaccattgtcacattctaagagaaaaacccctgctctgtcattgtgtgttattctctcagagtattattgaaatcaacagcctattattgtctttattagtagatattcaaaaaggagatcattcagtgagtagagacggtgttggcataggcgttggatgacatcattcttattaaatttggtataaaggttacactgatctgataaaacacattgcttatatgttcctgttt

SEQ ID NO: 14607 - DNA, 19791 bp, Human
  misc_feature (1)...(19791): n = A,T,C or G
ttctttactgtactctcagtgccaatctggtcatctgattgaagtacggagatagacaactgcaaagcaatgccagcgagagcgaatgcacaggcacactgtgaaatgctacatttaccttcttcagcagggcaggaaatacctaccaaaagatgaaaagatctcagttcaaactaacaaagaataccatgagtgctttctttttcttttttcttttttttttttagatggagtctcgctctgtcacccaggctggaccatgagtgcttttttaaacctcattttaaatctgaaagaagaatgaatacattggtatgcataagaagtttagtatgaacccatactgtgttttgttatcaacaaagaaacaagaacaaaattggcaccctttcagtaagctcagctgaggtattttcacactgaaggttctgcaggcttctggagcccttgagaactgagtaggtaggttcaggcagctgtaacaaaataccacagactcggtggcataacaacaaacgtctatttctcacagttgggaggctgggaagtttaaaatcaagctgcacacagatgaggtgtctggtgatggccctcttcctgatctgctgaaagccacctacttgctgcatattcccatggtaaacagagatcatctcttctgtgtctattcttgtaagggcactaatcccattcatgaggactctaccctcatgatctaattacccgcaatgccccttctccatagaccatcacactgggacttagggcttcaacatgtacattttgggtgacaccgaggagtcagttatgaaaaaggcactgggagataggtagggagatgtgcaaggccctgaggatctgagcctttgagtctggagtgcaagtccattctcacaggttaaggcaggatcctgaacaaacatttgttgaggtttttctttttgtgtttcacataattctttatttttattttttattttttatttttttgagatagagtcttgctttgcccaggatggactgcactggtgtgatcgcagctcaccatagccccaacctctggggctcactcaggtgatcctcccacctcagcctcccaagcagctgggattatcaacatgtgccactactcctggccaatttttccttcgcatacttcttgtacttgcacagtggagacacagacaccaatacatcacaatacactgtgaaggaatgaaaggaaatagaatgcactgtaggcagaggtgccagctcgtctctgcttgggggacagtgggaagagctacagagaaggtgtcattgtaggtgcctggtaaacaatagctgttgtcgggtgtggtggctcacacttgtaatctcagcactttgggaggccaaggcaggaggggcgcttgagcccaggaattcaagaccagcctgggtaatgtagtgagaccctgtctctacaaatttttttttttttttttaattagcaaggtgtaaggtgcatgcctgtggttccagctactctggaggccaagctgggaagatcctttgagcccgggaggttgaggctgcagtgagccatgatggtgccactgcactccaactggggtgatacagcaagagcaagatcctgtttctaaaaaaattaagcaagccagaggtggtgtgaacacagagagaggtgggggcaagaagaaggagacagattgggatgatgaggaaggagattcagggccgagggtgataccaggaggcagagcctgagtatcacctccttcccttctccaggaccgggtcccttttaggtgagactagatgaaaagggctcttcagcagctgacttcacagcaactaatttctgacaggtcagagttggcattgctcaaatctgggcttcatttccaagaagtttcacaagtctgccaggggaagtccctggacttcttgcttctttcgtgtaggacaggctgtcgaaacctcagtggataaaagacctagagaatgtgtatcccagaagaagctggccaaggatatgggagcaaccaccatggaccagaagtctctctgggcaggtgagcatggggttgataattcagcaggaaagttggtgaggaaggaagaggtaacaggtctgtagaagaagtaatcttcctcctttcctgggacttcagtctttccgttgaccttagtgtcaaaaaatttcaagccaatgcaactgttgtaggggaaccacctgatctttcctgaatggacaaaaatgcagcagtagccagaaccctttgcactggcaggatgttctcagtttgtgcagaggtccttcttgtccacattagaactggagctaagacaggaaagaggccaagctttcttagtctcttggtgtatgagcgttgtattgcgagtcacatctttcttgggctctgctgtggttatattttacaacttttggagagccccacatttctcatctgcagaatggtttattgaatttaatgttttttaaactctccctttcaactctaaagttctgatccaaaactctggcttttgtggtggctgggaattgggatgagagtggggatgaggctaaataaacaaggctatgagtgaacgggggacgtttaccaggaggggaggggagggaatatgtctgctggaggaaagaaatcatttatttgtgtccatacctctttcaccttgtcttaccctctcaagccatgaagcccccacttggcaagagccttttgggttccctgttgaacttagctgagccctggactgacccttgacagggtagagcccgtagggaggccacactttggagaagggcctggaggctgacctgacagtggatgtgccacagagaatttctctgaccatttacttagtgagtgtgtggagaaccagggcctaacctccctgcctaaaaaaacatgtgagtcatcaagagagaacagtagagccctgttttccagccctaagctctgcaggggaggaatcagctccagcagctgtgtcattgaaagttttctctcctttttggctgcccctttcttcacttttggacccgtaaaggtttcagagtgaacaatatccccaggctggggggattgcagttccaggagtcttgtccattgggcaaagtttctaggatccaggggtctgctctttttttcctttaggaggatgtgttaagtatagaataatctcaccagtcttcctagggtagatgtcctatggagaagagactgggcataatttcaaacatataagtttaaagcactaccagggccagctcacactgcttatcttgttctaagagttaattgtttatacatagtgggaccatctcaatttgcctgagatagttctggttcaagctatcgtcctagggaaattattaataatgttcctttttactctttgaagggtctcattggacaataaactatatggtcaccctacctatattcaactccagactggactatgagctccttgagtgcagggaaggcattaactgcattataatttccccagtgtcctgagcaatgcttagcacagagcatatgattcaataaaactttgttggataaatgaatgaaaaaataaattcccagcttggaacatgtttctgcctaggaatgtagagacacaaggcaccccagggctggggacctcaaggtcctataaagaaaccacaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcgcgccactgcactccagcctgggagacagagcgagactccgtctcaaaaaaaaaaaaaaaaaaaaaaaaaaaaaaagaaaccacagcagctgtggctggggagcccagatgaagtgtggctctatcttgtatgtgagcacacccacattttcactgccattatctgggacagcagaaccaggtttggctcaacagatttctctttccacccatctattgcaggtgtagtggtcttgctgcttctccagggaggtaagtagtcaataagtcactaccgcctggatctcctggcttgggtgctttcatttttgatgtacagtttctttttctgctacatgctttttctcttgattactctctccggttctgccactgacatatttatgacactgagtttttattctatctttttgtgtatcccttgttctagttctttttgagccactctctctctcacccctcccccatagctggcctcaatatgtgtgtgtgaatacaaacatacacaatgtttgtattatctgtttctctactgatctgtgtcatccatccatacatacatactgaatcttagtgctccatgggtgtttcatatgttggtggtatctctgtctctcaatgtatttttttttaaatttttttgagacagggtctcactgtaaggtccaggctgtagtgcagtggtgtgaccatggctcactgcagccttgacctcccaggctcaaacaatcctccaacttcagcctccttagtagctgagactacaggcatgaaccactacacctggctaatttttaaattttttgtagagatggggttttgctatgttgccagagctggtcttgaactcctgggctcaagaagtcctcctgcctcagcctcccaaagtgctgggataacaggtgtgagccactgtgcccagtctcagcgtatttcttaactggggtctgggtactcaagagccagcactaaaggcccaggctgaatgaccctcagaggctctggcagaatgagcaaatgatgcaatggctgtcttggggagaaaattgtgactttctggactctaaggcaacagccctagagtctcactggctctcttcactctactccaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagtcagtaagatgggggtggaagcatcctgcatggattttagaggagggaagctggtcttaagctgacactaagacatactatctcattcattcattcattcctatatatttctctgggtgtatttctgatcctaactgttctcaccagtgcttcatcccttcactgaacttcactttagttcaaacagccaggccctaattgtccattttctctacacttaagaactctgttctttagacaaaggcttccctggcagccagaaattaaataatcatcttattcttctacttcaggaatcccaaactgaaaattctcttgtccattggagggtacctgtttggttccaaagggtaagactacatctttattttttgttcatttccccatgtaatttttgatcatcatcatttttcctccttctaagaagagatattaaactaggctttaagaggttttcccttggccaggtggcaaaactgatctgagatttgtcataagcagaggaacagcattaggtttcctggggtctttgaaggaattcttctggagcttaatacaagcccagacactcaaggcttgagagaaagtgggccatgaacaatattcagaaaattctgaattatttacatgaatgtttttcactttatggattatagaattagttttaattggaaagtgcaattttttttaaaatcacttgagggtttgactttgtgccccggggtgggttggatgggttgcttccattcagaagccccaccatggcccatagcagtcagtggagtacaatgtctgggatcatggctgtgcagccagatggcctcagcaccatcagagcagcagaggaaacaatcagtcctgctttgcttaaaatcaaaatagctattgatacaaagcacacattcgaaataatattttctattcccatggaaatgatatcccatttacatcaagagctaaatgaaaatacataaggataaatatcacattttttcaatcttcagctacagtttatctaattttgaatttcttctgctttattatttaaagtgctaacatcttaaaaagtccagagatcttaaatttggctgagagagtcttggagtttttatagaaatctgatagtacaacttgtgcaacctgtcagaagtcagttacagccagagtgggcagagagaagaagtagtgttagaagacctatgtagatttctgcacacagaaagaaggaagaaagatcaggctacctaacttttttggttctgtgttaactcctccgtgaacacccttcaatatgaatgggcttccatggcacccatccttctaattatcaaattttctccccttcctaatacttgcttaggtgttgatgcaaataaaaatgtcttcatttattcattcattcttgcattcattcattcattcattcattcattcagtaaattcattcagtaagtaattgtttaccagtttagtggttgaaagtagaactttggagatagacgtgtttggtttggatttccctttagatgcatgcaagctatgtgacttttgtcaagttctttatgtctgtatgccgcagttttctttaactatacaataagaataataacagaatttacctcagggtggtgttgtaaaggcaggcaacgcaagcaaactgtttagcatagtgcccctgtgcaataagggctcaatggttgcagtaatcattgttatatgattattgttgttattattaggtaaatgccaggctttgtgccaggtgctgtgcagaataattatatatgtgtaatatacaaacttgcttctaaggaacaaattagtaaatttctattgaatgggcagctctcctaaaattggaggcatctgcccagaggctcaggtgcaatggctttctaatcattgtaagcactttcaaatgcaagagaaaagctagaaaactatttccaccgtagttttctgatatcaggccagtttcttgctatctcttcaacttcaaagatgagatacatgcaggaatcaaaatctcaatttaatattgagtaaaacaaaattaattcaaggctctaagaaagcctgggtgtgggaggtattgtaagaggtgaaaagtgacacaacttaaaggttatgtcctcaggaaaataccagtatctcatctacagctttgggtttaaaatgctattggtgcccttggtgtgggcatctgagaatcaacttcatggcttcagaattctagttcagatgaagcccttgaggagctgctgatttcaagtcctgttttcatcagaaatcccgggggtggggagatctgcgttgcctatttgtggccgggatgcttgtttggggaccatgaagtcactggagtccagttctttttcctggaacttccctaaatgttatccccttgaggcacatgaagcaggattagtaccctcagtcccaatttagaggtggccagactggaacccagagagcaggttaatgacaaagtggccatcaatcagaaaggactctaaccttggacttgaatctagttctcctgaccctaagcccaccacattgcaaactgcttttccaagggtgtaaagtgttaaagaaaaccaaagctggcatccgggagggaggtggggggggtcagccccccgcccggccagccgccccgtccgggaggtgaggggcgcctctgcccggccgcccctactgggaagtgaggagcccctctgcccggccaccaccccgtctgggaggtgtacccaatagctcattgagaacgggccatgatgacaatggcggttttgtggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatcggtgaccttgcccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaaaaaagaaagaaaaccaaagctggacagtatttaaagcagtaaaacagattttattcaggaaatattgaaacggggaaaaagacctcagtatggtactgggttctattccaaaggcagcaaaggcaagtgaggaaatatagccaaagagcacgctaggggcaatcagtggatggaaaatcataaagaggaaacactggggctagagggatggattcttgctaaactgattcaacaggattcctgccaaaggatgccagagcgatgagataccacctgggggatggcagggggtgagtaatcaggtaccaggtctgggggtttctggctaaactgacctagcaggactttttctggaatcggacactgcaaagacagacacagaagcccaagattgaggtccagttgagaagagggctcagagaagcctacctaagtttggtcaaggcaagagtcttagccaaaggcagctccgttacccttaggaaggtctgcagagaatctagtcttcctttacctggctggatcaatgttccggcccaacaatcctttttctctcgtctgttccaaaaggggaaagcattagaatagacaaattgtaagtgaatattggggaagagaagactgctcaggatttctgtgaaaaatgtgttacactacaagtgttacttgttctttccaaaaagacactcgtattgcttctttccaggttccaccctatggtggattcttctacatcacgcttggaattcattaactccataatcctgtttctgaggaaccataactttgatggactggatgtaagctggatctacccagatcagaaagaaaacactcatttcactgtgctgattcatgtaagtcatgaatcaagtaattcatgtgagtcagatgccacggtgtactcagtactctgatatccagaatccatggccacattgggagacaaaaaggaggagattgagtctaacagccccagcctttctgaagctcccactaatgagagaaaagccctgattcctattttaaggcagtaacaacatgaaacagtggagcccccttgcacatttattttgatgtccttctttttgatgaagaacatcaaaataaagcaacatccatatgaaagagggtgtagccataggatttcctgagtactgaggtggcctcacagaagatctatcagatagatctgaaaatctatcaggtagaaaccaagatagttattcctgggtagagtgaggctggggttctcctgcctaatgtggagacttcctgagcagatacaggcacaaggcatccccatgtggggtggggaggaaagggttgatcctttccatctaatgtggttctagaaacctcatagattccaggcaagaagcttagcactgtactctgggaaggggaatattgcaccttgtttctttgtttttcctaggagttagcagaagcctttcagaaggacttcacaaaatccaccaaggaaaggcttctcttgactgcgggcgtatctgcagggaggcaaatgattgataacagctatcaagttgagaaactggcaaagtgagtacatcagagcaactttccatccctctgcttccaatttggtccatgcaaatgatgcatcagcatgtttgacggatgaggggaggaggaagagagggaaggtcattgtcctaaccctgcatcattcagccaggaacaacttctttacagagactttcaatccttctagcagcatcattcaaagccaaaacaattacttacaattgtttctaccactgctcgtcacaaaatctctcccattgcttttggcactttagagatctggatttcatcaacctcctgtcctttgacttccatgggtcttgggaaaagccccttatcactggccacaacagccctctgagcaaggggtggcaggacagagggccaagctcctactacaatgtggtgagtaggccaggggaaccgcaggggtactggctgtgggggtggggccggggagagtccagcatgtctagagttacttctgtcttgaactgaggaagagctatgagcccaagagggaattgggtagccccaggagcaagtgagtgcaggagaagtgctttgaccaggcaccaacaaaatgtcacctagaaaatatcagaagtgctgatagctgaagtgccctaagctctgtctctggctcagagtgtcccccatcccagtcttctctggattctccatctttcatacatttcttggcatctacacaggagaacagaacttggaccttcctgtgtccatctatattccctatttaattctatctttaaaacaaccccatgaggtcagctgggtaggaaatgttactcccacttcacagatgatgaaacagaagcttggcagattccattgactcttcaaggtcgtgtgttgtgaacttcctggtgatgggaaatgaaaagtaaaaaaaaaaaataatgttgttgatgttgttctggaacataacttatccacccaatgggttctccttgcccattgatttatcaagataggagaattgcaatagagaaagagttaaagtcatgcagaatcagctgtatgggagactggaattttattattactcaaatcagtttccctggaaattcagggatcagggtttttaaggataattttgtggatgggggacagaaagtggcgagtgctgattggtcaggttgaagatgaaatcataagggttcaaagtgggtttttctcgctgtcttttgctcttgtttgggatcacagaactggttgagccagattcctgggtctgggtagtgtcagctggtgcatcagaatgcaagatctgcaaaatatctcaagcactgatcttaggttttgcaacagtgatgctattcccagctgcaatttggggaggcttagaatcttgcagcctttggccgcatgactcctaaaccataacttctaatctcatggctaatttgttagttctacaaaagcagactggtctctaggcaagaagagagtttgtttctaaaaagggctgttaatcatctttgtttcaaagctaacctagagactaaattcctcccaaattgagttggcttacacccaggaatgaacaaggacagcttggaggttagaagcaagatggagtcagttaggtcagatctctttcactgtcataattttctcagttacaatctttgcaaaggctgtttcatatatatggatgtatattcctaaaattttgggagaaaaaatatctgtgttgcatgtttccaggccttcatattcaaagtcacaaaatggatcggtccagagctagatatgatttctggttggggttttctaggccttcatgtggctaagtcacatcagcctccttcactccttcctctctatcagttatctttaaggataaggagacatatctttgtcttctctaaccctttattttgttctgagagcaggaaagccaaaatcagcctcttacctcccaatctgtctataaaccaaaaataaaattctaagccccccaaacatctgaacaaatccttcctcttggccaagggcattcaaagttaatctgaaaagttaattcaggtcatgatgggaagttgggtgtcagacatgcctcacagctgaccagcattaacatcaatacagagaccttaagactgatagaagagaatttctaagtctgatgagaaacatttacaatctagtctttctgaagcctgctacctggaggctttatctgcatgataaaaccttggtctctacaccacttatcataacccagacattcctttctattgactccaggcctttacataataactctttcaaccaattgccaatcaaaatatctttgaattcacttatgacctggaagctgcagcttctagttgtcctgcgtttctggagtgaaccaatgtacatcttacatgtactgactgatgtcttatgtttccctgaaatgtatgaaatcaagctgtaacctgaccaccttgggcacatgtcctcaggatctcctgagagctgtgtcatgggccattcgtcactcatatttggctcagaataaatctcttcaaatattttacagagtttgactctttacgttgacatgtcccattgggtgcaaggtcattgtgaggcctcatggactaggaatctgacagccacctttgtcagtattcacaaagagccattgtgtagacaagttccacagggattttgagttgactcaaaaggggaaggaagatggtgacaaccttgatttcatgttttctaggttccttgactgatttcttttgtgatccactgtctagttcctttcagaaattagaaaaagttgcataagcctcttgctgctaaagagcatatgtgcattacaacaagcactctggtccggggggtctggtctgttcacactcggatgtagaaaagaaaccaggcagtcacctctgtgaagtttgggatagaggctaaaaaaggtctgacacctttctttccccacactctgagcctccatctctcttcccattctaggaatatgctgtggggtactggatacataagggaatgccatcagagaaggtggtcatgggcatccccacatatgggcactccttcacactggcctctgcagaaaccaccgtgggggcccctgcctctggccctggagctgctggacccatcacagagtcttcaggcttcctggcctattatgaggtacctggaaaccccctgtaccctcagctccctgccatgtctgggtagatgttccatcttcaatttgacagcagagtaaagcatcctgagtgttgcgaaggggaaagggcagagtactactgaacatgtgaggggatctcctaactctgggttgggagagggtcagggaatgcttcctggaggaagtgaaataagctggactctgaagaggagatggagctagccaggaatggggataggcagaggagagtgcgagaaattgaaaaaggaagactaccccaagttcttgatttgagcagctaagtggatggcaatgccatttacagagatagggaagactggagggagaacagagtggacattggtcctgctcatgagatcagttttggacgttctgagtgtgaggagcccgtgggacatacagataacaggtgagtcattgaatatatgggtttggatcacagcaggccagtctgcactagagaggtagattcaaaactatcagcataaagctggtacctgaagccaaaccatacagtgagaagtgaatgaggccccagacacacccaaaaacctcctacacctgagggacatgcagaggaaggggaacatattaaggtaactgacaaggaactacaagagggataggaggaacccacccagatctgtgccaaagaccttagagaagtaggtgtttcaaaaaggagggagtggtcaaatgtgtcaaattctgtgcagttgtcagatagatcatagggataacaaaattgttctgctaattataccatcattcctctctgccctccaatctgggaaaatttatttaaaaagcataggggaagatataaatctaacaataggtcaaccaacagaaactctttggacactcccatatcccaaacactgggtactgtgaaagctagaaataagtaattatccatccttgtctctaaaggggttattgtcaaggtggaaagaatgtgaaatacagacatagctagttaaacaagagttcaaaaacaagataactataacatttaataaaatcagagaggtattgtaaaacaatatgggattcaatgaccaatgaatggtgtagagtgacatgagatcagagatgggtgactggggaaggctccatggaagaggagaagtttatgctgggccttgaaggattagtagaaatttgatcaggtagagaaaaaaaaaatatcattctatatcctggtctatctttggagtcccagcctgacctctcattgtgagtgtgaacatgccatcggcccatgctgaatgacttggcacccaccaaggtacccattcagtgtaatgctcaatttttcccttcatcttacacataggaatgattggcacatcatcaattcaattggcaacaagaatgggacatgggtcattgtgagagtcctcattgaatctcagggtgcctgatacataggaagtgggagagaggctgacccatccttgggtagttctaggttgatagcaataacactcttaatataagggagaagagaggtcattgctcagaatctcctggtagggttataatatcaaccactagatatgcacttcccatctcatggaaagtttgatttgattgttcagttcataatgactctaggtcattataactttgacaggttgatatttgcttaaatattcaactttcattttctgccctcattgtagtaagcacaaatgtagttcatccaaaaagagtaatcctaaatggattttctatgtgatgttgaaatgcattgtttaattgaagatttatcttttttagagctcttccttatgctaacagaaagaatatagctaatgatagaaggggagccccaggacagggcatattggatatgggacgggacagaggaggagtaataagatttaagtggagatgctacaagatgaggaatagtggtgatggtcatgataatacttcactttagaagtagagcactttactgttttcaaaaaaattttttaatgtgtattagttcatttgatcctaacaacaacactgtaaggtagatatgttgaaagcattattataattatttccattttgcaaatgaagaaattggaagatttattggtcggtgctggggtctgatctggaactcaagtattttctgatttctagctgctgtgtctcctcctgatgagactttagcacagacacttcctagaggttcaccttggaacacccacttcatatgatatatgtggtcatttctctcattgtctgatccttgggataaaggttctgatattttccccaagtccctagtggctcacctgccctgtctaccccaaccaagtttcaagaataacccattactgaccctctcgtttccctttcccctgccagatctgccagttcctgaaaggagccaagatcacgtggctccaggatcagcaggttccctacgcagtcaaggggaaccagtgggtgggctatgatgatgtgaagagtatggagaccaaggtaggtgggccacaggcagatactcctttaggtggggaatggtgatatgtagtaaaatgcctgaatactctatgttcaaagagagaagcttctgaggccccagactctaggatgggatccagcagcctttatagctcaagtctagtagtgactctatgtcacacccgcgagcagctgtggtacaggtagaagagttggaaaggacgcaaaaaagaattgagaacaagtaagtttattctgataagtgaggagtggagagaagagtaaggcaaggagaagggagggggaataaaggagacgttggtgcctgtatagataatctactttgttaattatctcaggacaaactgttcagtccttctcatggattacctagctaggaggctccagattcctgagcctaccagttcttagaccttggtaagacatttgtgttcctttcatggttagaacaaaaaggaggcttgagtgtaattgacaatcctggccacttgtcttgttaagggcttcctagtttcttcccttattatggagagttttctcagcctccaagaatgccggaccttgagtgtggtgactcaagtcagaatgagatgtagctaatgctgatttggtggctctctctccctgagcaatcttacccctcaggaagtctctaactccagaaaaccagttagtctactgctgtattttaagcttagtccctcatctgaacctgatatggtcctgggcatttaggggccacccttcaaatctctgtgtatccttctgtgtctcccataggttcagttcttaaagaatttaaacctgggaggagccatgatctggtctattgacatggatgacttcactggcaaatcctgcaaccagggcccttaccctcttgtccaagcagtcaagagaagccttggctccctgtgaaggtaacagtccaggctggagctgggagtgggcagacagctgggcagaacagggcacaggagactgggggagatcatcttcacatatttggactaatcctttctcatgctcctttggctcttctgccatgttttcttagcaattaggctggttctgcccttttcataggcttcccatagacttttaaagtaataataataatattgataaattttggctaccatttattgagcatagtatgagctaaagactttcattacatatatatattagggataaatattgacaccaccacaattcttggttacaaaatcatcagcctgtcttaattttctaaatcacaataaatctgactctatgtcctcaattcactggactgatgataatttccatctcactcattacctgatgctcttttcccccacccacagttgatcttacttagtctagacatttgggagctcccatggtcattattgctacgccttnnnnnnnnnnnnnnnnnnnnctcccatggtgcattattgctacgcctttacccaagcctccctattaccttgaaggtcggtggctttgctgctgctccatccctgggcccccagttccctaggtgtgttgtatatcctcctgtgcagatgaaggctgttgctgaccaaacagttatgctgtgatacattggttctagggcagagggtggagaagcagggcgctggggctcactgcagacagacaactaaaagactggctctgctatcctggcaaagggcctagaaccatttgaaaactcctgattagataattgggtagcagccttccaactctgagcatccattgtttagtaacttgacttaggcctcagtttactgagttgggctttgaaatatttttccttttgtttccaggattaacttacagagaagcaggcaagatgaccttgctgcctggggcctgctctctcccaggaattctcatgtgggattccccttgccaggccggcctttggatctctcttccaagcctttcctgacttcctcttagatcatagattggacctggttttgttttcctgcagctgttgacttgttgccctgaagtacaataaaaaaaattcattttgctccagtaagtatggcctcatttattcagtccttgaccctgtgatatcaggttgttctgtccctgctatttgtgggatccagagctagggtgaaaacgaagttttgcatatcatgtttaaatattaaaaacagctaacatgctgttaaaatatgacttatgctccaacattaacacatacaactttgcaaccacctagaaggtcagaacctgaaaatttaaaattctcagactccttagaataccacaccagaattcccatctttgcctctgtctctcacagtaggagcctcatgggcatacttgtggacattgtaggctttgtatccaagcttcatctgcactctaccctctaccctcaacctccaacacacaaacccacccacacacacatacacctgcctctgggctatgcatgtgcacaccggcgttgtggtccactctcagtaaagatgggcccagggaaaagtcatgtgcagcctctgagagagcgcacaggctcttctggctatttgggtagaaatgctggatgtctggatcatgatttagaagaggaagtatgtgagctttaggtgaatgtgctcctagcctggcagtctccttaccttgtggggaggggtgcaactggaagagggcccaagtgggaccctccaaaggagggtcagcaaactacggcccatggatcaaagctagcccactgcctgtttttgtaaataaaattttattggaagacagccacactcagttttttttacatattgtctgtggctactttctcccaacaatggcagagttgagaagtatgacagagatggtatggcctgcaaagcctaaactatttactctctggccctttacagaaaagtttgccaaccccttttctaaagcacggtgctcacagcaccaggtctaagactgattccggtgtcagactccttaattttaggatgaactgttttcccccattttcccaatttcttccaatcttttccgtctagaaaagccacttttatcctgacctttgaacaacagtttcatgcacatatttaattctcatggcttgtgaagttagtgataataaacccaattttcagatgagctaactggggcatcattgtaagggtacatgtctgataagtggtggcaactagactgaatccaagaaggcggctgcaccagaatgtccgtggaggagggcattagaggtggctacacgatcaaagcagcataaggtgggaatactaggagacttttttcaaaactgctttgaatatcctattatgatggaaaaccccagacgtacataccaaagaatgggaatggcaagcactgacagatactaggggaagttagtccccaaggtccccttgaatgctgctccagtgctcagatcttcttactacaaggtagaaattgcttgggcacctctctggctttctaactctggctttctaactttgcttcctatggtaattgaattctcaagaagcagaagatcagagtaattaagaacatagtctggagccagatctcctgggttcacacacagtggctttgttaccaacctagtggctatgtgaccttgggcatgttatttatcttttatgtgcccccagctttctcatttttaaggtggggataataacaatatctacctctcagggatatgataatggttaggtaagttaatatttgtaaggcatttgggcaaatgcccgacacatcacaaatactatttgtgtttgttattatttccattaaaaggaaaacattagataaaacaaatccaacagagtttatttgagcaaagaatgattcaatgaattcggcaacactcagaaccagaagaggttcagagagctgtcctctgcaatatggagaatgagtatttatagacagaagagaaagtagagaaatagtctaattggtcacagccaggagtttgccttatttaaacatggtctgatcagttggctgcctctgattggctgagatctggttactgttac

SEQ ID NO: 14608 - DNA, 256287 bp, Human
  misc_feature (1)...(256287): n = A,T,C or G
aaaaacaaaaacaagatcaaaaccatttaaagaataataatattatctctgttttttctctaggaccattaacagttactggtggtgatattgatgatggtggtggtgatagtggagtgtgtgtgtgtgtgtgtgtgtgtgtgtgtgtgtgtgtttatatgtatgtctgtgacagagaaagagagggagattaacttcactcattcagtttctatatgtaaactattcctaaatattaaggctctagtcatcttttccagattgattatattttatttttgctatttcccacggtgctaaaaagcttgaaaagtaaactgtgtttaaaatgaaactaataatacatcatattcactccaagttttaataaaaatatcacaatctatctgaatatttagttgttaaaaatacagaaatttagttgcatacaaaaattatttcttgacctgaaacaacatttggattcttgtttattctacttgtttattgtttttaaaaccgtaaatatctaataatatgatatcttttcacaaaagatattttactgttacataataccattttctatagacttcaggatttctttttctaatttaatgtctggcttatccttgaagctaaggtttttgtttagttaaaatataatagttcaattaaatatctggtacattttgatattaatgactaatctgtcaagtttttgactgttttatttgagacataaatacaactaagttctaaattattaattcattatataaaatagagaaaattgatacacacagaaataatgctagtaattgtggtttggtttcccattctattaagcaaaacttatttaagcattattggtgctgaattaggagatgatagacatcataatcttatttgtatataaatatttaggcttggtctaggatggcaattctcaaacttaagctgtcatcaggatcacctggagggcttgtcaaaacacagatttcttggcccactctcagattctgcttcagtagttctgtggtgaggcctgagaaattgtgtttccaataagttcccaggtgaggctaaggctaatgttgcatttctgggactatactttgagactcgttggtctagtggaaggcagtagaccagagcaataaatcccatggactttggtgataggcccagatttcagccctgactttggcacttatgagctgtgtaacttggataagttagggatcaattttgtcatccataaaatggtaattatatctattaagaatattgaatgaaataatgcatgttaagtgtttggaacaatgcttagcatattatgaactctcattaaatgcaatatcagtaactaattgtgatggtagtaagagtggtagtcatagaagtagtggttaatggtaataaaaaagaatatacacatttgccttagttcaattgcattaaaagtttattggtcggccggacgtgatggctcacacctgtaatcccagcactttgggaggccgaggtgggcggatcactaagtcaggaggagatggagaccatcctggctaacacggtgaaaccccgtctctactaaaaatacaaaaaattagctgggcgtggtggcgggtgcctgtagtcccagctactcgggaggctgaagcaggagaatggcgtgaacccgggaagcagagcttgcagtgagtcgagatcgcgccactgcactccagcctgggctacagagcgagactccgtctcaagaaaaaaaaaaaaaaaaaaagaaaagtttattagtctttctaaggaatgatggatggagagcttggctttcattgatcattttgtctatgataaacattctgcacaagacatcagtaaaaagaagtaatgcccctagtgaaagcactttcaagagcattttggagattattatctagattgcagtttaaacaaaagtttctctatttgtacaatgtttctcaatactcagaacttaccatatttgttactttccttcccttagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccaggtaaaattctttctttgtatgtaatcgttctttcctcattgttccttttaaattccattccttttttagtactagagcccaaagcaatagaatatgcaaaaaaaaaaaaaaaattaaaagtagcttatcaaatctgtcatccctctgtgtctttgcttggagctaaataatttcaatgtaattataaataaactgtgcttgttcaaatgtacgtagaatgtgtttatgtgtcttgagtcataataacatacatactcagttcccagtcctctctgtgcctgtggatcaacaaaatcagatgctgccaatacctgacagagacaataaatgcccagtaccccaaagcaaaagagcccatgtggtgaacaaagcatctaagtgtttttgcattgatttccaaaaaagggtgctagcatttctcagtaaagagaaaataaaagaaaggaaacatttagagaaacaggaattactgagaagacccagcaaactcagaaatacaagggaggtcaagaagccatttgcatttaagaggccctggctatgtttttgatattttaggcagaacaggggaaaaaaaaatattcctttcattgtaagaaaaggaagagtaattttcattttaactttgaaggaatgtttacaaaagaggatttcagccaggaatggagtttaaatagttgtacctgctgtgctttcatgaaaaacaaagctaaagagaccacagagtaaaagaaactgctcaatgacaatgaagaaaaataagtcttgtctctatggcttggtacatttatgtgtgtctccagctgatttatcatggatgaatggatggatgttaagtgttatgtggaagtcagcccattgcagacaagtttgttcatctagggccaggcagggtggctgacgcctgtaatctcagcactttgggaggctgagaagggcagatcacaaggtcaggagttcgagaccagcctggccaacatagtgaaaacccatctctactgaaaatacaaaaattagccgttgcgtggtggcacatggctgtagtcccagctactcgggaggctgaggcaggagaatcacttgaacctgggaggcagaggttgtggcaagccgagatcgcgccactatactccagcctgggcaacacagcgagactccatctcaaaaaaaaaaaaaaaagaaaaaccattccaaactaacttccgttaactcactttagaagataacaaatcgtcatgtatatgttaactaatctctaactttatttccttggagttgtggttgtggaccatgtgtgaaaattcttcttattctccataatgtatacatagtaaaccaggagacaaatgcaaggtacatgcttgatgatttgaatagaaataaacagaatgaagaaaatctccctgacttgaatgtgtgcatgaggtattcaggctttcaggacattgacaactgttgattttcatggccaaggcagagcttatgacactacttggatctctgaatttagccaatgcagtcattcttatatagtgtgcaactagctattggaggcctgagcgatgtgggagttcactgaaccaactgtcatgttttactttacataccatacacattcctttggttcttcccccatcccttgccctccaaaaactctccaataaattagtttctccttcatttggactcttgctgggaaataaatgcatttcaaattcattaagagcacatatttccaagaagacctacagtgatatttttttctttaaacaaaggatgtgttcgtacaaagtatattagtttcctaggtctgtcataacaaaatgtcacggaacagtggctcatacaacatgaatttattttctcacaattttggaggctagaagtcagaggtcaagatgtctttatagctggcttcttgtgacacctttcttcttggcttgtaaatggctgtgttccccttctgtcctcacatggtcttccttctgtgcatgcctgtgtcttaatctcttaagagcaccaagtcatattgcaatagggcccaccctaatggcctcattttaacttaattacccctttaaaggggtaattacaaatacagtcacattctgaggtattgggggttaggacttcaacatatgagttttgtcgggtacacaattcagttcataacacaaagattgaactattcatttctctcccatttatcttttctatacaatgagagtttgcttaaaatgaggcatatttttcttaagtacagagtcaagtaatatatattctaaaaggcagaactataatgctggtatatgagatcatgaaagaataaaacttacaaagttatttttctttaggaactgagggagggtgggaattttacattttagctctattctgaatgcagcctctctctctcctctgttgcattttgcatatagaagccacagtgagcccttcaatattcaaatctcatcatgtcagggtcctgcttacaatccttcaacatttcacttgccaacctctccagcatcattcttgatattgctcgccttcctggctttgactctgtctcatgttcaggcacaagctgcccttcttgcctggttatactttccatggctcttctcctgacttctgcctgctcatctctcaggcaatggcttaaacatcttttcttcaaagaatttttcgctgacctccaatctttggctttggacaaagttaggtgctcttgttatagctcctataaaagttttgttttttctttcaaataaaatatatcacgattacaatgaattcattgtttaatttctgtcttcaccaaatggattgtacatttccttgggtcaagttttctttttctttgttggatggatgactagatatgtggctagtggatttcataattaccgttctgtgaagtttcagaatagctaaattcattggtcttttacaactttgagcttcaaatatgaattagcagtcacattccaattctgaaatttaggtatctgtatttcagaaagtgccatgtggactgaaaaggcaaacataggttcaagtcaagccactgatttcttatgcctaagaaataaaaatgaagtgtgagtctgactatcttttgaaagaagccaggaaaccgacacagaaaaagtatttcgttctccatgtatcttagattttaaattttgaggagcagaatcccatataattagcctaatttgatggggtgagaatatatttttagctgtaccataaatagatctgcccaaattcctacttccctataacattggctgtgcattttctcaagcaattatggcttttgccttaactaatttgatcattcacaacttaattcttgcacaaatgtttctccttttaaaaatattatcctgtcccttttccactctgcttttctcatctgaaattttccctctgaaccacaaaacagagatgatttcagtcaccattttcttgattcttccaagaatagcacatagcaagtgagagaaattattgtattacatgaggatgtcttgggacagtggttctcaaagtgtggttcccagatcagcagcttcagtgcttcctaaaaacttgttagaaatgcaaatttcctgcccccaatctaccgaattaacagtctggtggtgagggtgttcagcagtctgtaatctgtgtactaacaagcactttagatgactctaaaagcactctaaagctttgccttaggtcattagtacttgttcttaggaccacctgaatgatctgttaaaactctgattgctgggcccactcttaaagtttctgatccagttggcttggggtgagactcaattatttgcatttcttttttttttttttaaattttattattattatactttgaattttagggtacatgtgcacaatgtgcaggtttgttagatatgtatacatgtgccatgttggtatgctgcacccattaactcgtcatttagcattaggtatatctcctaatgctatccctcccccctccccccaccccacaacagtccccagagtgtgatgttccccttcctgtgtccatgtgttctcattgttcaattcccaccaatgagtgagaacatgcggtgtttggttttttgtccttgcaattatttgcatttctaacaagtttccaggtgatactgacactgctgatatgggaaccaccctttgagaactattgctttaaagttgtctgtgatttttccaggtggagttgattcctgttgatgcctgatttacattgttttactttctcaaaattactaataaggaactatcccccttcctgttcctcaagggtagaggccatgccttcttctttatatctgtccagtacttagaatattgacacataattgatcttgagcaaatttcttatgataaataaatgaaatcactttaaggttttgggtttttttaaatatagcaatatgcagaaagacatttgatgataatgataaaccaattgtgagatagagtactggaatattagaaaaatctgtggtagcaccaacccaactggtattagctcacaaattgtttcttcctctaggagtttacagttccacaggcattattaaaagaatatgccggctgggcgcggtggctcacacctgtaatcccagcactttgggaggccaaggcaggcagatcatgaggtcaggagttcgaggccagcctggccaacatagcgaaacctcatcgctactaaaaatacaaaaaaattagccaggcgtggtggcacgtgcctgtaatccgagctactcgggaggctgaggcatgagaatcgcttgaacctgggaggtagaggttgcagtgagctgagatcacaccattgcactccagcccgcacgatagtgtaagactccgtctcggaaaaaaaaaaaaaaaagtgcttatttaattgggagaatacctagccaataattgtgtctagtaaattgttgtacatatctcttgaatgtatgactgtttcaattcagaaaacctgaataattttttcagtggacttcattttgaatgttactattggtgacttctaaccatcatatgtggtccttaattcatgtacaagggattccaaaattcctttgactggaaagaacccccccgcctcaattattattttacttgcgactatacattaatcttctttgataaccatctcttcaaagtaaaaggagtatcttcattttatatttaaaacgctgaatttcaaagcattgatttgaatgccagtggggcgcacagacagcaaaattacaggcttttcaaagttccagaagcacaagatagtgtctgaaattacagacattttattttattttgtgtgtgtgtgtttttttttactctcttgtaacttaaaacaattttgtaagatccacccccctccaggcagcattttatagccaatttataaacctctaaaaaccgaagtttatggtgggaatgctgacagtcagccccactactgcagagctagtgaatgccaacagagtaccttgcctgcgagggtaaggatcagagcgtaaatcatccagagtctggagggccatgactgtgtgttcatgttatccatttcccatttccagaaacatgagactgattgtccagcaaaaatcacattgagagggtgttatgagaggccagtaaagaatgacccaaagtggggaagtgatgggtgggggacagggggagcagggggagcattcacaattaatccagcttcaacatctgggaacatagaacctctttaagcaatgcatttactatcccctggtgagctaaagagcgtgagagaccactgaacagagagacctttgtgttttgtagtattttttgcccttcctcaatactcttaatctgattctcatggagctttgtttgaatgacttctaacatatgggcagccctgtgttctacctctccctactgaatgtgcaagttttctaaataaataatttaagtttttctttcttttcattaagtaaaaaaaaaaagatgggtataggcatacaaatactagcctgcttactaaatatcaatcagtataaatagcaggtcttttttgtgttttctactaataactttgaatattattaaaatgttatttatttaccttctactgcctgatacttcttgttctcttcttccatctgctgaaatataatgagaccacagaaacagaataatcatatgaaaatacaggaattttaaaaaatatgttaaataacaatactttatttgaaggcaaatatatgactctttaaaatgcccatcaagtctatcaaatttttttaaattgtttggaattgtttggagtattgttttgactgtatctgtcttgaatccatcactgcagtaacaatttctccctcgctattttggcaatccttttgccgttactattttaaacacatgaaaccaggaaatcaaaagtgactaaggcaaatctctaaagtgtaaacttagtgattagtaatctccaaactacagctgtgtttgtacagaaacaggttacaactgtgttttctgagattgaagagaataaaggttgtatgtttcattctttttggtaattttaattcttcttctaattgccatcagatgtggtctgctggagagtatactcctggaccccctgcagcttcttcatctttgttcttcttttgtgtgtctcatcttgtttcttctccttgcctctttgtctttctcttaccatcagaaagtcaaaatcacagctggagagtgatgaacattctattttctttttcatatattcagagccctgggtttcaaaaccctaactaaccagtgaaccaaccaaacaaataaattgcatcaaataacttgttattctgaagtctccgagacggcagtcttgttgtatatatgcctttataaaaatctaacaaaggagatacaatatatactttattgctttattattataaaataaaaatgaccacatacgaaataatgccctctgtgaaatgcggagagagttctgaaaaattatttacctatataaaatggaactgggggagctttgttacctccagattagaaatggtggccattcagtatgctcagggctcataacatgtctttgacctgtacctgctgtaaacacaaagcatgtcaaggactattggagcatccagaaaagtggggacattggaggcagctagtctgcttctggccaatagaaaagtaagaggtggaaatatagcccaatatcatttgagcctcttttatttagtatattttctacactctcagctttctgtgaattgggccaatacatttattctctgtatctctatggttataaacatggttctacatgggtctgaaataacttagcttacatcttagttctgcacctcttacttgtgttcttggggcagttatataaactctctgagcctcttttcctgacatctatctatctatctatctatctaggtaggtaggtaggtatatagatagatagatagatagatagatagatagatagatagatagatagatagatagatgtcaggtcactattatccaatactggcttggtcaatattccagtaattgttatagatgaagtaattcagagatgtacatacacccacaaaaaaaatctgcttttacagaccaacattctactggattggggatgatgcaggatttttgctccttagttcaactaaatctgggttcttttctcatgaccaggaaaaattaggcatgtggatacactgaagtgtgaaaagggcagaatttattaagtgaaaggaaaactctcagcaaagaaaggggtagtatagccctaggtagtattggaaaaggcaacattcgtttggttaaaaggcattattcagaaagaatcaatcaggaaagagcgggcaaacaggggcagaagttgtccctctgggtcacaggtttcagttggaaccagcagtcatgtctttcagccttcaggctgttttaggcttgaaggtgatgtttcaccagggacccttccctatctgcctaggtaatttgtctgcctgctgcctctatcagggagatgacaataagtatgtaataaacaaataatcaaacatcagataatgaaaatattacaaaaacaccccaaacataggggtgtaatagagagtatggggcaataggaagcaagaggtaagagaatgatgttctgtcttcagagggaacattgaaactaaaatacaaatcagaaagaaccagccaagaaaatctcttagtgggagtagggaggcaagagaacaatcctggcaaagagaaaaggaagtagaaaacctaaggtggggccaagtttggcatgtttgggaaatagaaaggaaacaaaattgtgaaacattgagtaagggaaagaggtgtaataggtaataatgtcagccttaaataatgagattcagaaaatatgattaagtacagagtttatttgagctcagagcttgaagatggccactcaggagtgtagattcaagttgccctggatatacagtccaattagcagtagttacaagtgggtcttgaaaggaaaaaagaagcagtttttaagtttttgctaagaatatacattaaagtaatgtattgattggctattcatggttctttgtatcacagattccaagaacatgaagataatggtagaggcagctaattaggaacaaaaatgcctttaaaaaactaccctgggcatggatgctgtgaggaggggcatgatcaaaagtctccaactcatggctctctgggttggataaattttgcatacctcacatagctcagcctgatctgagttttctcatttccctccatttcatcaagatgttttgaagaaagcatagtagatgaactaaaagcattttgactccttagtcctatatcataaggaaggttcattcccaaatggttctgtcccacccaggtgggcgtgtggggaaggggcaggggagagaatacatctcagtaagaaattttaagtgtgcctaaagctgaattggaatggtatcacagggtggcaaaaatgagacttcagccaaatctcagtcaacttatttatatagttgctgtcacttattgaatcatcctggtctttagaatattatgactttaattttctcagaagcagtaaaacagtgagagatacatattgcaagtaaggattaccattacaaaaagagaacatgtattccaaaatgaaaaaggaaacctgttccactggtgagtacactgaaaacatcctgaagaaaattaaacccttgtcctttagagactcatagataggaaataattctggatttagtctaaaatataggaaaatcataaaaactcaaaaacagtagtcagtgctggaatctaatagcaggtgtgctatagttttcttctgaaacattatttttctctctccagttccccatgtaaaccaaggataattcttagtctgatcaatttatttgcaaaataagttttagtagtgctcttggcctgattatttgtataaagtgtaacaagaataatgaatggccatataggctcctttaagttggctttgctagaactttttcataaggaatctcaaattagatttttaaaagcctcttgaggctaggaaaacaagccaaggatttgctgtcaggttgtgcctgtaatacctatatgaattgggtaaagtcctctcttcttgaggtcccaaaatatcttgaggttcctggacctgtcagaaagtgatattctttacttatcataaggtcaggaaccttgtaagagaaccatgtaaaaatgtatcatgccagtcttttccagaggccttttattgggtttctaaagtcaacttcaattcctcaaagcaatctggtcatatctaaaaatatgccattccaataaaagctttggaaaaattaccagtgttcaatgtgtcctgataccaaaaaacaaacacattcttattgaacttatgcaaataactatattgccataaaacaagaatactcattattagtttccatattttgaagaaatcagctaaagagaaaagtgaacatttcaattttgcttgcaaatgtatactttaccccgttgctataagctatgaatagctgaaaagaaaataagacaaaatataaaagagtcagtaatgttgcaaacaaaaaagtcataaaaatcatttcagtcctctatcagttcagtaaattgaaataacttttgattgacgttgacttagcaatcttcattaatgtatcagctttttaattagagttctggcagattttacttcgtccaaaagtaagatctctaaatttatcagaaatctttattcaagaattcttgttgggattcttttccacgaattttttgaagaatggactatagctgattataaataacgttttgagaagacttaaagtaaaacgataattgtctgtggatgacaaaaagagtagccatggtcaaagatacaattgacaagaaatttaattatttttatggcataaaacaatgtaatataataatcataattatgtctgatagcatatatcaagacatatctgaatttaagaatctcatataattttggaatacatgttaatacatgtatactaatataactcaaacctatttttctaacttttattttaaattcaggggcacatgtgcaggttcgttatataggtaaacttgtgtcatgggggtttgttgtacagattacttcatcacccatatattaagcctagtacccattagttatttttctgatcctctccttcctcccaccttccaccttctgaagggccccagtgtgtgttgttcccctctatttgcccatataaacagcatttcttatttgacaatgcttcctatatgattttaacataccaaataagtgttatatgtctctcctggacttccaggggtttctcctttatgtccaggttagtacaaattaaaagataattttagaatttgaaatttaatttttggaaatatgtaaagtattaagggtttaaaacacttgatattgaaatttaaaaatgtttaaaactcatgatcaaaatagaatctgaagtcaatgcataataatagtcatttattttgtgaaaatgataattcaaaggtttcagaaagcaaaattttttattatttgatagggaagagatttaatacccaatcaagggacctaataaagacaacatgagggaaactctccctgcagcttaattattttacagtttactcaaaaagtaaacaaatcttttactatctcttattaatactacacaaaattcttgttctaaggagaaaaccaagttttacttttagtgtgttatcaatactaaagctaattttaataaaacattatgaccaaatctgtccaatctcaatcagctttgacctcacaaaataagatttccataaaccttttataaccttttgtaattttctattaaaaatgatcagtattttgagaaaaccctgtggcaacataggggcacagactgtggccttacatcagtgtgcttttgatattaatgctcagtttttagaaaaacatataaataatttctaattttagacaacttgaacacacacaaaatttctttcccaagattaatcttccacaaaccctctacaacttgcttaaaatgttttgccactacctaagcaaaaattctatggataaatacataggtattttcctgatcagaagacagctattttcactaaaccaacaatattaaactagtcttaaagatttactcaaatcatgtgaactaaaaggcacttgagctggttttgagacaggatagttcccttggtacctttgtgggactcacaaaggggcggctcggttaggcagcccgcagcactcaaaccccttgtgggagggttagcacgcaggtgagctggtgcaggagccggggcaagtgcctttgggtgcctgcaggaacaaacactgtacaggcccatggcagcgcctaggggttgcctacgacccctggagccccagaggatgtgtgttatggtgtggtcctttagctttgtcatccatggatggcttaagtgtttaacagctcaatggggagttagtgtgacagcctcttccccctcacctcagttcttgtctggcatccaggaggagtgaggtcacacgaacaatttggagggtggtgaatgcagaggattttatcgtgtggtggaagtagttctcagcaggaaggggagctggaagggcaatatagtgggaagataatcttcccctggagttgggccatctgtggcagaactcttctatgaaattctgctgtcaagccatccctctgaagtcaagctgcttctttctaatatccagctggttcctcttttctccttccctgccagtggagcttggagtttttatgggtacagggtggagggtggggccggccagggtagttttggaaaaggcaacatttgggtgggaaaacagggatgtgaagttttcatttagggcattggttttgggcttgagggtggagccctcgccggggaaccaccatcttctacccagtatttccctgcctcctgtctgtatgtagtttctatttttctgataaaatatttgatttaaccacttacattttctttaagacaattaattggaggttcttcatatatgttgctagtaaaatgtcacatacacatgccacatttaaacatatagacatacaggacacatagaagcaaattttgtattaatagctttataaggttctccatttgccagtttgcaaatagtttctttcctctttagactctcaagccctaaacaattattagctaggctatcctaaatttacaatcacaaaaacatgactcttaggtgaaaatttacctcccaaaggcacagaacttagatctaaacacctttatttactgagacaaagaagggcataggtaaaggcccagtcaagataagattaccagcaaaaatatcttaaacaaaagtaaggttggttttataaactttaaggcactgtttttcctgtcataaaagtttctagtagcttaggtggagcaagggagatgctcctacaaatggagatttccgttatatatgtatatttattttacaaagagtttcaaaatagccacctaaatgccagaaagtcatattttggagaccaatctagtcagaaagctggtattttcaacttagcttatgtattgattagattactaacctcagggttgagccctttaatgaatagcaaaatgaaagcatttgcagtttttggggactaatgtttacatatgtgaaaaacaggcagtgcacctagatatttaaaattgaacgatcccacttttacattgaatcccgggtcccccagaaaagagaaatgccacaagaccggggtatgcaatgtttccacaatgcacctcactgcatacattccctcaagactggtaggtgagcaatgcccatcagcccactctgtgatcagaccaccctcccacaggaggagttttatgccttgaggggaagtgtttcctccaccttcaagtgttcaaacctgtctttctatctaaacaccggaaaaaatgagtagccccgtacatttataatcattcactgtaactgatttcagctgcttcagaaaccacagtttttgccagtgacttgtcagccattgcacacacaaaattcaagttgtatctcatagtacagagtaatccctggtaccctaaaagctaaagaggtcagttactacttctaacagctcttgcaaatctttattattagactcagttatggaagtacgattgcccataatcatatttcctttttgaatgataaaaaagacccagtgagaggaattttggtcacccaagaagaatgtttagatttgtcaattgaactgagctgtgaaatctgaccaattttaaagattacaaatttttcacttaagctgtaagattacactttttcttttcagagagaaactattttttccccgaccaaaattttaaatgagataaaagattgaaaaactctttttttttttttgagacagagtctcattctgtcacccaggctacagtgcagtggcacgattttggctgactgcaacttctgcctcccaggttcaagggatcctcttgcctcagcctcccgagtagctgagattacaggcgcccaccaccatgcctaatttttgtattttaaatagaggcagggtttcaccatgttggccaggctggtccgaactcctgacctcaagtgatcctcttgcctcagcctcccaaagtgctgggatcacaggcgtgagccaccgtacatggctaaaagatgggaaaactctaagaattaattcaaaataacactagctcaaaaagaaaaagtgaaagtcacaaatctgcaatcagcagagactctagagaataacaaatggaactcctaccttacagtagagcttcatttccaaccatgttgtggcaggaatgtgtgcagtttcaaaaagtgaattggtctgaatgttcaaccaagaatggagcattcaaatctgaggagggcttacccagttgactgacctccgctgactccagtgaggtcagatgaatgaaagttatgctcatatcaggactccagctgtcagcaaagcaagggagatcactgaaagtctgtttcaggtcccacctgagtcaccaaaatgtcaaccttaaataacataagtacagagattatatgagctcaaagcttgaagatggccacccaggagcctagattcatgttgccctgaatatacagtccaattagcaatagttacaagtgggtctttaaaggaaaaaagaagagaagttgtttatcaagacttttcgttaagataacataagctattaattggttattcattgctctttgtgtcacaaatgctaggaatatgaagataatgagtgagaaagctggtcaggaacaaaaatgccttaaacaattgcccccagtcatggctactcaggggagagacagccatgactgaagccctgtacttatgtctctctgggcctgataaatgttgcatatctcacatagttgacctgctctgagctatttttcttttctcaataatatctaggaatgaaatatggctgtagctaggagattgattaaaagtggtaatgtattccagagtcattaatggtatgacttttctacacctatgcttaattttcactttatctcagattatttatttaagtttaattttctgccatttctttatgaaaattccttctagaaacattggtctggctaaaaaaatatacttagataattatgcatctatgtgagtacatagatgagtgtccctactggggataatcaggtaatccaagtgaaagaagtagtttctagatggagtataaggcaaactttatctcttacatgcttcttgaaacacacagtctttgggataatttttttactcctctgctgttgatagctttatggtgtaggcatcaagatgctggctggaagcagagtttcactccagatgattctactgaagaaaattaaggagtatttaccaaatatttacagaagcagtgttaagggaactgaggtaaaggcaaagagatgttgatgttcccagagaggagcaacagagggaaacgtttaccaccctgagagctcaaggagcaaccacaggggtgtttccagagttcattgagagccagagcctcagaggagggcctgcttggaaggactgtagacagggagagatgcaacccctgctagacagaagtgccaaagcaaggagacaaagagggaaaaccactcagatttctctctactcttgccttttgaagttctttctttcaagcttccataggcagaacccaatggaaaaccagtaaacaaaagaactaagattacacagtcgatagaagggtcacttccttggggcatagagcaggacagagaggacatttaggaaaggatgagcagaaatacaccactctccctgtataaattaagttaaataatttttcttttctcctaactattaaaaataaagaatgcaagttcagtgataaacagcacctactattttgccttaggattggcaattgatacagcttggtaggaataatggcaaagtggcttcatttaaagaacaaaactgctcttttactctgttccatggttgctgtgatgtctttttttctgacaccaaatgtgtgggtttttctgacatcaaataccttatttttgcatatcgattctctaattctctgacatcaattggatgtcctacaatttaactcagttttgacacaaactacctgatcatcatgagacttcacaggtgtaagggctcagttccacaccagctgcaaatggagtgcccaggtgtattagtccatcctcatacttctatgaagaaatacctgagactgagtaatttataaagaaaaagaggtttcatggactcacagatccacatggctggtgaggcctcacaatcatagtggaaggcaaagggggagcaaaggcttgtcttacatggcagtaggcaagagagtgtgtgcaggggaactatcctttataaaaccatcagatctcatcagacttactcactatcatgagaacagcacagaaaaaaaacccacccccatgattcgattacctgccaccaggtccctcccatggcacatgagaattgtaggagctacaattcaagatgagatttggttggggacacagcaaaaccatatcaccaagctacccacatttcttcccagcaactacaaaatgtgggagtacccacaactccccaattcaggtttagtaactcactaaaatgactctcaaagcactttatgtttatcagtttattataaaggatacaactcaaatgaaagaaatgcatatggccaagcatcagggaaggagtgtgtagcttctgtagcctctctgggctcactaccctcctggcatatatcagtgtcttcaccaaactgaaaatttcctgaaccttgttgtttagggatttttatataggtttcattaggtaaaacctctgggtttgattaattaaatcattagcccttggtgtttgagctcaatctctggcccctctccagttcttggaagtcagagagggtggggatgaaagttccaacccactaatcaagtcttagtctttctggtgaccagtccccatcctgaagctacctgagtgacctcattagcataaactcagatgtggttaaaaatagtctgttctgaataacaaaacatacccctatcactcaggaaattccaagggttttagaagctgtgtgtcagcaacctgagaaaaagactaaatatattttttattatgtcatagttgccatgcagaaagcatgggttaaactgtcccatctattaaaaggaatcacagatttcaattttcatgtgaaatctcccaagtttcaaatgttgacaaccatttcaaaatttccaaaatctctttgcagtccaaataaaacatacctgtagactgggtttggcccatggtttctagtctctcatacctgacacagaacttcggaacaggagttttcaaccctggctgcacactgaaatcacctgggtagctttgaaatctttgtgcctgggcctcatgccaaaacaattaagtcagaatctcctgggctgggccccagagattggtatttttaaaagtagttttctgataattttaatgtacagtgattttaaaagcttcttattttgcaataagtttaccttcacatagaagccataatgataatatagattttctatatattgcacacccagtttcccccattaacaacaccttaaattaccatggcacatttgtcaaaattaagaaactgacattggtatattactattaactaaactccagactctatttggattttgccaacttttttattaacattttctttctgttccaggatccaatccagttactatattgtgtttagctgtcctgtctcatcagcctgctctgatctgcgataatttcttagactttgtttgttggagtagtactggccaggtattctgaatgtctctagatctgagtttgtcagctgtttttctcatgataagacccctagttttcatgggttttgggagagaataccacagaggtgaaacacccttgacatctcatatcaggttatattccatttttgaaaacaacttcttgaagtaatagtggctgggtagagtggagctagcaggacccatcctactcttgaacagattgaagtacatcagtcagtagagaaaatcaggagggatgacatgaggccagcaatggagctgcatctcttgcaaataaatagtctcaattcaaagtcatgagacaacagttctattccaggctcatccactaactagtttttagggaagccaatcacagtcttctagtgttactttcttcatctgtacaatatagaagttgatatctgagtcttgaaattatgtgactctcaaactctggaatgtgttttcattagtcaaatattgtcatccacagtttcatttcctaagaggaatgtgttgtaatgctgagcaagataccctcaaaatttctggtttctacaaaagggcatgtaagggaggcctctctgcttcactgtttggtacttaagacacttgtatcctaagaatgtcaggtgcctggcaggaagaaaacaaattgcaaaaactgagaagaaaattcatcgcattcattcatctttgtttctggaactcactattttattccttccgttacaatggattaagaaggaaatgacataatttgtttttgaaatgtcagaagcagtgcagagtttagtactttaaaaaatagtttaatgttgaccctgtgcatacgtaaatcttaccagaaatgaggatgactggcttacaacgttagatactctaagttgccaataatttgtacagagcctgtgattgcaaaaccacaaacatttcacaatactggaaacctctaattaaccataataaatgacaggatgggtttgttttaaatacatggttaataatgcttactgctttaagaccataaactgtgtgattctctatggaggtgacagaggtaggctgcaaatggttttgcaaagtacgtttctacctctgcatgttaagtctgacccagaacattctactaatattggatcagcctctcatctgacgtaatttgcctgtgggaattgtatcggctgttaaactagctcctcttagtagctgtttgaaaaaaaaaaggaagaagaagcacaattctgtggtgtgtttcaaataactgaagccagtgtcctaggtactgagacaagaaagaatgtcaaacaggacctttaatgtgtatttatatttaaacatcagacctaacagaaaaccctgaagctttatacaatgattagagccttgtaagatcctaattaatgtattgtcaggtgaatggttggcctggcactcaagctgttctgagggacgcaaggggtttcaggtaccgcctaggaagaatagatgcagttgtagtgattcagtggcccatctgaaagggacatataaaggcagctgtgtctggtgtgctgtcttttcagactcacttgataatgctagtgtcagtttcaactgaagcgtgtgccagattccagacagcttgagctggcatttcagagaggttaattgtgaaacttgagaagaaaatgggcacattcttcctaagatggctattcaaatatagtctctttcctccccccccagagctttctgggtctcagtctcacttttgttctgcttccacgtaaaatgcatgaggaacactgagccttttccccttggcagctcctatattgccatctttgctgggactgctttgccttgttaaaatgtgccccgtgtattaaaatggaattgtcactgctgggtggtgcagcgtaacatggtttgacactaagcgccggcagctacagaaaacagacttttattgcatttattctttcagagacgggagtctctaaaggctcacagcagacattcacttagttaaatctgaatgaacccaaagtgaacaatctactctgctgtctttgtgttcatagaaacagcccccatccagcttgatatggctgtaaaacagtgttaagaaaagatgatcacacttagaatgcagaagggaggacttgaggctttcaaacagaacaaaaatattttaagtgggtggagtgggttagccacttgattttcttttttagcttcctctctattccctaaaatgtattatgtagaataaacacacacacacacacatacacacacacacccctacacacacacacacacccctagtattagtcttcatttataattccatgccattttaagacaaaggatttgatttgtaggactcttgcaagcaagctttagattcttaactgccttttatccagatgagtacccagagagagattgaacagggagggggctctgaggcataaactttgcattttgtagctctcctggaataaaaattccataaagtaacatctgtagtaattaagggcttacatttcctctcccattcatgtctctgctaggagagaaggttattttcccaaagagacaatagtggatcctgtgggaagagagaaagaacagagttagaattcttttcttcctggaaatggaaattttctacttaaaaaaaaaaaaagataaaaaaattgaaagacttacagtaaaaggttccactggaaaggaaacttgaaagagttaggaaaattgtacttagctgttcctaaatatttagaatgaggaaagattccgcttgcctttcttatccaaacatcttctgatataggggaacttgtgagtgagtagtaaacaaaatgctgtttttgtttttatttttatctattaaaattgcataaagagttttctttttatttggacatcaaattgattcattctgaagactttttttttcaaaataatacttatgtggatccattgggtcacctgatgatatacatactgagcgttaatgttaagttagtttcctacactctcttgtcatagcaggatcagctacttaaattagggtgaaatatgacaatgtagatccctttgttaaaacactgttaagaagttcaaggtggcaacagcagaactttaaaccaagtgcagggttgttctaagtgtggggctgtgtgtgaagacataggcctcattcctgtaaatttagccctgcttggcggtagagatttgtcatatccatcgatacagaaagatgcactctcatcacatgcttcataagaatgtacatctgaaaacaaaactttgtcagagaataattatagctcaaaactggaactcgttcctgatattatcttcaaacttgttaaacaagtgatacagatgccctgacttcctctctcagttaatttttaagaatttcccgggcaaaccttccactgagccacatgcttgctctctctaccacattgtaataaggacgcacgccctccaagctgcccagctcagccccctgccctaattacttcgccaaaagcctctcctagattccgtgcctcttctcagcatttctctcacttctgggattcctctcacatttgaattcttatagctgtaataaatatgtataacttacttgacatttgttagcatattttttttgtatcttgtttcctttgccatgtaatatggtcctataatatggccatgtaatatggtcctgaaatggacataaaatttagatgtaggaaagttttacaacttgagttgatgggcaccattccaagaaagctcatattaataacagcagaaaatccaaaattaaactttgccttttgaacacattttacacatttcacacatttcatacacattctttcatgtgtgtgtatgctgtttcttaaatgtatttttgcctctagtatactctttggaagacttaattttcttttatcagaattaatccttaattattatcctccccatccaattttataaaataaaaaaggccagatattatccattatttggaaactgctacaaatattactgtacttaagatatggtaacattgccaaaatttaaattatgttggtatggctcaaaatgttcatgctttaggttgtatgtgagatgccaaaatttggcacaagaataccagtttaggaatattgataagatagtatgaaaaaataggatattgtccaaaattcaatattgagaaagcatagaacctaaggtttgtgtatctataccttccttcaacatgtaggaccccacctaactctttggatgtcttacataaagtggattttcaataaaaatgtcataatgctgacgactacattactataccaatcagtcctttaggctgcaagccatgcaaataaaacacatcttgtcaacctcttttgtgaaatccatcagcagtatagcttagtagctatagcacaggctttactgttgcacagatgtcagttcaaatactgacttttcctcttattggaaaggtagtttatctgtttaagcctcagtgaccttattgatatgaatgacaataaaaagacttacccatcaggtttgctaattcatcattcaacagacatttgttgaacactttcaattgccaaatattgctgggtgaattaagataatgccgcagggttacctctgaacgagtgctcagaatagagccctccacatagacacctttcaaagagtgaataatactttctaagcattaatgagtttgtgatgttctcttatcaatctggtcatcatgttcatgaaaaaagttggcaattagggtacaattctcaaatcaagtatttctatggctttcttgttttcctttacttcttaagtttctttttcttgacaaccatatatgacctctggtttacctttttttcccagaatggagtctactgaaaaatgtgaagtggtaattcaacattttaatggaaaatatctgaaaacaccaccaggcatcccaggtaagaaattcactaataagtgactgaatgatgccgaggcttaaattgctcttattagaataagtacattgtaaagcccttgttgatcactgcagagttggggggtttgcttttcttaatgtgtattttcaaataatactgtgtagcaactcatctttctcaaaagctttttggtaattcttcttttgctttttgaatctctgctgctaactttctaaagtggattagaagaaaaccatagcaaagaatagttaaagaatgatgtgctggaagtgatagaattttatgactcagcattaatattaaaattccaatttccaagttacaaaatatccaaacaatgatattcacaatgaatcccacaaattgatgccagccctgaaacatttcttaccagtccatgacaagaaaagcacagaaactgagagaaagcatttagaaactagtatagcgatttgacaatgtcatgaaatctcagtgcataattttcttttacaaaaatatcagttactgacaaattggaaattttagaaaatactgtctatttatcagagctagtttgagaagccccaatctggactatcccagggcatttcacacttcccaaggcaaaattcctaaggttttatacacattataaagtgttctaattttatgctattaagaattgcattaaacatgaaataattggatttattatgtgtatcagagctacaaatgccagaacttgaggcagtagtgtatgtggaaggttttaatattaactaagtaaagttttaaatataattccaatataaaaaattaacaatggaatgaagtattaaactaagaaaaattacgtaaagattcatctgaataaggcagtttggtttatttgttggtcttttatatacagttattctcagaggagactaaggcgacttcttccatcttacaatatgtgactttaatctttttaagcttgatttcaataccgtttgctgtataatgcatctactatttaaaacccatcagagagttcagaggttgagcattttagttccttaaaatatattgagtttatagataagaggaagcatatacaaaaagagaaatatttttgtggagggttttgtaatgacttgctttttttaaggggggatgtcaagaatgcagaaagacccttcagacagacacttgcataatctgaaaacctaaagtagctgattgctggctaatcagtgagtcaacatacagtgaagactgtgccttgatttggttagcttccatgtgtaacgttcccttgggaactgactgcattatgatccaattggagacatatggtgttgttaagaaaagagttagcagttttcatctcagcatgttagctgcccttgcattttagcagaaatactttttttttttttgtataaacagacattttaagacactttactcaaatccgtcatcgagtaaaggagttgcattgtttgtggactttcctcttgtttgtcctatttcatccaacggatacctatctatatagaagttgttcaaactaggtgtaaattatataattatataaaaataaaaatgagcacactgtgtagaaattatgaatgattcaagttttagcacaagtctcaattttttgatttgttcaaaatattggtatgtcaaaaagacgtattgaaagccttcttgccctgattgatttgaaagtattttatttggttttccccaatgaacatattgctgactaatacaatttaatgctgaagacaaagaaagtcactacaaatccccaaatgtctgggcatccttccagaatatgcaggctatgatattaacctatctaatatcatagctacacccaatggaaacattgtgaatagcaggaacttggttatgagttttctcactcatttttatctcccgggaacaagaaagacaaaataattatgttcagttataaaactcttaggagagacaactgtatgcttctgagatttccactcatcataatagaactaaatacagaatattgatcatcatcagtgcttgaatctgcttatttataaattactttgaaagttagagttgaataaaggcttcaaatgctaagtaaagacatttaatctttgatacttaaattaggtgtggaagaaaagaggatataatacaagatatgggtattttgcaaggtaaagtagtaatttgcccttgttgagtataattactaagtcataacaggtataattacaatttgggtatatgctgtctgcctttattggtcctcattacttattacctggaaatagctgaaatcttactttcagaaatgtatgtcttaaccaatatttgattccatatttaagacagggagtaggatatcactatgagctatggcatcagatatttatactttttttaagtggccaatttccgaatctttttcattactttagagagtgtgtctttgcttgtgaatatgctcaactataattggtgtgacccactgaaaactaaaatacaatttttaaaatttgaaaaatctcagtgttctgccttatcaagatttgacatatttgaattcagaagtttgtggttttatagaactgcacattgattgtttaaatacattgctttaaggtcatgtagatgagggactcacagggatccaataatgatgacctgagatcctcgggtcttaagaaagctgtggaaagattgaatatgatgtcaatcatcttcttctcatactagggccctattgtattagtttgttttcatgctgctgataaagacacatccaagactgggcaatttacgaaagaaagagatttattggacttacagttccacgtggctgaggaggcctcacaatcatggtggaaggtgaaaggcatgtctcatatgacggcagacaagagaagagagcttgtgcaggcaaacttcccattttaaaatgatcagatctcatgagacttattcacaatcacaagaacagcaccggaaagacctgcacccatgattcaattatctcccactgggtccctcccacaacacatgggaattcaagatgagatttgggtggggacacagccaaactatgttgcctacatttaatataactctaagcaagtactgagcaattggtgccatattcatacggtctacgtctctgtttaggcacagtgtggggaaaatgtgcctgtgttattgggcaaatataatggcatttggtttctgtcactgttgacaatgacaattattcttaaaggagatgcaaagctaattattttcctgagatgatcatctagtttccaagtcccctactatgtcatttctaaaaaagaacaaggaaaaaatctatttcaacctaaaatgttgacattgctctgaatttcaaattctaaaaatttcatagttaaggaaatttgcaaggacatgtaacactgaccacatttatgttgctgccccatttcgatttgagccattgttggaataatttgctaattaaatatgattcatgttggtattgggttctaattcctgacagataagtgagttggaagagaactttacagatatctttttggaacacgctttatttctctgggctcctcctatttattcataaaagatctttttttaaatgaatacatcatggatgattgatgtcttttagcatatcccagaactacctctgttcattttagattataatgttatccccagattttggttccctggatcaatgaagctaaatatacatgccaaaaatcaaattattgagtactagtatacaggaagttaacaaagatcagtcacatgtattgctgctagcagatgagaaggagagaccaaaagcatgtgttaaatagtgtcaatcgtttgagtgttgtagccatcagcagaaagagatcattcagcgttttctcccttacctagagggaaaagaaaatacagcattccataaatgttgcatgtcctacatatcgatcttgatgtttttctggacaaaatgaaggatcattagttgcttgcctgcctaaccccagacatttctttgtcccgtaatgaattacacagcaatgttgtatagccccaaagtgttccattttcaaatctctggcaaaagcaaagggttagttcccagacacttcagggatctgtggggcatggacttgaaaggctcactttcaaagagcccccagagcagaatgatacaccatgcggaaaaggttttcacatgtagggacatgtattgatgaacagaacatgcaggccggtttgtaaaaaaataaatcatgttttgctcccaaactagacatttgttttttcctgtaagcacgtgctcctatcagtggagcaatcttttcagaataaaatggaataactaacttctggtatgctttccttactctttacataattgtttctaatcttaattgaactctaagaagtaaggaaaatttgagagaaagcctaccacattatgggatctttaaaaatttaacaactcttgtgactgacagaactttgcacaagtagttatgtatcagaggaataatatttttcgaataaataaagcatggggctttttgatgctttgacatagtaattttagtgttgtgtgttgatgtaaataacaatgtgtatgactatgtatgtatatgaatactttatgggagcaagcaaggaaaaatatttacaaaatgattttttaaatgatgaacacaaatgtttgtataaacttaacattcctgccagagtaaaatatcgacaacatatttaaatgcaatttatcttaaatttatcttatgtgattcaaaaatcagaatatttaagcaatagatttacaaatttttatcagtgggaaatgttgcagagctttgcgatctgtgtttgctcaatagtaacagtctattaagtccacaaatacaactatagctgagaagaggtaacaaataaaaaatgctatggtatatagttgggcaaaaaatatgtcttgattgttctgctcaggtggcgcattgcttctctccaaatgttttatctttgtgaaactaaagcatcacttgtataacatgctttgtgaacaatgtaatccccaattgggtatcattttagatttttcactggaaaaatttttgtattcttaatgttggtgatgtcttcagattatttctatgcatcaaacatactttgttgcttcatgatgaagaaaacacctttaaaatattattagtgaacttcacagagcagctggacaacatcatggtcaatggagtctgagaatctatgtgagtcctatggaatttgatatggtcaatcagttttcaacctttctatggagccacatctgacattgtgaaggtaaaaaagctgtgtgctggtaactgattagatatataagacagagagaagaggtgattaaatttctaaatctttgtatgagaagctaaatagagaaggaaaaagtttcatcttcaaaagaatagaaataattgaaatgagttttttgacagggctacatctactctacccacctgtgatttcggctgcatatgagatgcaacctagaagcatcttaccttatgtatccacctagtttcttcacttttccacctcaggacaaaatttataaaagcttgctcaatgagacagacaaacgtcttctacaaactttgggggagttatcaccccctgggatagcctccaatcaacagggtataggagccagaagataacattgggtctctcatcctttggaaggataattctgagtcacattctacagggttccttgagaggttatctacagtggtcacaagctcaatgaggtttcctttattagcattttcccccttccctgtcttttccttttctatcatctcagcttcctgacatcagctcccaattaaactaccttgtcccttgctctgattttggggaaagtcaaattcaagttgggggttctagaaattgtgttagggaactactttttgatttaaaacctttggctataaaggaaggtattcacttcactaaaatagtaaagtgaatttcatggcccaaatgtactgtttttatgactttttgtttttttaaagagcagagattataaatcccatagtagggttaatgaaggtgaacattagaggtagtagtcaggtagcaagccagggttgaaatttagcaagagaggtatggaaaaagacaagaaggacaagaaaaagacaagaacggtggcatggccaacttgagaacaactgaggacacaaagagttagatggctgataaaaatggaaaagatttagggcagccataaagccagtaaagtgaaggtgaggtgcaggcacagaaaattatcaaacagaaggtattttttgaggttttggtcttggataaatgtagaggtggacatcaaatatgacatccaatgtgtgaatgcctacagctggctgaagtcaagtgaaaaagatctttagtcgagcagctggaggcttacgattagaaggttggaaggtctttcactattaccttaaattttattacttaatgtcatacttgccttgattgcctcttgaagttctaatcttggtaggagcaggttaagtgaatagtgacaaagagggttgttttttttctttatttatctgattttgaattttccaaaccagagtatttttcattttttgtagctcaagggctgtatgcttagctctgtacattctcactaaatactctttggagttgtatagtttcatgaattaaatgacaatcatacatatatttgcttttaatgaactttctgaaggtatggggaggatgcacagctctgggtaaacaagcatgcaaccaatttgggggaaaacattgaggaaaatcttaaaatatttttaaatgttttaattaaaaatatttccatatctaaatagagaaagaaagcaagagtgagagagagaaaaatgtttgtaagaataagaaacttatttgagaaaaatttcagttacattttggaaagcctaatttttctaagactgcttttcaaggtgtatactgaagacctaattgtagtttctttaaagaactcattcttgaacagtgcaatgatgaattctgttttctggcatggcaaatggtcttgcctaattatactggaataatgtctctaaactttttgccactggagctagttaagcacaatgattatgcagcacttttgctccccctgccacgtcttcacatagaaagataaatgtcttgagaaaaaacaaaaaagagaatttccagtctctattatatcccttttggcataatattgttgctcatttctgcctagagaaagtaccacattaacatattatttctcttataatattatataacatactctgtaatttttaatcaataagatatggttaatgctttcttgaccatattttttctatagttacatatgaagcaccaataagtagcagcataatgtgtctggagtttccatttggttccagaatttgattgattaaagtagttgtaatttcatgggatagagaaaagggatgaggaggttttctatacatctccaaaatcatgaaccaccttcataacttatttctaaaatactgactccattcaggtctgcacgaatttctggactgaaaatttcacataaaaacttacaaaataaataataaaacactaattttgcttctaagaccatgttgggctttgccttctgtcagcatcactaatgagtagctaaaccatttagtgtctgtccggatgagtcctattaggaagctgagggttgagtggcttaagaccaattaacacacaagccagggaaaccaaattgaataattaagttcttagtgcatttcagaatctagaatctcatttaataggattgatttaagaacacattctaaccaatttttgtatgaatggatagtattctgaattaaatacttgcaactctctccttgtaaccattaaaaagcctgctatacatacacctcatcatttatgatctaatttttagaatgatctaatttttagaatgaaaagtctgcaaaacataagaaaatattttaagagaaatgtgaatgaaaacagtaggcaagctctgaactagccattatgtgtttatcttactagctgcttcctcttatttcttacgtctttcagccctgaatgatgaatcaattatttgagtaatattttagttatttttcagtacaaaaaataaatctttcataggaaattggcatgcttatgaaggttcatttgtcccattagactgtaggtttttctgagaaagaactttgatgtttatctctcccatcttccttaaacaattcaaaccctttgaaaacaaggactgcaccttactgtttcttccaaacatctagcccaatgcctggcacagaacaataccaatatcatttgttaaataaataagcaaatacctagttgtggtagacagaataatggtcctctaaagatctgtaaatcctaatccccagaacctgtaaatatgttaggttacatgaaaaagagtaattaaggttacagcaaaaattaaggttgcagctggaattaaggttgctaataaactgaccttaaaataggaaaattattgtgttagtttgttctcgcattgatataaagaactacctgaggctgggtaatttataaaaaagagaagtttagttggctcctggttccacagggtgtataggaagtgtggctggagaagactcaggaaacttacatcagggcggaatgtaaaggggaagcaggcatgacctacatggctggtgcaggaggaagagagtgaaggaggaggtgctacacactttttgacaaccagatcttgtgagaactcattatcacgagaatagcagggaggaaatctgcccccatgatccagtcacctcccactaggcccctcctccaacactgaggattacaatttgacatgagatttgggtggagacacaaatccaatccattcccattaccatggtttatctgggtgggcccagtgtaattagaagcatcctcaaaagtggaggagaacggtagaagaggaggtcagagtgatgcagtgtgcaaagaattaacccaacattgccggccttgaagacaggaggcagcctttggaagctgaaaaaggcaaagacttggatttcccccctagagcctccagaaataaacttagccttgctgacaccttgattttagcccagtgagatctgtgttagacttctgacctatacaactgtgagataataagtttatgttgttttatgcctctaagtcttagataattttttctagcaacaacggaaagctaatatactagtatagaacttgtattcaccgactatcatccagactattcctatattacattattaaatagtctctgaaaaactctcatagtttctcctgatttttaccttctttgtgagtttttattgaagaaaaatcatattcagtgatgcttgttaaagcacagtaagagtttttttcagcaccatcacaatagttacaggcaccactgcaatggagtctcttacagtggagatgagagattgggctcacctccgaatgcagcatagacaagtggaaatttacagccgaggagcagcataggaggtcggtggttggaaaattaccaagaggaagcatcaggggtaggattctttctgaagacaggccagggtaatcagacgtcacctagaagaaagttcagtaagctgactaaagtaaggccaaataaagaatcatctcagaatcattagagttgcttgtgtgttaaatagaaaaaaaaatcttgttagttattttaacttcacagtttctttataactgctcataagcacatattactatagaagactgttcagcgtctgaaacaagaagctttgggaagtccttatatcttagagcacattgttttttatttaaagaaataaaatatgaacttaaactatctgacaccataagtatgccaggaaaataatcctaattgctaatctaaattcatgtaaatgtgtatctcttgggtctcaaccttaatacttgctttcaataattcctattcttgaaaagttattagggcctagaaaaacagaatggagctcctcgaggttataatcaactttaagttttagatgattatatctcaagcatagaccatgctcacacccctactcattgtcccatgaaacggggagtgtcctaaagctctaaatgccctaaatctttcatctgaaagcttagttttgagacacacattaaaaatttagaggtggtgaatatgcatacttattatatatttagaaagatagataatgcttatgataaaataattttaaaaattaagtgcattttcaaaaatgtgtttcttagccaaagttattatacattccatattattcctatagcaagattgggaggctgtacatatgaaaacataaccattttctattgaactgagtgtgagacacattttggaccagaggtttatatcaaacagttgcactagttgacccgctgagatgccctaaagaaaaagaactcaagaatttaagttgatttccagctgtttgttattagagcaaatgttagtgctcccggagtgtttgcccgtggccatcaaccagcacctgcatctctttcattaggtagactgcccttaggctgcagcagcctgttttgcctgtgagcagtgagagtcagaagtacttgggaatttacatccccattcggggccatccataaacagtgattgacagctgttggagtatcaatatcccagttcttctgcttctgatgagaataccctgtgtatgatgtatactatctctatagctttcctgaaggattcaaacagttacagtttgtggggctgtctaacaccacatccttgcttgactccttcacttcctggtcccaattcccaagtcccttactggctttccctgaaaatacttcctaagaattcacgttcacaagcaaccttgtttcaaagtctgtttctggtgaacccaaactaaggtattatattcatacagacactaaatttgttattctatgatctattattttcattaatgttttgagttttacagtctcatctgtaaaatgtactcaagttaactgaatccctcaggatagattgagggaggtttcaaaagtgaatataaaattcctcaaattccctcacttcactggaaatagacatactagacactctaagtaaggcagcacttgtttataggtagctggcttctttataaaagggatacaccatttaaatgttgataaagtgtgtgtaacagcagataaaaccgtgatcaggtctcctgtgagtgagcaatcaccggccgattatcactgagctaatcacaatatgtcttaataaaggtccattcaaaagaatgaaaattgtatccatatataagacaaaggggttttaaaataaaaaaatcttagcaaagtgtacaaaagcactgaagaaaaatattgaaactaatatgtttttacacataatcattttaagatggtatagtgagcttgatacaaagggtgttacagagaccgctggaggttcctaagatcctttctggtggtctacaaggtcaaaaatatttttatcataatacgaattcattatttgcctttttcactctgattctctcatgaatgtaaagtggagttttccaggggctacatgatttgagatgtggcaaaagctggaatatggaagcaaatgttagaatccagctgtcttttattaagccagaaattacaaagccactcttctcttttttattctgtttttgaaaatagtgtttttaaataaaagtgtatgatttatgtcaatatgtaacaggactattattattttaaaataaacatctaaatttttttattttatgttttaatggtgtcaataaatataacgtgtctaaacaagttttgggggatcttcaataatttttcagagtgtaaagaggccctgagacaaaaacaaaaaacaaacatagaaaacagccgatatagagtcaaattcaagcccttcatcttagaaaagatgaagaaagataaccaagataaaggcgaagtttaaaatacgctctcactttttttggtcttattttgagaacctacgtatgttctaggaagctagttttaatggagcaattaaaaaataaatttcaattaaatgagttctaccagtttttttttatttttttattttttatttattttttttttttggtaaacaagcattcaggcgcctaatctatagtgagtgttttgttttatttttttaaatgcagaggcaatggttagtcttctgaacatttgcattctcattttcattagcaaatagcatattgtttgacagaatatgtgaatgttgtattaagacaatgtatttaagcagcgtgtgtggcatgctgcaattgtgggaatggaattatgtgaatttgtgagtagcatgcgaatgagtctgcccacaatttagggagagtttaagactaatatctaagagccagaaagctaaccacagatgccacatgggagctatgttatcatcataagaactattctgtgttgcttcttttagtcgctgctaatttcagataatgttcatcttacatctggacttcaccagtgtgagtgctattcaccatgtgggacatatcttaagtacgtacgaccttccaggtttgctagttgtagtacatgataataataaaaatgataataatatatttaaacactagcatgcaactaattgaacactgtatattattagtgttcacataaaatcttaaaaaaatttcagaaatagtaaagtctcctattgtagagtcacataatcatgatttcattaagcttattgcatctttacctaatttgaatgatctctaaggaaagtaattctctagtcatcttttgtaactagttgtaattttatctgaatgaatccatgtaatagataaaagaatttaagataaaattctcatataatttatttttaaaggacgcaactcaatatttgcttacatcatttaacagccccttcatttcttgcatcccaaagacaagcattttacatctttgctacacctatatgatgttaaagaaaagagcgccatttgtccagcttatgatatgctttctatgagatcctcacggccaggatcccctttgccctttatgaatttaatttctggaagaacatatgctacagagaataccacctttgcctttggaatcagatggactttggtttgacttatgctgctgtctcttttttacgttttaacttgaacaagttatttagcatcttgccaggttcctcatagaacctaattgttccgcacccattaactcgtcatttaacattaggtatatctcctaatgctatccctccaacatggtacatgtatacatatgtaacaagcctgcatgttgtgtacatgtaccctaaaacttaaagtatagtaaaaaaaacctaattgtcccatttgatgttaacaatatctcctttacaagtgtttctagaattaactgagagattttctatagccccacaaagaattctggcaagaaatggtagatagtattagtagcattattagtggcatctgttagcctcatgagaattatttcatcaacatccaccttctaggctagaagtataatttaatagttgacgtctctgaatgacatcattgatgagcattatctggtacatggggtatataaggtacacatcctttgcaactaggtaaggactacccttccattttgagccttatgtacagctcattctagaatggtatccattaaattatacatgtccatgttagaggttgacagttttctgagataattggaaagagtatagcatcaaagaaatatttaccttgaatttgctctggtaattctcagattcataaacagtggtcccatttattatgggaccatggcagctgtgttaatgtagtcatacacaaatttgtatgatcccaaacttcttgtaaagttttcccagcatatcattgcacctctagttcccagggcctgcattcccctcattccactcttatttcccaaagaaattctgttcaactacaatacttttcatgcagattttcctgatttccaacttccctttccttaactctcactgtacggcattaaatgcttttctcctatactgggtgtctatttgtgacatgtagcctcatttaacaactgttgtatgcttatcttatcccactggatggcagaattatgcctttgttattcttttatctcctccaatacctaccatttgaacatacgatgtttgatatagacacactaaattgaatttaaaatagtcgagcatattattctagtgtgatttcctaatattgccttaattctctcttaatgcgttttattagtaaatgcttataaagtgaatgcagaaaccatcaactatgatgattccacatagaaatatatgacataatactttttttggtacattttaaaacacttaaacctcaaaaaccttctttcaaatggaagacaatgtttaaaagcacaagaacccttttcatttttataaagattaaattatctttccattctgcttcctgctttctattgctactttctccagattaatttttttaaagagtattgacctatggacattaaacacaaaaggaatataaaataaatgcgttggaataccaaacatcctgttggttgttacaattctacaacaacaattagatttttttttctaattaaaatcatttgaaatcacagtttttgtcttctcagaggtttctcttttcccaaagtttccttcaggtcctgtccttgtagtacattggggttgtagtggcctgtgccaccaggagaatggattcattaacctttacattgatttgaagtgtcgttcaaataaatacttatactctttttctctgatggcttagtgaagtcctttatcaatagcactgatatctccccttgacctttgcctcctgttcattcagaaaatttccatcaggctgttttatttacatttgcaatctcttgctacctcagttaagtttggcacagaaatgtattagtcctggatccaacagaattattttacactctatattcttttggcttctgcagagaagaaaatttctttctttgaatttcattttttaatttcagggtttaaacatttcctgctttctgcatatgtgtctttttgtattttgtctgcctgtttctcttgttctcttgtgactctctgtatatgattatttcaatttcacttcttcacaccaatatctactaaaagatatagttagagccaggaaatgtttctgatcccctgttcccaatcttatcaataaacttttttttttttttgtgcaaggggattggggaattactatgtgccaaatgttgtatttagtattttacagatttttaaatttatttctcaaacacccttagggaaaaagaaactgttccatcttgcagatgaggaggctgcattttatattatgtgtataaattgctttgatgcatacatactagtaatgacagtagtaaatgggctgattgaccccaggatttaattctgtcaccttattagatatgtgaccatgagcagttacttaacccctttgttcctcaatttcccctttggtaaaatgggaataactatagtctcttctgtactagtgttgcaagattggctatggattaaatacattaaactacatagagcaattggaatgtttctggtaaatactaagtgttacttaggtgttaacattgtactgctatgtcataggtcttttctttgatggagaggggatacactataggagaaaatatcagcaagaaattgagtgtcacttccctccattaccaaacttggaggaccaaccttcttccctacatgatacatagaatgaatattaatatcctgtattgggttaaatacatcatttctttagtctggtcaaagattcctccttgagattcagtttcatacttcaacactcattctaattttcagaatggaaatattgggccatccctttgacccaagccatgaacttggttttaacactgatttttaataagtggttcttttgttttaaaggaaaggtagcctatttatagaaactccctttagagaaacaatctttctttgaaaactaagctgtaaaatgatgttcttttgtatgtgtgtgtgtgtatatatatgtaaacatatatatatacatacatgtatgtatataaagcataagagctatgtctagaagaaaaggcacactattaaaaagctccaattagaggaatgtcagacccatattttctccatctgtatagtatcctttctttgaatgggccaaagaagccatggacactgagtgagatctgataatgctttttattccttgaatttctgagatgctgaagagaaagtgtcttgctatcagtattgtttctagggttgaaaagtacctcttaaaaaaacaattaccacaggtatttaattcaaaagacctgaacagagttccttctgtggttacaaggaagctgcaaattttgaagtcatataaaaaagtcacatctactgggataaaaataatctcagcaatcctagattaagatgaaatatatatatatatatataaacaaccccaaattttaataacatagtagaagatacaataggttactgatcgaaggcacaaaaagattgtatactttagaccctagcttttcttatgatactttgatgtcctttacacttgtagacatttgagtaagcttttttttttaattcaataaacaaatatctttgaataactggtagacatagaaatacattttcagtgtaagggttaagcacataacggaataattataataaaggaagtaataatgggggtaaaaaggagggattgataaaccctgcatggaggaaaggaatcaaggaatattctggagaagcatccatttttactgaaattcaaagataaagatgaaaggtatttccaagcagaaataggttgatgctttttgaaacatattgatatagttcaagtttaatcctatatgcttgactttaaattgatgagaactagtttttgctgaaaataaacaggatgagggaaccagatatgcccctgagcgctttgaattgattataactagatggagctggtttggtctagttaggtttgatttgaaactgcttgagttaagttttattcagtcagataacaaaaaaaaaaaatttgagtgaatcttatggtttgactacatgctttctatattgagaatattaaacatttgtccattgcatttgtcattcatgctttcccttgattgctctttaacttttacttctatttcttaaaaataatagtttactttttatgtgaaataaacttctccaatgtgtcttttaaaaaaatcaccttaaatgtaagagatttcattaatattcatttctgtatcttttgctttttctctaaatttaactctttagtatatttggtatcaaataactatctaaattgaatattttcccaaaaaccagtatcctatctgcacttaaaaattaatctattcttttcacattctttgatatcaccttttcctataatacatgcttataccacttacttacctgtaatatgtgtgcttgctttgtgcaagaatttacaaatccttataatacatcttatctcacagaacaagtccctgctctaaatttttcttccagtttgattttttattgtttagctgttcttgctgttttcattatccagatctacttcaaaattattttgtcactttttttccaaaatataaagatatattcttaagatactatgttaaaatatagaacagttcttgttttattttattttattttattatactttaagttttagggtacatgtgcacaatgtgcaggtttgttacatatgtatacatgtgccatgttagtgtgctgcacccattaactcgtcatttagcattaggtatgtctcctaatgctatccctcccccctcccccgagaatagttcttaaaatctccccttttcttccccattgtgttcttataatctccctttcgcttccccattgtggtcaagccctccctcccacccttaatcattggaaaccatttctttgttttctatccttgtagttttctcttttccagaatgtttatgtaaatgaaatcaaacaatgtatagccttctaagtctgccttccttcacttagcataaggtatttacaattcacccacatggttatatgtatcattagtttgttccattttattgctcagcagtatttcattaaatggttttataccgcattttattctccagctgaatattttgattgctattagtttttggaaattgaatatgataaaatgcccacttttagtgctaaatcaatgttttataaaaattttggtattattaatcagggttagctcctgaatattatgaaatacctgagaaactcattgtctaatccttgattgcttgctaatgctacctcttatataactaaattttaaaagttgaaattggatcactgctgcaggctccctgagacaccaaaaaaccgtgagtctgcttgctttctcagtggggaggctagtggtctagggcaagttatcagccctggtcactggctgcctggaaatagactcagtgctgttgtgggggcacagtgggagtgagactggcctttagtaccgtgggctgtgtgggagagggttgaggcctgtgactaccggctttcccccacttccctggtgacctgtatggctcagcataggcagccacaatccccccgggaatataactccataagattgggagccatatcctcatcccccacagcagctgcagctagtctcacccaaggaaagactgaactcagacatgcttatccctgccccccacctggtggtctttctctacccaccctcggagtcgaagacaaaggtcataatctcttgggatctctatggccctgcacactgcctgagaagcctgaatacttaaccaggtgtccctagggcaagtttgtatccttataggaccatagctgacgcgctcttgaaagctccacctcctacctggaggccaaccaacacaaaaccagtgcactaaacaaaaacacaagcaaggaccctcacagagtccacttcactcccctgctacctccaccaaagcaggtgctggtatccagagctacaagacctgaagatggatcatatcacaagactctttgcagacactccccagtactagctcagagcctgggagctccgctgggtggctagatccaggagagcaataacaatcactacatttggctctcaggaagccccattcctaggggtaggaggagaacaccacatcaagggagcatcccgtgggacaaaagaatctgaacaacagccattgaatcccagatcttacctcttacatagtctacccaaatgagaagcaaccagaaaaacaattttggtaatatgacaaaacaagcttctttaacacccccaaaagatcatgtcagttcaccagcaatgaatccaaaacaagacaaaatctctgaattgccaaaaaaagaattcagaaggttgattattaagctaatcaaggaggcaccagagaaaggtgaagtccaacttaaagaaatcaaaaacacgttacaggatatgaaagaaaattcttcagtgacacagacagcataaataaaaaccaataacaaattctggaaatcaaggacacacttagagaaatgcaaaatgcactagaaagtctcagcaatagaatcaaccaagtagaagaaagaaattcagagcttgaagactgggctttcgaattaacccaatccatcaaagacaaagaaaaaagaatttaaaaaaaagaacaaagcctttcagaagtttgggactatgttaaatgagaatatgttaaatgtccaaacctaagaataattggcgttcctgaggaagaagagaaacctaaaagttttgaaaacacatttgagggaataatccaggaaaactttctggacttgctagagatctagaccccccaaatgcaagaaactcaaagaacacctggaaaattaatcacaaaaagatcatcacctaggcacattgtcatcaggttatctaaagtcaagacaaaggaaagaatcttaagagctgagaggcaaaaacatcaggtaacctataaaggaaaacctatcagattaacagcagatttctcagcagaaatcctacccgctagaagggattggggtcctatttttagcatccttaaacaaaacaattatcagccaagaattttgtatccagcaaaattaagctttgtaaatgaaagatacagtcttttccagacaaacaaatgctgagagaatttgctactaccaagccagcactacaataactgttaaagggagctctaaatcttgaaataaacccctcaaaaatacaccaaaatagaacctccataaagcataaacctcacaggacctatataacaataacacaattaaaaaaaagtatttagtcaacaaatagtaagatgaataggatagtacctcacatcccaatactaacattgaatgtaagtggcctaaatggtccacttaaaagatacagaatggcagaatggataaagattcaccagccaagtttctactgtcttcaggagactcatctaacatataaggcctcacataaacttaaggtaaagggatggaaaattatgttccatgcaaatggacaccaaaagtgagcaggagtagctatgcttacatcagatgaaacaaactttaaagcagcagcagttaaaaaagacaaagaaggacattatataatgacagaaggactagtccaacaggaaaatatcacaattttaaatgtatatgtacctaacactaaagctcccaaatttataaaacgattactactagatctaagacatgagatagaaggcaacacaataatagtggggactttaatactccactgacagcactagacaggtcatcaagacagaaagtcaacaaagaaacaatggacttaaactataccctacaacacatggatttaacagatattttcagaacattctaccgaacaactgcagaatatacattctattcatcagcacatggagcattctccaagatagaccacaaagcaagtctcaatacatttaagaaaattgaaattatatcaagtattctctcagaccacagtggaataaagttggaaatcaactacaaaaggaacgctcaaaaccatgcaattacatggatattaaatcacctgctcctgaatgatcacggggtcaacaatgaaatcaagaggaaaatttaaaaattctttgaactgaacaataatagtaacacaacctatcaaaacctctgggatacactaaaagtggtgctaagaggaaagttcatagcattaaatgcctacatcaaaaagtctgaaggagcacaaatagacaatctaaggtcacaccttacagaactggagaaacaataacgattcaaacccacgcccaacagaagaaaatacgtaacaaagatcagagcagaactaaatgaatttgaaacaaaaaatataaaaagataaataaaacaaaaagctcattttttgaaacgataaataaaattgatagaccgttagcaaaattaaccaagaaaagaagagagcaaatccaaataacctcattaagaaacaaaatgggagatattacaactgataccaaagaaatacaaaagattattcaaggctacaggaacacctttacatgcataaactggaaaacctagaggagatggatacatttctgaaaatatacaaccctcctagattaaaccaggaagatatagaatctctgaacaagcagtgagattgaaatggtaattttaaaattgccaccaaaaaaagaccaggaccacatggattcacagctgaattttatcagacattcaaggaagaattggtgccagtcctattgacactattccaaaagataaagaggggatcttccctaaatcaatctataaagccagtatcaccctaataccaaaaccagggaagaacatagcaaaaaaagaaaactacagaccagtattcttgatgaacataaatgcaaaaatcctcaacaaaatactagtgaactgaatccaacagcttatcaaaaagataatccaccattatcaagtgggtttcataccagggatgtaaggatggtttaacgtatgcaatctaaaaattcaatgcaattcttatcttaataccatattattctttacagaactagaaaaaacaatcctaaaattcatatggaacaaaacaagagcccactagccaaagcaagactaagcaaaaagaacaaatctggaggcatcacattacgtgacttcatactgtactataaacatagtataacataacatagtatcatataaacagaattaaaagcaaaaatcacatgatcatctcaatagatgcagaaaaagcatttgacaaaatccagcatttctttatgattaaaccctcagcaaaattgtcatagagggacataccttaacataataaaagccgtctatgacaaacccacagccaacattatactgaacagagaaaagttgaaaggattcccctgagaactggaacaagagaaggactcccagtttcaccacttctgttgaacatagtactggaagtcttagccagaacaatcaaacaagagaaagaaataaaggccatcaaaatagataaataggaagtcaaactgtcactgtttgctgaagatatgatcgtatacctagaaaaccctaaagactcacccaaagagctgctagaactgataaaataattcagcaaaatttcagcatacaaaattaatgtacacaaatctgtagctctgctatacatcaacagtgagaagctgaaaatcaaatgaagaactcaacccctttcacaatagctgcaaaaaaaaaaaaaaaacttagaaatgtacctaagaacatgaaacacttctacaaggaaagctacaaaacactgctgaaagaaatcatagacaacacaaacaaatggaaatacatcccatgctcgtggatgggtagaatcagtgttgtgaaaatgaccatactgccaaaggccatgtaaaaattcagtgcaattcccatcttaataccaccattattcttcacagaaccagaaaaaaaataaaaaaatcctaaaattcatatggaaccaaaacagagcccattagctaaagcaagactaaacaaaaagaacaaatctggaggcatcacattaggtgacttcaaactatactacaaggccatagtcacaaaaacagcatggtactgggataaaaataggcgcatagaccaatggaacagaatggagaacccagaaataagccaaatacttacaaccaactgatcttcaacaaagcaatgaaaacataaaatggggaaaggccaccctattcacaaatggtgctggcataattggcaagccacatgtagaagaatgaaactggatcctcatctcttccttaatcaaaaatcaactcgagatggatcaaagacttagatataagagctgaaaccataaagattctagaagataacatcagaaaaacctttctagacattggcttaggcaagtactttatgaccaagaacccaaaagcaaatgcaacaaaaataaaaataaatagatgggatttaattaaactaaaaagcttctgcacaggaaaagaaataatgagcagagttaacagacaacccacagagtgggagaaaatcttcatacatctgaaaaaggactaatatccagaatctaaaataattcaaatcagcaagaaagaaacaaacaaccccatcaaaaagtggcctaaggacatgaatagacaattctcaaaagaagatatacaaatggccaacaagcaaatggaaaaatgctcaacatcactaattatcagtgaaatgcaaactgaaaccacaacatgataccacctcactcctacaagaatggccataatcaaaaacataaaaaaaaaaatagatgttggtgtgggtttggtaaaaagggaacacttttacattgtaggtgggaatgtaaactagtgcaaccagtatggaaaaaagtgtggagattccttaaagaactaaaagtagatgtaccatttgatttagcaatccccctactacatatttacccagaggaaaagaagtcattacacaaaaaaaatacttgcacatgcctgtttatagcagcaaaattttcaattgcaaaaatatggaaccagcccaaatgcccaccaatcaatgagtagataaagaaaatgtggtatatatacgctgtggactacaactcagccataaaaaggaatgaaataatggcatttgcagcaatgccattgcaattgcaggatggaattggagactattattctaagtaactcaggaatggaaaaccaaacattgtatattctcatatgtgggagctaagctatgaggatgcaaaggcataagaattatacattggactttggggactcagggaaaaagggttggtggtggcaagaaataaaaggccacacactgagtacagcatatgctgctagggtcatgggtgcaccaaaatctcagaaatcatcattaaagaacttattcatgtaaccaaacaccatctgttaccccaaaacctactgaaattaaaaaaaattaaaaattaaagtaaaataaaatatttagccatttatttttcctgggaaattttaaacttcattatgatggattcttctaatgtacatttgatttattttatattttgagttggtaatatgtgcagttatttaaaaattcaagaacttcacagtgaaaaatactttctctttctttcctgtgacacagtcacccaagtttctccctagaaaagctattgtcaacattccctgtgtccagaggctgctcctgaatcccaaacgtatgtttatattttcactccaacagtggcaagtacccacccttctctaaatcttgtctttttttttcacttagcaatgtactttggagttcatttttttttttttttggaaaaaaatggtaattaaaaatttgtaattttaatggtaattaaaatcccaggctggagtgcagtggcgccagcttggctcactgcaacctccgcctccctggttcaagtgattctcctgccccaccctctcgagtagctggtaatacaggcatgtgccaccacgtccggctaactttttgtatttttagtagagacggggtttcattgtgttatccaggattgtctggatctcctgaccttgtgatctgcctgcctcagcctcccaaagtgcagggattacaggcatgagccactctgccaggcctggagttcattcttaagggtacaagaaaagctgtcacattacttttgatgaccatatagtattccattgaacatatgtacaatattttttatttaaatgttcaaacgtttccttacttacagagatctaggttgtttacaatctttatttattgtgaacaatataaaaatgaaaagtaaatgtctgtatcttttttctcattgatacaagcttatctacaagaaaatatataaactgtacttgctaggtaatatagtatatgcttatttaattttgataacttttgccaaattattttcctcataggttatcctaagtcacacccacactagccagtgtgaaaagtcctgtatcccaacaccttggccaatacaatggttatgaatctttttcctagctaatataataggtgaaaagtttaccacattgtagtcttaataataataagagaaatgtgagctaagattgaacatttttgatgtgcttagacctttaatacttcctgttcttgaactctcttgttcatattctttgcccattttttcaactgaattgggccttttaaaaattaattcccaagaactttatcacatgaaagttgatgtttgtaagttatttatcttgacttcattcatgatgtattttttttgccatttagattttttaaaataatgtcctttaaaaacttgaatggcaaaagagaaacataatgaatggtgatagacgtatttatcctttttaaaaatctgaatatctcatatatatataatgcccatactgagaatattaaaatgtaactgattttttctctagtaatttttattaaaaaatattaattttttgaagccatctagaatttattttagcattagttgtaagatggagaaaccaactttaatttaaatttttaaaatttcctgatggttaattagtcagttgttctactattgaataatacattctttgcatagaatccaaatgttacattttcttccattaaatcaccatgtatattttttattttcctgaaatttcaattgtcttaattgacttactagtcaaatcatgtgttattaatgtacatctttgataattagtattttacataatgtttgactatttgagggagtcattcccaccaccacccatcattcctcttcttttaaataatatttctggcttttttgcttatctattttacaataactttaaaatttatattttacctgccccctgcatatatgggcattttatgatttgtgcatccttaattcgaagtgagaggaacatatgattttctggaggaaactttcaactttgaatgcttgtgaccaaaggaaaactatgacatcatctggcagccatttcaaattatagccagatgttctaaaatggtttcttactaccccagaagtgtggctttaagtcacttccacttcacaggcattgctatcaattttctatctctcacaactcaaaatcttaaagacaaaaggtgttatatcatcttataactttctgaatttttacaggtgattttagctaagacaatccaaacatctggagatccctctccatttttctttgatgttaaacacatttttacagaagtaaatacagctctcttctgcactgacatagagaaaatactttttgctcaatatttcaaggacgactttaaaaatctattctaaaatataggtaaaaaagtagcatatgaaatttaaaacattatattaaaacaagatataattgcactataaaggttaaatctcatatttagcgctcacatgatatcactcaattttgtgaggcgtcttttgtaaagtatagtaggccattatgagtatttggttacataattcattttcacttaatgtagatagtattaatatattttgtgtggttcggttctatgaattttcaaagagcatgattcattcatgggtaatcagtaacccatagtccttgtatagtcattagaatatcctgtcttgatggttttctgtgaatatcaacgctctcagaagtatgccattgggactaagcctacatagatgtcagagattctctaaaatgacccagccaatactccctccacctttcatttctctggtattgtgacttactaagtgttttacaggaagaaattaaacattcaggaaagtgtgttaattttcaaaaagactccttttttgtgtctgccctcattttcttgctttttgagtcagttatcgggattttgaagtttaaaatgctgagatttttaaagtttcaatcgaaaagtattcatactttgacattgaataaaatttcccagttagcatgatctttaaaatacaaatttgatttacatttacatttcaaagcttttaattctttttggtgaatgtcccctgatactgcactctgcagacccattctatttgtttagctttggcttctcccctgccttgagtgttaaatttggtgggagatgggcaaggaaatcagagtgaaccctcacatctcagctctgatagaaggtgcacctattcctctataccagtatgtttaagaagtcttgtaacacatcttgcttttagaaatccatttatttttgtttttgtttttgttttttaaagaggttctcatacataagtggggtgaacaggtgaataacattgatttctttagaagacaggtattatgtaaatactgccttgtagaaatgcatttccatttcctgcattgatctcatcttaaagccttgcagtcaatcctattttttatgtgttgctgttttaatagaaattccatgttccacaatgaaagtaactgaccaaagatgttgaaatgatgtttaaaagcctcttatctatcatctttggaatttcaggatatcattaaaaaacaaaagcaacaaatgataaaaagaacaaacagtggtgtgctttagctgatattcattattcaaatagcttctcaatgtttttttcgtctatttttctttccttctagaaaattcctttttgaaagatggctttgaactcggaccagtctataaggaatagattttactgtttatcattaggaggagaggatttttttaccttacacatagtgtggttgaaccgatcattaagtgactaaaactctcctctatccctaaactttatcctattcaactaggaaaaccaagacaggacctcttcctcttgtagaacatcctgacagcgttcactaaaagctagtttgtgtatatctcagtagagatttccatcaacaaagcagtgacaatatctgccaaaggattttgcatttgtattgcaacttcatgagcataaaataaaaaaaacttgaattgccactatcatataatggttattcttatatgtaatcattattaccaacttatttatttttctaaaatcacattttattttttaatgaaatataatgaaaaatcttaatctccaaatttgttttttaaattatattgtagtttatcacatgtttttaagttaaccagaaacatctatgatcttgacctttaaatcatttattaaaataaaaacataggtgcctgggaccagaattcatttttataaaatcacaactgttcactatataacactatgatttctttttgtgtttctgatattttcctatctaaaagtgacatagggttaaaaaggagagaaagtggatgtagaacaatatccaaacattggttccctgcttcagtccataattgtcattcattttttattgcctcaattccagttatcaaaaggtaggtactaatccaaactgcatttcacctcctagcaaaggagttaaaatatgtcttattgttctccatgttctgtatgaagttcttactttgaaatgcagggcccttcattctttggcttaatcctctgaaactcactgaattttctagccttgtcatctaccaaaatgtgcacatattgttgtaccttgggctgtcttaaaaaaagacatcatgaactctggagccagactatctagatcagaatcccacctgtaccacttactagctgtatgacctggggcaagtgacttaacctctctttgactcagcattctcatctatataataagaacaattaaagtatctgacaggagaatcaaagcctggccaaatgaaacaggaaaagagggagcaaaaatgctgtttatttttctgcttaatcatttactccttcattaaataatcatttatacctcaacaacttccagttttaacaaaaatagatttgagtttacttaatcacagataaaataaaacatatggataaatggaaccaaagcaaagcaataaagaaaaatagtgagaaggaacattaaacttttggtagagcgtggacatgacatccaagttaagacctgaaatgaactataattgaaattccttgaaggaaaagctggccaggtgtggtggctctcacctttaatcccagcgctttgggaggccaagggggtggatcacttgaggtcaggagttcaagagcagtctggccaatgtggtgaaaccctgtctctactaaaaatacaaaaaattagctgggtgtgcacctataatcccagttacttgggaggctgaggcaggagaattgcttgaacccgggaggtggaggttgcagtgagcccagattgcaccactgcacttcagtctgggcaatggagtgagactccatctcaaaaaaaaaaagaaaaaggaaaagaaaaagaaaagcagaaagagaaacctagtaagttacataattcagcctaaaagttagaatgttagcttctggggaagttaagaccgtcataatttttttttccacttctgtatactaagaacctgaatgattcttagataacaatttggatttatttaatatttattaagtgaattatgaaatcagtgaataataaaaaagcatgtcacattttctattgctaaaaaagtaattttatataacatccatttctccaaataatatcctctctaatttaagatggataatgatgcctgatcttatttaagaaatgtattctattttgaagagcttaataaaaataattttgactcattataaacatggccaactccaactctcttttagccagttgtatctttaactaagctggtaatcagatgagaatcatgtgcacattgcattctatgaagcttagcttcactgatgtggcttacacgctgtttcagagatgtatggtcattctttggtcctttctagtgtatgtggaatcccgtttgatatagtttggatatttgtatcctccaaatctctagttgaaatgtaattcccattgctggaggtggagcttggtgggaggtgtttgggtcatggaagtggctctctcatgaatcgcttggtgctaccctaacaataataaatgagttctcactctaagttggcataaatctggttggttagaaggcatctgcctcctcactctcttgctcctattcttgccatgtgacgtgcctgcttccccttcgtcttctgccatgattgtaagtttcctgaggccctcaccagaagcagttgctagaactaggctggtgcagcctggaggaccttgagccaattaaacctcttttcttataaattgcccagcctcaggtatttctttacagtaatgcataaacaacctactacaccattggaccctgagattttgctgatggactgttcctactgaggcaattcctctcaattgttccttagctctctccccagggaagcatcttaaaaccacatgatggcggggcacggtggctcacgcctgtaatcccagcactttgggaggctgaggcaggtggatcatgaggtcaggagatcgagaccatcctggctaacatggtgaaaccccgtctctactaaaaatacaaaaaattagccaggcatggtggcgggcgcctgtagtcccagctactcgggaggctgaggcaggagaatggcgtgaacccgggaggctgagcttacagtgagctgagattgcgccactgcactccagcatgggcgacagagcaagactccatctcaaaaaataaacaaacaacaacaacaacaaaaacacatgatatgggccttgaatcatgaatgtaaatgggtgttcaggcacatgactttataacaatttgagactgtaagtgaatcatggacctatgaagcactactcgtctctgaagagatctttgactgccttgaatcctcaagtttaggagattcattttgtgaatgtacacatggtcatgtgcccggtacacagctatccacaggtgataaagagcaggacacagggcaaaacaatttgctaaagggttgggagaaataacctaataaattcaatttctttctcgcaggcctccctttaaaaagcatgtatcttatggtagcataactctatgcttcccattctcaactcatcagtactattttttgaagttgtaggttgttggttgacatgggcatttttaattttgttattaccagaccccatcagattccctaggcgtcatgtgtgttatcataggaaatacttctctacttgcctcttccattatgtcagctgttgtttgatggggattaggaaagggcacaagaaggaagctgaacaaaactgcacggctggtacctttctctgtcttttgtaagtgcttgttagcaatccaggatttcctgggaaaggacagaaatcacagatgtgtatatatgctctcacagaaagtggaagccagtaaccctgggaaattcgtgctcaactttggaagtgtatcagagatatactccacctctgaaaacctccaggctgagtatatatttaaaatgtatctttgcatttttcaggttaactacatacgtgactagcaagacaaaatacagcattattttcttttcatgatataactggataactaattgatttgtttactaattaatttccatttccccacaccagagcatcaactttatgaaatccagaatgcagttttgttcattgttatatctctagcctaaaactgtatatcacacataagctcaacaaatgtttgttgaattaattaattgataaatggtagtagaattagattctaatccataatacagaaatataaccttgagtagatttcttaaaatatcttagactcatctttctcctctgtaaactgggaggaaggagggaagagggacaacaagatgacttgtaaaaaggtccattccaattccagaattctatgcattgttagcaggaaggaatattaggctgacccatcaattcactgattaattgaaaaataggaattaatggaattttaccaaagggaattaaatggatttagtagctgcaatgtaccagcctattttgaataaaacacagttcctatgctggttgattccagaggggtaggaaatggatatgaacaaatcatataattctctatgatacaagaacaaaggatgaccagtgtataaggatacctcagaggtattgtgggttcagttccagactactgcaataaagcaaatatcacaagaaagtgaatctcaataatattttggtttcccagtgcatgtaaaagctatgtgtacaccatactgtagcgtattaagtgagcaatagcattgtgcctaaaaacatgtatattgggcttcaagtaatcctcctttctctgcctcccaaagtactgagattacaggcctgagccaccgtgcccacccccatgctccacttctaattctagttctcttgctatttttaccacatcttcagagacttccttcactgaagtcttgaaccctttaatgtcatccaggagtgtttaaacaccttcctccaaactcctgttaatatggacattttgatcttctctcataaatgacaaatgttattaatggcatctagaatgatgaattccttccagaagggtttaaatgtaattttccaagatctatcagaggaatcactatctatgacagctatagcattatgaaatatatttctaaaactataagacttgaaagtagaaattactcttgatccatgggctacagaatggatgttgtgttagcaggcctgaaaacaacattaatcttcttgtacatctccatcaatgctcttgggtgacccaggtgcataatcaatgagaagtaatattttgaaaggaatctttttttttttttttttggagatggagtcttgctctgtcacccaggctggagtgaaatggcatgatctcagctcactgcaacctccacctcctgggttcaagcgattctcctgcctcggcctccagagtagctgggactataggcacaccccaccacacctggctaattttttgtacttttaatagagatgaggtttcaccatgttgaccaggatggtctcgatctcctgacctcatgatctgcccgcctcagtcacccgaagtgctgggattacaggcgtgagccaccgagcccggccacaatggcttttacttagtcaccattccattagcccctaatgagacagtcagcctgtcctttgaagttttgaggccaggcattgtcttctcctctgtctgggaaagtcctagatggcatcttcttccaatataaggatacttcatctatattgaaaatctattgtttagtgtagccaccttcataaattatcttagctagatcttccagataacttgctgcagcttctgcatcagcacttgtttcttcactttgcagttttatgttatggaaacagcttctttccttaaacctcatgaaccagactctgctagcttccaactttttttctgcagctttctctcacctctcgtagccttcatagagttgaagagagttaagatcttgctctggactaagctttggcattaagaaatgtagctagtttgatcttctatccagaccactaaaactttctccagatcagcaataaggtggttttgctttcttatcattcatgtgttcactgcagttgcattttcaattttcatcaaggacttttcttttgcattcacagcttggctaactggtaaaaaggcctagctttcagactatcccgacttttgacatgccttccagactaagccgaattatttctggctaatatttgctagagggaagtgtatatttaaagctgtgagggtatttataatgaataatgataatattattccttctaggcataatagggatggtattaggtgtgatcgataggttaatactcccagaagtgatatagtaaatgctaatacaatgtttatgtaaatagagggcatttggtaggtatgggtatcataatctaatgagttgaaatcatttatttttgcttaaactacttaccaattcagctttcaggtttcaagtgaaagacacgcaattctttctttcacctgaacaacttagaggtcattgtagggttgttaattggcctaatttcaatattgttgtatctcaggaaatggtgaggcctgaggacaaagaaagagatggggaacatctggccaggaaaagagtcagaacatacgtttatcaattcagtttgctgtcttaaatgggtgctgttcatggtgccacaaaactattaacaatagtaacatcaaagaatatagatcatagattaccatcacagataaaataataataaagcttgaaatattgtgagaatgaccaaggtatgacacagaggaaggaaggaaggacagaagaaaagggaagggaagggaagggaagggaagggaagagaagggaagggaggggaagggaggggaagggaaggaggggaaggggaggggaggggaggagaggggaggggagggaatggagaggaaggaggggaagaaaggaaagaaaaggagaaaaagagaaagggagaaagaaagagaaggagaaaggggtgacaaagtggcagggagaaaggaaggaaagaagaggcagaaggctgtgtcaaaattgtcctgaaatcagttttgtctcttcttttaatttattggcaaacaaaccaacacagcaactaactctatagcatatacagaatggaataggaggtgtttcctagaattggaaatgtgctaacactgttgttgttggcatgttatgcttttcaccaaagaatttagcaaaaattttaagaaggttaagttttatagaaccctcaccttagcctatttgaaactaagctgaccagatgacatagtgatgcaatttggtgtctatatccataataaccacatctgtcaaatgtgtattgtccgatattgttgcaacagtagaatttttgatgactctctggatttaattcatgcatcatttggatcttcgagatcattttatacacccaagttctttttgcaacatcaattgtaatgatttgtaccctctggtttttttttttttttttttgtaatcacaagggattgtacaatgtaatcttaatgttgaggatatgaagttattttttcttcaacctctttaaatattagcaactatttcacagatggtcttttcttaagcgatgtcattgatttaccagtgagagcagccaaatctcacttgggaaataatggtcaatgcctctcagtcatccataaatggagttgacctaatgctaaactaagctacaaggtaagagggccattgaagaaatttctaacacagatggtcaaatcaattcaaatattacacaatcctctatcttcctccaccaaatcatcaaagtttccaaactgtcaagcctttcacttttttctgagttgtctgagtgacaggatatgcttgagatttcccacatttcaaaacttgtctttaaatgcaatttcttcatgcatgatgaataatcaaatatttacacctaataaacattccctacaacttttttttagcacaacaaaatacactatggtaatactattctccttaatgccaatggcacaacaacaaaaacgaaatcctggaaggaaagacttttactccaagtcaatttaaaacttccttattcattttaaatatttcattgcattaatttttcaaagcaacaaaacaaatattcatcaagtgaaactaagcatgacccccctcagataggtacatctgttgctttcctgctgtatccctgaataattcattttaatacatttaaagtatacacttcattaaaacaagctacagtcatttacatataaaatgtacattgatgaaaacaaaaatgaaagctgttagaaagctgatcctaaaattttgttactccttgtgatttatatctagctgtctctgtctatttcctcctacaatgatggtataaaggcatctccacatcctctggcccattgggagctttagttatatcagcaaataggtgggaaaagttagctggtatattttgatactcttttcccacagcctttgttcatcatggacaacttcatcaagatttatcgtcactgtttgtccattttagctccctctgctcacatcacataatagatgtaccatgtatactgaatggcatttaggaatcaaagccaacacagagaatactaatcagttttaacttcttgaaaattaatcaatttgtgctggtctgatacagtgcagggaaaaatattcagttttattcactccctgcccttttgaactctgttaactgattatctaaatggttttcagaaaggccttaattttttttttttaccattatagcatttccccctcctccatttttatggttatgtcttaagtcaggaagggagaggagggaaggggtggagacaaagggagggatgagaggaaagagtttagcagttaaagacacattattaagtattccctttaaataaacttgctttctataaatatgttattggaaaaaagtattcatatgtcttacagataaagtttgaatgacatagaatcaaatataaaataatttatgagatattttctacgtaatactttatcaaaatatttgacaattgtcactattgctacttattagaaaaaaggctatacatcataaaatcatcaaatttcaaaggttatgtacaagaactatgctattacacatatttttatattaataactaatcatagcaatgcaattttaaaactctgtggtatttttctttctgaggatccagaacaatttctgtttattcaatagtgcactttttttggaaaagtaaagtgtaaaaacaaagcaaaacaaaaccttttcttttaatggtgactggctgacatcttactttatagaaactagtctctgagaacacacattttttttccatatcacagtattttgctcttttataggatttctcaaattttcccagttcatgtgacccttttgtcaggagaaaaattacctgaaactacatacctagtatctcactgcttgcttccccacctgttcccttccctcacaaggacatgagctcaagtgtgcatgcgtgcacacacgcatgcacacacacacacacacacacctgtaaacggaatgaataaagtgggtcataatagttgtactactgaaagtcagtgtaagttaatatgctactataggctagtatgaagaagttttacattatttatttaaagccatatcagaagccaaaactgtaatgtttcttatgttgacacagcaatgggggtcagttccaggttactaggagactccattgtggtttaactatgttactagtaccaaacttgaagaatcattgctttttttctttttttttttttgagacaaagtcttgctctgttgcccaggctggaatgcagtggtgtgatctctgctcactgcaacctctgcctcctgggctcaagcgattctcctgcctcagcctcctgagtagctagggttacaggcacccaccaccacacctaactaatttttgtatttttagtagagatggcatttcaccatattggccaggctggtctcgaactcctgccctcaaatgatctgcccgcctcggcctcccaaagtgctgggattacaggcatgagcacctgaccagaatcattcctcttaatcttagcttcctggcttgagaaggaaaatccaaatatttcatttattttttcttcctcatttatgagctaagtttttctctgccataaaaggaaaaacattctaaggcaaattccttctcactgtattttttttatgacacacagtaaaatatggtcgccttctagaaatttctgctctttttctcatgtcttacaaagcataagtgggaagattctaggccttaaagactggcctgggttcaaattataccacttctctttaccagctctttcatcttaatttcctcatccataaaatcaggccattcatacctatattttggggttgttgtgagaattacagcatatttgtatattcaataaatgggagctgctatcatatttattgacttttaggattaaattgtccacagcttccaacatctctttttcttcctttgaaactcccaaactatcatttgagagaccatatgtattttggatatttcacatcatgaatgtttagtcctggaaagtttgcttattttctctggtgtttttgtacctgtaacactcttgctctactgttaaaacctgacagcaagcctgagtataaaccaggagcccttaggaatatcagattaaggatcagcccaggaatctactttatgggctatttgctcacgtactgctatttatctatctgaccgggcagtgacaaagtcaataccaccaaccacagcctttcttctacagattcttagaaggctttctactgttctcgtattatatgaacagcaaagttgacctttagtccaagggtatggataaatatatctattgtgtgtataacataaccccagttctcacagcagaaagaaaaatatgcccgattatttgattgttttgatagtggtgttttaaaagttctagactagcacaatacttactgaaatataacccatgatcattttaacatgcatcgtccaaagaacattgtttgctcctgacaaatagcatgtgcccacgtgtcaatgaaataaagcaatagttattttagcttatatgcccactcaatttgtttatgccctatttataacatgctacttattttacttttagtctaaagccttgcatgtcaatatctagttagaagtaagtttggctgcgggtaaaattctgacagagaagagggacaggtgattggtggcctagtagagttagggcagtctgatataaatgaaaaaattaactagcatccggtgtagttgtaacatttataaaatgggagtgtgtatattcatacattttatccttattataagaccctttctgcccttaagatgcagcactctgaatggtgaatactaaaaacacagactcttgatcgaggtgagggagttggaagaggcaggacaagaaaggacgttgactttctgaaaatgggacgaacggctttatctgaaagccctagtactatagctctctgatgggatcctatttgatactcacagcccgttaaggcaaaagagtaatgtccttcttgggcaaatgaagaagctgaggctcagggagaataaatgacatagccaagatcttggcaaatccctttcccttttcactagttatatggaatcagaaaacttaagttttagttttattctgccactttcttagggacttcaaatcagtattttcacctgcataatgtatgataataacccgcggctatgcttatatttcctgggttattttttagattgaaattaagtggtgactctgaagatgcttcatgaaaatttcaaagtactgaataaatataaaacattatctaaatggcaaaatagaatacccagcttctgcccatccccatcacagcataatataaatagtttctattaagaggagatgtgtggacaaaggggtgttaaagacaaaagctaaaattcattggaatatctatcacctaccttaatatagtcacagtttgcaaactggttgtctttagtgtttaatagaatagagccaaaagatatattttatcaacacacattttatatatgtgtaatataacactatatattatatgtatactgttatatgtaatataacattagatatgtaaaatgtatgcatataatgtgtgatgaaatatatagacacacatacacacacacatttgaacactctcaagctacagaaaaattgaaagtgaagaataagaaacatatttttaaatcacctgagagcaagttactggtatggtatattctcaagaaactgcaattattgtaattattgtcaaatgagtaattataaagaatttaatcacatttaatttggcaatattttatgcatccagagtgcaaagtaggctatttcattcttctatctgtatttttttctaaactgcttctgatattttataaaaatcatacaaaatcattagagaacacctaatccaaatccagcatcacagataaggaaatttataccaagttaagtcattttccctggactaccaggtttcatgtaaatcactttatacaagcagatttgacaaaacttggtattttaactgctgctctcaaaaaaatgtaagactgaaattatttgtgttctttttcttcaaagtggtctaggcatattcatgtttgctataaaactaaaagaaaaaaatgctgacaaatgaaatatatacataaatgtcagtgtagaagccattggtttagaagatcatttttaattgattagggaaattaacagaggaaaacagaatcacaaaataggcccaaataatttataattagctctataatatatagacttatattctatttgctttaatgttttttgaatacatgccaagtaactcagaggtaccttgagcttggcaaatggcaaaaaagaaccctttatgtattttaagatggataacagaggctaaaaattatatacactatgtgccaatcattgagattcaactctacttttttaatactcttaagaaatgataaaatctgattttatgacacaaagcctatacttctaacactctgagctctgtatgtttttaaaaaatgctgccatatcttactatttatttctggaaaccagaaataggctagtcgttcttggaaatttcactctatttctaatttcttccttgtcaaaaagtcagtttgttcacattcagagcataaatgaaacctcaatttgcataatgccttaaataaatgtcaaaatgaatctgtgattttttctgatgtataaataaagatactagttgctttaaacggtttaatcaataacacagcttaccacagtttaccatgctttctgggcaaagaatctgcgtgtacgtgtgtgtgtgtgtgtgtgtgtgtgtgtgtgtgtgtggcaaaattctgttgaaattcccagtgatatgtactgaatgagtttaattccctattctgaaactactactactagtattttttaaattatctgttctgtgtttgaataaggttagatttctaagtttaatcatgcattgcataacaacctcttggttaatgatggactgtgtatatgatggcggtctcatcgtattataatggagctgaaacatttctattgtctactaacactgaagtcatcctaatgtcctagcacaatgctctgcttacatgttattggtgatgctgggtaaacaaatctactgcacttccagtcatataaaagtatagcaatacaattatgtacagtccataatacttgatcatgataataaatgactgcattaatggtttatatattttctatactatactttttatggttatttgagagtgtactctttgtacttatagaataaaaagtaattgtaaatagcctcaggcaagtctttcaggaagtatttcagaagaagtcattgttatcataggagatgacagctctgtgtatgttactggccctgaagatcttccagttggacaagacgtggagagcaaagacagtaatgttgatgatcctgaccctgtgtaggcctagggtaatatgcatatttgtgtcttagtttttaacagaaaagtttaaacagtataaatactaattttaaaaatagaaaaccaccttatggaataaggatattaagaaaatttttttgtacagctgtacaatgtgtttgtgttttaagctaaatgtgattactaaagagtcaaaatttaaaaagattaagtttataaactaaaaaagttacagtgagctaagtttattgttaaagagagaaaaatatgttttataaattaaatgcagcctaagtatacagtagtatacagtaatgttctaagccttcacattcactcaccacgcactcactgactaacctggaacaactttcagttttgcaagctgcattcctggtaagtaccctatacaggggtgccatttttaatactttgtaacatatttttgctgtactgttttgtgttttccacactaatttttgttcaaaatatttgagaagaatgaaaagtagcttgttctttttcattccagagcataattgatttttaaaaacctatttgatgcatgaaccatatttcccttctcagagaactcgaaacctacaggtaaaacaagaacctcagaaaaagaacccagacaaaaagtaaaaatagtttaaaagaacagaaatcattttgaccactcatttatttattattgtttttatgtcactatgtcactgtgcaagtatttcaaatcagctaaatgacaaaatgcttcagctatgagctctccccttgattgtctaagccaatgaaaacacagacacaggtagcctgatctgataatctaaaagttaagcacaaaactgtttttgaaatgtaccatattttgtgcaatattgtgctgcaaatttaggattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtaaattctctctcactttttcaggtatgtcatgaattctatttcttacagcacctactgaatattattcgttgagtctggaatgttgatcaaggagctatgcttttaacgtctattacttttcaccaattaactatttgcagttgctttttcaaaaaggattgggattcttttgccatatagtggcaatggattttttccaatattataaacgtctgagtcctgaacatctgtatttactttcaaatgtcacaactcatctactttgactatatgcattattaatctgtaagatggttgcctgtgaaaatatatgcttcaatttacaaatagacaattaagcaggaaatcttttagaaatagagaaaaaacatgacggggctgtaacaggttcaaaggaaaaagaaaacaagtgcaaatacctgtaacaaaatagtaagaacataaaactgtcagtatcaagattgcttttcacattgcaacatgacaaaaatgtcactgtctcactaactaagcaactgtctttttcttctctgcataaatctagcctctaagctttcccaaatctttttcagaatgaagcagaaattctcatacattaataaacaaaataaaatcaaacattgtatatgattactgccaagacagaacatcttattggaagacgattttgcactgtgtattaaaatttaaaatatgcataacctattgacccaacaatcttatatgcagggttctgtcccacagaaataatagcatgcatacatacagatatttgtacaaagatattcactgcagtattgttagtaatataaaaaactggtattataactcaagtgtctttcaatgagcaaatgatttttaaaacttttcagtgtacaatgcagtactacacagacatttaaaaagaaatgagatggcaatatggtgacttggaaagatgttccacagcacattgttatgtaaaacaagcaagtgtagatcatgagatgaagctcaatctcattgtaaaaataaaataccaaaaaaataaaaaagtactatgtgaaggggtgtgtgtgtgtgtgtgtgcaatatctaactatatttgggcaatggaaaaatagtaatttcatcttctaaattctaattgttttcttcctcttttttcctccagcttaacctgaaatttcaattttttcccttcataagtgaaattgtctttgtatatgcaaaaccaagcgcagttttctaatttaatgttaacaaaatttgagtcaaagctgtggtaacccacataccacattgattgggtggattacttctccaacaccaggtttactgtagtaatccatggtttatggcatttaactctcattaaagcacagttaacaggtacccattcagttatcaccatgcttcaggatcacacgctacttgggaccatttttgttgttcatttttttttgttagctatgtcagcagataatattcgtatttcaatacctctgtagctgagcatcaaagctgcataacttctacagcctttctccttcctgctatttgctcactgaccttttacaaatttaattatttatacccaatttggcttcttctctttttctttttgcctattaatgtatctaatgtagaattgatattgtgaaccacacaatggaatgtgctgtaggaaatctctcaccttctaaagccaagtgacaaatgaaaaggaaaatgccaaaggattttgcaatttgaaacagagtgctaaaataaggatgcattgctgaggttatggtgtaacacattcatttcctccctggcgggaagaattttacacaatacctggatcagatcttctgatcagatatttagtaaagcacccaagaatgctactgatttaatccaacatcactctaagaatgggctaaataatttaacgtctgggtaatttaacgcctggttaaactcttaaaacattactatatgcttcatcctgtcacctgcttgattatcacttatacttgttcaattgttttaagaattataaattataaagagacaaaagaataggaaaagcctaagaaatgcgtaggatctgtccattggataccatggcttgaaaagaattataatgataatagcaatcctgatattttaataaagtttagacttactttaaaagatattgtaggaacttctactgcattatgttcaattaaggacattaaggaaaaacagtcagtgaggaaacattgatccaaaatgtaatttgtcacagtgatggaaaagacatctaaatgtatattctccttatttttccttaaatatgaaattatccaaatatctagttagtactgatttgcgtttatttcataacagtcaatggagaaaacaaaataaaacttaaatcacaaaagattgttgtgatctcagattttaagagtttaatgacatgttataagaaattaataatttacctaaaaatcctttttcgaaagttcattggagaatttcattcttgttattttgctgtccttattataataaggactacaactacatagaaatgatttgaagtgctagttatgttttcattgacagcactatgatcagtggaaaaaaaaaaaaaagatcctgttaaaatacctaagtcttacttttgtttctttaatcatgggcaccctttatgtgtgtgcatgttaaaccagattagcatttgcgcatgcacatgtatgtatatctttttattttaggtgagacaataaatcactgatatattagtaacggggccttcaactatgtcaatacttctgccaatgccaattttcattactaatattaaattttatcatatatttgattgataaatgtttgttttttgtttgccttaatagaaggcaaacagtttatttcagagcttacatcttttgctcttgcaaggctgtcactatcttctcacagatttttttttaggaattaggagaaagtacctgtttctgagcaatcctctcaaaagtctgatgactatgatgattaacagtacagactgatatttcctgtgaaggcagcagtttaggccgaaatgctttctaatgtatgaagaaaataactttcagtttaggaattttagaggaaggaaaaaaatcacttaagcagcatctgtttcaagtaaaaattctgttgctaccaccccaccatcatggtccttaaattttcttttcattgattagatattttcaaattttgttttacttcattttactattatattgatccggtgttttaaggaatttgcttgcattcttatcaaggaagcatcgttttcaatttaaataggtcattatggttagaaatctaaagaaatagcatagttcattatagtatacgctttgttaatagaagtaattattttcatccttattataatttgacacaatgtttcctttaaaaaacagtgatcttagaaaatactttaggtggataagaacaagagacatgatgagtaatatctaattagaggtaggtgaccttttaagctctaacaacattctctacatctccagttataaatttttatttctaacttaagaaattaaactaattatgtattatggagggaatattagatccttatatgtcagtgcagcttatttctaattaatggatggttgaaatcttcaaactaccttggacctatttggcatttgaggaatctcctttcagatgacatttcaaatgcacatataaacacacgtacacatatgcatatgtgtgcatagaattgatattgtgaaccacacaatggaatgtgctgtaggaaatctctcaccttctaaagccaagtgacaaatgaaaaggaaaatgccaaaggattttgcaatttgaaacagagtgctaaaataaggatgcattgatgaggttatggtgtaacacattcatggtgtaacacatgtatacatatatgtgtatgtgtgtttccatacatttttattctaagacaaataccatagtaataattaaagtaattatatttctcttaacactcttgaaagcttttttccaagtaacaggttcatgatatactgagctattttttgttacattttgtttttacaacatactaatattgatttatttgttagacaccaatagaaaacgcaccaaagtaataacaaagtctctcctagtagagaagcctattacttacttttgatgtatgtatattttcccaaactcatttctttggtaatgaacattgtctccataaaattgcattatcgaatagtttgtggaggactactgttgtggcatctgatcccagcataattctttctctcttttaagtctaaatttaagtctaaatcctgtggtactggtgttggggtaaaaaagaaggaagaaaggaaaatattttcagtccctgggaacatgagggcatttttttctctctcaggtggtgtaatcttcaggtaatcgctgaagactggggctctccttggggctctctagtgtggtcttttggagctgctccacttcacagttccatgacctgcaagagtcatctccagatccacctgtactggctcagctaccatcctggggcacgcctggaagcccacacggcctctggcagctgtccaataagcagccttcttaactgctgtacagcaggacagtctagactggctctcttctgtgatgctcactacatttattctacaaatattttgaacaccttctataagctgggttctattctaggttcttgagattcattagtgcaaagccacaaaaaacccttgctctcatggagtctacattctaaggtctcataggaaacacatgtaactttaccatgctgaagagaaggcatgaggctgcttcaaaacttgttccctctcccccattattccctccagtttttttctctcctgctaaattatacattgctcagataatcaaatgcccacactaagcagatgtccaactagtgattcagatctctgtgtctgcttctcaaaggtacccctaaatcttttgtccattaggataaagatgagtgacctcaaaaatgttctttttttctcacttccccagacttcctgcattgatttggagttaggttgaggagctaaccatggttgctggtgattgctgagggtatgctctgccgtttcttaggaagttgtggaagatattggtctttttgtgaatatgtatgacactattcatttcctccccagatttgggctctacatgtcaatccctgtggaattgaaaaagtcatgatactttgttgtaagtccatatattatgatagaaatagacataagatgttaaagtgggacttcttaaagtggggtttcaagttccactgagatattgacaggacagttaggatccaaagtgagtgtgagtcagatgtcctcccctccctaacatgtggaattacagtgaaaattgttccaagaatgtgataaaatttttggatacaagccccttagataaattaaaaatataagaataggtcatagagaaaagagaagggagggattggttaaaagatatcttgggagagagccattaccctgctacaaatcgttcccctcccaccacctcccctcctacctttgaggaaaggcttagtgggaaagttttaaagagaccgtcattgagtgctttgatatgtttgttctcctgttggaagattctaggtattggtacttgacttagattcaaaaaagctaaaagcaccggtgaactaagatctaacttgctctgcccagtttcccaaaatctagagggtcaggtaagagctgaccaactgttttggttgcaaaagcaggagattgctgctgtgttgggatccagtctgcccatctaaaacttggaatggaaggcatatttaaagctaggttagattcaaaggtttgactattacttggaatttgcatttgaagtattaagatggaaaatagttttattgccaaaagtgagaaagagtttttcttttttctgagagtaatcaggaaagtctagagcatgtatttgccgatgccttctgggtgatggaaagacgatgtctcctacttcatgaataaagttcaatgagatggtagaacatataaataaattgcattgtcattatactttgcttattgatttttcagcttactaatcatatgtgcatctgtgtatgcatatcacagatgtacaacgcacacacatatgcatatataaaatattatatattatatattgctgtagtacctgttattttcatccagtagtgtatcatgaacttctttacataaatatatgcattttaatgtttcatttgtcatgatatttaactaatacccttttattagacataaatgatgtttccggttttctatattaagaataaggctgtgagaaacatacctgtggctacaccttttcataggcccttaactaattgcttaggataaatttcttaaggccattctttttttcaatattttatgggtcatcatacatgcctaagtcataatgtggtaaatattttacaaccaatcctggaacattttattcatataaaaatagcatttccataagattcttggcaaaatagctccaaaaaggcatgagttaggatgttttactaagaaagtactgatgcctgataaaactatgatgtgctgtacagagcttcaaaattggtatctcttttggcttaggattgacttggcgatgcgggctcttttttggttccatatgaactttaaagtagttttttccaattctgtgaagaaagtcattggtagcttgatggggatggcattgcatctgtaaattaccttgggcagtatggccattttcacgatattgattcttcctacccatgagcatggaatgttcttccatttgtttctatcctcttttttttcgttgagccgtggtttgtagttctccttgaagaggtccttcacatcccttataagttggattcctaggtattttactctctttgaagcaattgtgaatgggagttcactcatgatttggctctctgtttgtctgttgttggtgtataagaatgcttgtgatttttgtacattgattttgtatcctgagactttgctgaatttgcttatccgcttaaggagattttgggctgagacaatggggttttctagatatacaatcatgtcgtctgcaaacagggacaatttgacttcctcttttcctaattgaataccctttatttccttctcctgcctaattgccctggccagaacttccaacattatgttgaataggagtggtgagagagggcatccctgtcttgtgccagttttcaaagggaatgcttccagtttttgtccattcagtatgatattggctgtgggtttgtcatagatagctcttattattttgagatacatcccatcaatacctaatttattgagagtttttagcatgaagggctgttgaattttgtcaaaggccttttctgcatctattgagataatcatgtggtttttgtctttggttctgtttatatgctggattacatttattgatttgcgtgtattgaaccagccttgcatcccagggatgaagcccactcgatcatggtggataagccttttgatgtgctgctggattcggtttcccagtattttattgaggatttttgcatcgatgttcatcaaggatattggtctaaaattctcttttttggttgtgtctctgccaggctttggtatcaggatgatgctggcctcataaaatgagttagggaggattccctctttttctattgattgaaatagtttcagaaggaatggtaccagttcctccttgtacctctggtagaattcggctgtgaatccatctggtcctggactctttttggttggtaagctactgattattgccacaatttcagctcctgttattggtctattcagagattcaacttcttcctggtttagtcttgggagagtgtatgtgttgaggaatttatccacgtgcacattgtgcacatgtaccctaaaacttaaagtataataataataaatttaaaaaaaattggtatctcattttccatcttttatggaccactttctagggaacagtaagagcctggaaaataactaatgctaatttaggaagacagatatttaacacatggccctctcatctgctcttccttgccatatataaagttacagaatgagtgtttccttgaaaaatctaagaggatgcatctcttggaggaactgatgtttggaaaaagacatcctgaggaggaggggaacaacaccactgtaatgacaaagaagtctatccaggcacaattgattgaacattagcttaccttcattttctttctccctaacacactctgaagggacctggtgtctcatcttcaactgcagcacaagataagagcacatttagttgccactttactttagatgcaggaaccagcattgaccctggtcatttaagatcattcctacatttctaggtttcttatctgcactcgagcttccatgcacacccaaaaccttagatatcacccatgtcaaataccctgcagcaattattatttatagtcacctcttttagaacttcgaagacttaaaaccatagttatatctcattttattttctcttagctttcacatttcaccctaggaaacaatatactataatgtttaagagtatgggctctggagtaacatctggttagaagttgaaggcaatccctctatacctcagtttgttcttttttataatagggttaaaattaaaattaggaacagggggttgtcaacaagtgggtaaagaaaatgtggtatatatacaccatggaataatactcagtcataaaaaggaatgaaataatgtcttttgcagcaactcgaatgcagctggaggcgattattctaagtgaagtaactcaggaatggaaaaccaaatatcctttgttctcacttataagtgggagctaagctatgaggatgcaaaggcataaaaatgatataatggacttcgaggactcaaggagggagaagggtgggagggggtaagggataaaagactacacattgggtatagtgtacactgcttgggtgatgggtgcaccaaaatctcagaaatcaccactgaagaacttatccatgtaaccgaaaagcacctgtactccaaaaactattgaaataaaaataaaaaggaaaaaaaaaagaagagagggttatgagtattgaattgagtagtatattagctgttactgtagcaattattggctacttgccatatctcagtaaacattaatttttagtaatttcatagtccagtttggtggatgtatagggagtatggattctaattcacacctacatgctgaaattcagacctttctgacatatggtttgacctctttaagggcctctcagtcttttactggaccctcttctttccagttaacagacaaaggaagagacaaaacacagaagactgcccgattagcaaagccaaaaagtcatgtgcatccccctgtgcgcgcacacacagacacacacagacacacacacacacacacacacacacacacatttcactggacagacctccatcatatgacccactcccctacatgcaggtgagctgggaaatgtaatctggttgtatgcccaagagaaacacaacacagatgttggtgaacatttcagcaagcctctgctgttattatcatttggatataaaaccaactttttttttgttaattggcacaacctctaagcattcttcctttgattgttatttgctctgttgaagttcaatgcagccaagcccagaaatcaaaggttcttctggtgcttagaaaccctttaatataaatatattattatcgaggcttataatgtgaagttctttacatttttgcataaaaagtgacccatagaaaatagtcattttcaaacacagaaaacttttgtgagtcaaaacagttggcacagagtacttaagacatgcttgatcccaactggcacctaagtagataaaaacaaataggttgggtgtggtggctcacgactgtaattccagcactttgggagacccaggagggtggatcacgaggtcaggagttcgagaccagcctggccaacatggtgataccccgtctctactaaagatacaaaaaattagccgggcatggtggtgcacacccgtaatcccagctacatgggaggctgaggcaagagaatcgcttgaaccctggaggcagaggttgccgtgagccgagatcgaaccactgcactccagcctggatgacagaaggagactccgtctcaaaaaataaataaggaaaaaagttatataaaatgcctctaattagttatctgttattcttttctaannnnnnnnnnnnnnnnnnnntaaaaattaaaatgggttgcatttccaaattttcttttctttttttttttttgaggcaaagtctcactctgtcacccaggctggagtgcaatggcacaatcttggctcactgcaaactcctctcactgcaaccaccaccacctgggttcaagcgattctcctgtctcagtgtcccgagtaactgggattacaggcgtccaccaccacgcctggctaattttttgtatttttaatagagacaggtttttaccatgttggccaggctgatctcaaactcctgacctcaggtgatctgctcgcctcagcctcccaaagtgctgggatttcaggcatgagccactgcacacagccacatttccaaattttctaaaggcacattttgaaagacataaattgaatttagtaattgcatgttttcttaaaatttgattatttctgattgaatctgaaagtagaagtcaacatgcatttgggaaagaaaatatcagaaaaaggaaatgcttttgctcagcatgcttaatatagaaagtaggtttattaatacaatgtcaccttccattttggaagattatattactagtggaaactttgcctttgtgggctgatagggaaaaatgataaaccatttgaaataatttttgaaaagaaatagaatattataaaaaaaacaagcagaaggagccattgtagtttcaacagtctacttcagtagcccttctacagttaatctattattgaaccaccaaatataatcatgcattcattcatttgttccatcgtttattgaagattgattgccacctgctatatgctatactctatgttaggtcagatgtttttataacaaattgtccttaacactatgttcaatgtttcagcaatcttctaatttagatttacatatacaaagatatataaatgaatataggtataatgagaaagatatataattaaccagtgttacattcgacattgtgttgtctaaatgacacatgagaagcttatttaatattcaaattctatatttttcactgaaaatcttaacttcaatcaataactagtaaatgacctaagaagttgtgtaacttttctcttctactgacagtataccgcattgttttttctcctttcatttagttactattttaaaatttttcttctttaataagtaaaatacaattctattttttttcaaaactgtgagacgatgtttttttacattttttgtccatgtgtgtattttttctattagttctcaataatttatataatttttttagttgtcgtttgatattgcttgaccccactgagagaatttctcaataattcaggcttgatacattgttatcaacaatgtctttataaaatgttttattgttgattatgataatctttaaacacaaatgttgtgaaaagttttatatatttatgaatactataaaacttccaatgcgaccttgatttcctccacggagactgaattgggataagaaaaacacttatttgctatgcaccatttattagtcaaccaacataccataactattggttaatttcttcaagcatcccattttattagtaaaataataatcagtatgccttttatttacttcatgtccctgaaaatatataatgtgactccttatttggcctaatgttgaataagcataaattagttatgttgaactcagtaattcaatgaaagttattatctccatggtagctgcttttgcctttctcaaaagcatgaatgctaagttttactatgaaaacccacataactaaaatgcaaagaagtggactctaaaattgcatgaaatagttcttaaaaagtagttttctagacccaggaaattttagtaaaattaagaaaaacaatacattccattgccacccaacaagataaaaaagatgtcagggacttttattatgttctagactcatgatgttaagtgaaacatcaagtgttctattcttttcatccgtcaacagaggtagccaactactctcctgaagtagtgtgtatcctgcccttgcaggttgttgtttcattccatatccatagccgtgtattacagaagtctgcaaacttttacttaaagggccaactagtaaatattttaggttttgtgggtcataacctctctatgacagctactcaactcttctctggtggcaataaaaagcagccataaacaaggtgtaaataaatagaggtggctgtattccaagaaaactttatttacataaacagataacagaccagatttggaccacaagccatagtttaccaattcttcatgtgttgtattagcaagggtatttttaaattttttaaatagcatcaaaatgtattttagcaaatttttaattgaatatcatggttttgagatttacagatggatctagcctcttcatttcacatgctatgtcaaatcatttatttatctaatcttttaattatgggcagttatttaatcccccattttttcacagttatcagcaatgcagcaatggttgttcttcaacttctctttctgtgtatatatgcaaaagattctctgtggtactgtattgactgacattcagggtacttatcagattttctatgtctaaattagcaggctcaaaagacattttctagtatatgaaaatcaaggatagctgagatcagctaacttttttggtgaatatagactgaattaaagtgtcgaagccactgtttttataatctactccttatataaaacattaagtgaggccaggtgcagtggcccatttctgtaaacccagcactttggaaggccagtgcaggtggatcacttgagtccaggagtttgaggcctgcctggccaacatggcgataccctgtctctactaaaaatacaaaaattagctgggtgtggtggtgcatgcctgtagtcccagctactcaggatgctgagacatcgcttgaacctgggaggtggagattgcaatgagctgagatcgagacactgcactgcagcctgggtaacagagtgagacttcttctcaaaaaaaaaaaaaaaaaaaaaaaaattaggtggcagaaatggtaaatttaaatactatgatctatttatttaactgaaatgttgccaaaaaatagactttatttttgaaggtgacaattgaatcctttctgattgtaaaacacaggctttttctattagaggattgatagatttgatctattaattagatcaaatcctctattagaggattgaatctatttgatagattccatgttaatttttctggtacttcaatcaaatgccattttatatgctttaactttgtttttattttcctcttgcactcaaaccagctaattcaaaggatagtgttcattttattcaaacttagctatttataaactcagaatacaagtatccccttttgccctaagatattttctgtcactaattaggttttgctttgcaagattatatcattcaaagtccttttcctgttactcaggtaaactgtcattggatagacagttcaaagtgttactttgtaaactaattaatgcacgtggtgctacaaaattccaagaatacaagaaagtccacaataaaaagtaattctccctgggcatggtagcaggtgcctaaaacccagctactccagagaccagagactgaggtggtgggaggattgcttgagcccagaagattgcgaccaacctgggcaacaaagcaagatcccgtctcaataaacaaaccaaccttgctccagtttccctcctgggaagcaaccattgttatcagattcttcaaccctctactagagatactgattgcctagaatggtcctgttttatgactggaatacactggcttcctatagaagtgcaaatgtgaatccaagttcatatatccccttgctgtttttctgcccaaatggaattcattatccaaacagccaagtatacatatctgtcaatatgatacatttttagagtaagttttcatataagcatccagatacaatttgatttttcttttatttatctaaaattttgcttgggttatgaagtttcttgatttattttctacaactttccctactttccattgtcccagcattttgtatttagctctttaattcataatcatggactctatcttgagtaagctcctggacctcctgattattttagtcttatttcaggcttatttctacacctggaaatagtctacaatgctactggacaggaatcagggttttttacatgactcccaaaacaaagtgggacagtagtcacttaatactgagttatacaagcaaagctgacaagcataggcttataaagaaaccatataaaattaggcaccatttctgccttccactaactcatgtttttgcaatcacaaactaagcaaactacctgtgaggaactacaacactttttatattatgaagccagaatattggaatggtttcctatacaattattctctgggaagtacaacgaataattccaggagatctgaatcataggaactttttaatatttaagaagccgaaatgtaggctaacaaccaagtctcattctaggtttttgatatcagagtaccagaagaaaatatgttttcagaatatcattaagttcctgcctttgtttctttgtgcttgcttctagccacatcagattctgatggaaagtgtatccattttttctttctgtcattagaaaacagaaatctgaaaagaagtgaccaggaataaaatacatctggctcttcttctcaaaattcaactaagtcactaattcctagggagcattattttttcatcatatgttcattaattgggtcattacttcaaactcaaatatatgattttaatttttcaaactgcacaaggatggtaatcctaaaacactgagctaaagctttcttgtgtgcttttcatcacagtggcaggtgcttctctttttttcacatttgctccaacacacttcatccttcagaacactctgtgtcattcaccacttcctgagtctgagtgtgtgactgcaagtatttgagaactttatttctcacttccttcagaccagtgaatgcctaattttaaacagactatttctaccagtttcccagtttaatctctgttgccatgattaagtagtccaaaacattcttcaatgatgtctaaggctttggaatttaaaagtaaattgcttctgggaaaaacaaatcaaacttgcattgcagacctaaagaaagtgcattaaaacatattacactgcactttcttggtggaataaatggatagtcacagtaatgtttcttctagcaatgtcagatttggagacacttcgattattttggctttcgattgagtttctctccaacactccactctctatttgatgtgtctacatatttcaatgtatccaatgacaatttatgccataaattattggctatatagggccaaaaattcagagtagaaaggtaaagcaatatactagagagagtgcatggagatgatatggatttgatttgatttcccattactgatttgctgtgtgacattgggcaaccttagcaggccttcattaatatcgctgttcatgtctacctatgatggtgtcatggctgccatattacatttgaggtatcttttctggtggaaggtggtagggttagtggtaagaaatattctaaaatcctccagtgtttcataagcacattgcacattctattttaaaaagtttgaaaggaatgcttagtaaaatgtgatacttggaggatttcattgtaatttgttgcttagttcaggaaagtaaatacctcactttttctagcattgaggagataatgaatatttacatttttaaattcacatttaaaatttgtgttgcagcttaactttaaaaattacttttattaaagtttaacattgtgtatagagggaaaaatctgcatactataaatatacagtaagacacattttcacaagctgaacacagtcctataccccccacccaatgacctcttcattttcttccccagtcgttacccctccaactaccatggataaccactatcttgacttttaacaaaataaatgggttttatctctttggtactttatataatttggaaaattctgtactcttttatgcctaacttatttcactcagaaatatgtttgtgagattcacccatactaattctggtagatgtagattattcattctcatagctgtgtagtatcactttgagtgaatatatcacagtctgttgaaagacatttaggtcatttctaacattcgtccattactaacaatgctactataaaacattttaaaatagcatagtgcaatagaacttcctacaatgacagaaatattcttaatatgtaccaccaaatatggtggcttttagctgcatgtggcttttgacctctggaaatgtgtggctagtgtggctgaggaaataaacttttaatttcagctaatttttattaagtagtcatatatggttagtggctactatattagacagtacagttctagcacatgtctttaggtgaacacatgtgcttatttgagaatagttattttacatgtaggaatgaaatgaaactgttgggaattgttattttatacctaggaatgaaattgcttggtcataaggtatgcaaatatacctctaatagattttaccagaaagttttctaccagaggggtttagtcatgcttatctttattcccttcagcaacacatgagagttccagtttctccacattcttgataatacttgacattttctatttaaaaaggaaatttagccattaatggctttactttttaggtgcctccataatctccccacatccattcttggttacatttaaactagttgctatggtcttaatgtttatgtccccccacccccaccccaccccacgccaaattcatgtgttgaaatcctaacctccaaggtaatggtattaagatgcagtgcctttggaaggtgaattggacatgagggtggagcatgcatgaatgggattaatgtccttatgaaagagttctgagggagcttatttgcctttcccccatgtgatgaccctgtgagatggtgccatctgtgagaaagtgggcctcatcagacactgaatctgctactgcctccatcttggacttcctagcctcaataaccacaataaataaatttctgttgtttataagccacccagcttattgttatagcagccaaaatggactaagacaatagtcttcacaaaagagtcacatcttttaaaaaatacaaatcagatcacaactcctttgtgtaaatctgttctcaacttcccattgtttttcctataaaatccagatcctaatcaaggtgagttatgttcaccaattttttctttattataaccacttcacagcaattgcagcattagaaattttatctctgatggaagttaatatcaacacatctactgatggtgagggttatatgtgtacaaacttggaaattagtttccagttgtaaacctatataacaaattccaatgaaatctagctcagaaaccatacaagaaaaaagcacactaatttaaaaaaggtaatgctttatttgttttcataaatatagctactgattgctagtgaaccaagaaactaaaaatttacatcaaataatgtatgattatttttatacagagcatttttttatcatcacttgggtttttctgaaattcaattattaatcttttattcaattggaagatagtaaatgaggacattattcattgccccaaagtcttcaaactgttcttaaaattagggtaaactatatcatcattctttttttttttttttgacagtttcgctattgttgcccaggctggagtgcagtggtgtgatctcagctcactgtaacctctacctcgcagcttcaagcaattctcctgcctcagcctcccaagtagctgggattacatgcacccaccaccacacctggctaattttttgtatttttagtagagacagggtttcaccatgttggccagaccggtcttgaactcctgacctcaggttatccacctgcctcatcctcccaatgtgctgggattacaggtgtgagccactgtgcccagcagttattcattttttatgtgttgtacatgagagatactaactggttaatattgttcagctgtttccccacccaaatctcatcttgaattttagctcccctaatccccatgtgttgtgggagggacctggtgagaggtaattgaattatgggggtgggttttcccatgctattcttgtgatagtgaataagtctcactagatctgatggttttataatggggagttcccctgcacgggctctcttgcctgccgccatgtaagacatgactttgcttctcctttgccatctgccatgcttgtgagagacttccccagccatgtggaactgtgagtcaattaaacctctttcctttataaattacccagtcttgggtatgtctttattagcagtgtgagaacagactaatacactggttaagaaattgcttccccaaaattcaaatcccagctctgccactcatttgcaagacctaggtcatttacttagctattctaagattaggcactaatgttaactaattattaatgatattaataatcaaatctatttcaaggaattctgagaataaataagaaagtgtttagaaagcactacgtcttctacatgtagtaaacatccagtgtttctttttatgttattttgcattttcttattcttatacttgtcatgataataaatgattcctttgaaagcttttgaaagataaatgctctttttccattttggtatgagtcgatagggtcattaagtctccaagtggcttgtcagtgttatatactgatggcatgtatatcaatgattagatggctatgaaaatgaattttagttttagttattactatagatattttaatttgcattaataacattacttaaaatgctgcttgcaacttatgcctttataagctgtgagtctcctatagcaattgttcactataaaatctcatgcttcctcccatgcagactttacacactgtattttttatcagaaatatccttttttatgtatttctacaagatgaaattcagtatatccttcagtgccacattaattatgcctcttccatgaagacttctcttcttatcgccatctattaggatctctccctaatttaacgtataactcttgtgttatttttaccttttgactgtatattctggttagctactgtattagtcttctattggtgtaacaaactaccacaaactgggtggcttaaaacaacataatcttaatatctgacaattccttaggttaaaagcctgaaatggctctcacagggctgtcaccagggctgcattcttttctggatgctccaggagataatctaattacttaactttttcagtttcttgaaatcacctacatttcttagatcatagccctggatcaatatttctccttggatcacctccatgttgcccattttggtggcttacttatattttaatgcttatttgagtgtgcaatcctttcacttttctaaaatttatttttctctactatacaatagaaatagtcacaagaattagaagttagtggggaaaaattgtaaatgataaaatgatgacaagacacatttctagagtaccaagatgggtcacacacacacatctttaccaagttgtttggttgtacaagccttgaaagaggggcaaagggggaactgagtgatttaagaatcacagaatttggaattagaatagacctccagtatagctacctacattccagcaagttaactattgtgtttatttatgagaggttaagtgcctgatctgagacgatacctctgctatatggtcatgggggctagaacctagctatcctttttgaattgctaaagaaccctccatacagtaacagatttcagaagcccctgtacttcccctggaagacacttatggatgcattctaatttgagctgccatcagttaagtttagcagaaataattttcagcaaagacaacaaataggttaatgaaatttttgaatgcaatggttctttcagggccatatgaatgtgaggatggtgatccctgtgtcaatggtcaatcgctttcttgtgaaaattatcgccttgttttccctcatatctatattactttgaagaaatatcctggcattataaaagtttttgatctccaggattttttcattttatctaatctttctcctttgtttcacaaagaagattaaccagttattcatatctcctgactcgtttgttgctaactgaaccagggctgaaactctgaattctgacttacaatcagagactgtccctcaattccatgttgtgttacctctattagagtaacctgagtaagcttcttagaaccagaaacacaggtaatacattatttaaatatcacactgcctcttgcatgtagcaggaacaagtaagttacctaagaaaaacaatgaatgaatccaaacagcctattgacaaggtaatccatagaactgagagtcagcaagatggcaggctacataaaacagaccaaaaagatgatagaaatgaaataataagattgtgtctctgttaaatttgtggatcacagtaaatgcttcactaatggtaacctcatagcatccagacacagtgagtcatttctctggttcccccttgtttttacccttgatttctcaagagtagctcagttcatatatttttgcttcagtaagaccattgactttgtgtgtgtgtatatgtttgtgtgtgtgtatgtgtgtgtgtgtgagagagagagagagacagagagaatggaggaacagcatagcacagaactgttcagctaccaacctaaatctattagccgtgctgtcctggaaatcacttttcagccacacaaaatttcactggccctatatcccaaggagccctgagttgccactataccgtagactcctctctccgtctggtggctctttccttccccttttttagatatataccttcaacttgaacctttttgttagtattatattattctttattttgttttaacataaaggggccactggacaatatttgttcagatcacttatgtgtactgctcagttgatatgcacatttactcttctgaaactgtttagcattaagtaacttagaacataaaaaacaatgcaacaagcatattatcttctattttttcccaaatcctttgtgatgtaagaggacagaacacatatatacatatcttttctacaaatggattatcaacattgttctcaacattacctagttccttaaataagaaatatatattttaaaatttgtatggcattcaaagagttacaattatgaatttcacatttctctagatgggtattaaacaatctttggcagatcacagactaagaaaggtaacagatgttggattggaaactgtacagtctagagatggaaaattaatttgtaaaaaagtagtgatttttttttccactgtgtgtgttttaaatggccttagcaaagcagaatggaaatatttgcattcctggcaatcaatttgcatacttaagcatttgtttttgttcccattctaaagataactgtgtgttcagtaataacccatatagtagaaagaagggtgaagaaatgtgtgtctttggcatccagcctgctgttagcgagtgactttctttctttctttctttctttctttctttctttctttctttctttctttctttctttctttctttctttctttcttttgttttgttttttgagacagagtctcactctgtcacccaggctggagtataatggcacgatcttggctcactgcaacctctgcctcccaggttcaagcgattctcctgcctttgcctcccgagtagctgagactacaggggcatgccaccatgcccagctaatttttgtaattttagtagagacagggtttcgccatattggtcaggctggtcttgaactcatgacctcaggtaatccacccgccttggcctccccaagtgctgggattacaggcgtgagccaccgcacccagcaacaagtgagtttcttagtctacaatgttcacttggaatttctttactcatgtcttgatgtaaaactcgctgaacatactgctattataaaaatagatatattttccatctctctggtggcatttcttctcttcctctcacctaacttaaatcttctatttcgcttctccagagctcccaacacaacagtcttcttttatcttcaatacgtagtggaatattgtgaaatagctgaagcagaatgggggaggagacagtggggaattttttaaaaaactgttttacccaaccattgagcatatactttttaaaatatttatattctgcctagagttgatgctgatgaaaccttgagtctgacaaagattttataaaaattcctatcacattccctatttcaatgtcaggcaataagtcagaatgcaggtatgacaatgtttttcaatggtcttacagcagactagaaagcaccatcaagaggagaatgcctctgctaagaggaattatctatttacactgcattgcagtcccatttctcatgcatagatctgtagcatatttggctaaaacttgcagaattattatgtcgcttcctgtccctctatccctactcactactttgttcaagggaattaataaaaaaaaaaattgccttattttggagctgtttgcgaaagtcttgttatttcagttaaagagaacactattttgttagcaagccattctgtttctttgggctacatttctatatacttatcagctaattatatagtgcagatatttttagtgggaggtagtcttttttttttgtccacttgtgacttctgccttgagacatttttgataaaattgtgctggggtcaagttgaaaaggaatgttttcctacattaaaaattttaattttaaagcaatttgactaaacatatcggtgatcataaaaataaagtcaaggtttaattcaaaacagaacattttagtttgtgtatagaaaaactttattttggagcagatatcaaggagacaaccaacagaataccgtcttcaactcttcgtttgttcacaaataaactcaatagattaaaacttatggtagtgaagttgcagggcaggctgttaccagcacggtaaaacaaaagaaagaaatctcaaaatacgtgcccttttgattgtggttatgcataaagctttgacagagtaaaatacatagaatgggtgtgtatgtaatatagagatacaggcctggaaagctgcctagagactttccgttgatgataattttagtacttaactaaaaaccatggttttttgactctttcatttttatttctgtaaatttaacttctactcagacagtagaagttttattctcttttattttattctggtgaatgcatcaaatacaaaagcaagttgtttagctcacaaattgcaattcagatcctttgccccttgtgcattcatttccagtgatgtttttaacaccatttgatcttaaacacccaacagaaaatagaagcacagggtgctacactgttacctcaatgagtgtggacaagtaagaattaaagtgaccttagattccagatttctgtgtccttccttaaagaagggatatacagaggtgctaagttgatttatactaagttaaagccatttcagtaatgcaatgaccttgtaccaataaatgtttaagtatctagttcttcagggatctgagaaataaatatcatatttaaaataacagatcttctttgagaacttttgactgcctgaaactttactcagggtggattttaaacaactttcatatacataggaatgaaagtatggctactatatgctttttactttaactcttattacaggttgaatagtgccaaagatgaatgagtatatttgtttgctcataatatgccaatcgaattctccttttgaggactgagtagaagttaagagtgtgagttacagccctgcttttctttttaaagttaccttggtcattgtcccacatggtggggcccatttacctctcagtgttcttggctacaaaataaaaatgaaggaaaaaataatgtgtgaagcatttttgagctctaaaaattctgaatttatgtctcaaaaataatactaaatgacccataattcaagataaatgtacacagtaagaatttttaatataaggaaatgtaaaacccaagaaaaggagaataaaataattatatgaaaactcaaccatatagttactgtaattaattattataaatcactcgatacttgctgacatggaagttaaaacaaatatttcaaaattcatcaaatacttttaccaaagaaaagcagaaatgtttggcaaatctgttataggagttttcttcataattttatgtaaggacctggtttaccaaaagctgttagattgatttttcctcttgtttttctaagattttaagttctataggatttgttaatagtgttaacacattttttattcaccctcaatttctgagggtagacatttaccttaaataaaaaaaaataacatgggagaattgatataataagatacagtttttatataagataaaggttatctcaaatcagctttggtgtgtgatcatcataagcttagtagggcttaaatgacttgttccattgtagtactgtcctcttttcctttatttctctctacactattcctttgtgttttaaaaaattattgaacctgctgtaaaatagaaatagtaacaaaatatacatcacaagatgtttgtaaagatttaatgagataatgcacataatgtatttaatacttttactagacaaatgttcttaaaaatgcaatcagtacatttatactgaaagaaagacacatacaaagagagaggtggaaggagaaaggacttgtggtccctttttgtttgatggaaactctttctcttataccaaactgatgtctaggcaataaatctataaagcactaataattagagcaagatgctggaacagaaacatactaccataatatcccacaaaagcactgattttgataagtaccaatggatgagagtacctttgtgggagcctgggcatctagcagaaaagtcccagtacactgttggagcaaaaggtatccaaggatagacgtattgaagggaataagaacggtttcactttacccatgtcacccctttaccgggcatagctcagtgacaagagaggctccctcagcctgcaatttttcccatacgtaaaaacaagcaagtagttagtaagtgtccaattcccctagctgtatgggatgctgcccaagacatccacttctttctaaccccacccaggatactgaggtaattagcatgactgagtggttggaagaagctgggaacaggaaacggaggctatagaccctactaaccactctacagactccctgaggaagtccacccatgaactacttaggaggccttgcctgtggatcctcctcaactagctcatgggcaccacaagtgtgccatgcacctcaagccccctccaagccagctcccttaatataccactatggacagcaagagcaagtgtctcactcagacaccaagcatgactctgcaagattgagagaaggcatatgaacttgagcatttctgggcacggccacagagaacacaaatgggaggttctcagaacctgtcctggctttgtgggatcgagagacagcatacagtcttaagaattcctccctaagagggaacaagtggcatggagcagatgtatccatggaaaatgtctaagagtactagctgaatctaagagagctcagaatctctggctgggttgattggtgaaggattaaaactgaaggagataactgcttcttcaaatgagaatacagtaatgtaagacttcaaagaacattaaataatcaagaaatatgataccatcaaaggagtacaataatattccaataatgagcctatcaaaaaaattaagatctataaattgcctggcaaattgccttcaaaagaattgttttaagggaacaattcattaagtgaattgaatgtgctacaagaaaacacagaaaagcaactaaatgatatcagaaaaaaatacacgagcaaaataaaaagttcaataaagatttagaaattatgagcgaaaccaacagaaattctggagctgaagaatgcatgaataaaatgaaaattgcaatagagtgtcatcagctgccttcatcaaacagaaatgatctgtgaacttgaagatatatcatttgaaaatattccatcagagataaaaaagaaaaaaacagtgaaaacaaatgaacaaaacctacaacatttatggaacaatatcaagaaagcaaacggtcactgtatgggagctccagaagaagagacagaaaaggaacagaattcttatttaaagaaataatggctgaaatatttccaaatctggagagagatgtgaacatccaggtatatgaagatcaaaagcctccaaacggacttccccaaagaagactcactacgacacattaaaatcaaattgtcaaaaatcaaagacaaagagaattttgaaagcgccaagaaaaaaaacatgcttatcacatataagagaacctgcattagactatcagacaagaaataggtttttgtcagcaaaaaccttgcaggccagcacagggtagaatgatgtagtcaaagtgctggaaaaaaattacaaaacaaaaatagattacctggcaaagctgtccttcagaaatcgagagataaagactttcccagacaagaataaataaataaataaaagttgaggaagttcaccaccattatacttgccttacaagaaatggtaaagggagttctgcaagctgaaagcatgttaattagtaacatgaaaacaaacaaaagtataaaactcaccagtaaaagtaaatatataagcaaattcataatactctaatattgtaatggtagtgtgttaattacttatgactctagtataaaggttaaagaacaaaagtatttaaaataactatagctataataacctgttaatagatgaacaatataaaatgatgtaagtcgtaacaataaaaacttaaaatggggtgggcagcagtgtaaaatttgtgtatgcaattgtaacaataaaaacttagaattgggtgggcagcagtgtaaaatttgtgtgtgcgattaaagtaatacacgtaaaatagattgttataactaaaggatgtactatgtaagcctaaaggtaatcatgaagcaaactcttatagtagatacacaaaaaataaagagaaataaatcaaagcgtaccactatagaaaagcatcagttcacaaaggaagatagcaagaaagaagaaagaatcaaaggatctacaaaacggacagaaaacaattgacaaaagggcaatagtaagtctttacctattcataatttgtttaaaggtaactgaattaaaatttccaatcaaaatatacacagagtggccaaatggattaaaacaagatgcaactaaatactactgtccaaaaactcacttcagctttaaggaaattcgtagactgaaagtacaggggtggaaaaagatagtccatgcaagctgaaaccaaaaagagcaggagtagttatatttctatcagacaaaatggacttttaagtaaaaactggaaaaaagaaacaataaaggtcactgtataatggtaaagtagtcaattcatcaagaggacataacaattgtaaatttatatgcacccactattaaagcacctaaatgtattaagcaaatattaacagagctaaatgcagaaatagagagcaatgcaataatagtagggaacttcaatacccaactctcaataacgaatagatcgtccagacggaaatcaataagaaaacattggactttaactacattttagaacaaatgaacctagcagacatacaaaagactccatccaaaagcaactgaatgcatattcttctcaagcatacacaaagcattctcctgaatagatcatatgttaatccacaaaacaattgttaagttttaaaagattgtaatcatattaagcatatttctgacccacagtagtataaaactagagatcaataacaggaagtatactggaaaatttacaaatatgtgaaaattaaacaacacatttctgaaaaaccaatgggtcaaaaaaattaaaagataattaaaaaaatattgagccaaaagaaaatggaaacacaacatacaaaaacacatgggatgcagcaaaatcatttctaagggaaaagtttagagtgataaattcctatgtgaaaaacaaagagacatctcaaataaacaacctaactttacatttcaatgaactagaaacataacaaactaagcccaaatttagcaaaaggaaggagataataaagatcaaggaagaaataaaatttgagaagaggaaaccaatagaaaagatccacaaaactaagaattacttttttttaaaaaaaggtaaacaaaattggcaaaccttcactacactaaggaaaaaaatacagatttaaataaatatgatcagaaataaaagaggagaaattagaacagacaccacaaaaataaaagtatcataagaggctaatataaacaattatatggcaacaaattagactgcctagaatagaaaaattcctagaaacaaacaacctacaaagtctgaatcatgatgaaacagaaaatctgaatagaccaataacaattacagagattcaatcattaatgtaaaatctctcataaaagaaaaacctatgacctaatggcttcactggtgaattatatcaaacatttcaagaataattaatagctattattttcaaactctttcaaaaaattaaagaggatgatgtatgtccaaactcattttactaggctggcattactctaataaagccagacaaggacaccatgagaacagaaaatttcaggtcaatatctctgataaacatagatgtaaaactcttcaacaaaatactagtgaaccaaatttaacagcacattaaatggatcatacactatgatcaagtggtatgtatcactggggtgcaagccaaacacagaagaacatataccgcagcacctcacttaaacatggaatctagaaaagttgaactcatagaaacagagcacagaaggatcgttaccaggggtatagaaatggggaaaatgggtagatgttgatcaaagggaacaaacttgttagtataagattaataagttctggagactttatgtacatacggtgactatagttgataataatatattggatacttgaaatttgctgagaatgtagatttttcatatccttacaacacacacaataaaatgtaactatgtgagagatatgcatgttaattagcttgactgtggtaaccatttcactatatatatatatatatatatctgaaaacatcacattgtacaccttaaatatatacaatttttacttgttaattatgcctcagtaaagctggggtggggagaaaacctctaatgtttaacttaagtacaggacaaaaaactagcctatacattttggtctggacaatttgcccatctttgtcctctcatgacctccagatggtgaccttactattcagtggatgcagaagcaagatagatgacctttcaagtttagtctttgccataatgcctaacccagtctaaatggtgctgcactcaaatgatagttttgataacagtgttacatggggtcaatcatcatttttgcaaacgacttgagtaattttttttcttgatacttaaatgatagttccaacacaggtgattctcctccaaaaccataatgagtatgagtctgttgaataaatgtatacctatactttagtgagcatagaataatatttttaaactctttatattgttgtttattactatttcttaaaaccttatacgtagtctagttttactgtggattattttccttgtgtcctgggattgatatttaatttctttgcttttcttcacactttagttataattgttatacatttagaacatttaatctggatttttgtaccattcagtaaaagtagtcaaacttcccaaactttagccctgttttctccttacccataagctaggaatcaatatcagaatcagagataaaagtttgtaccccctccccgtctgtattgagctgctcacgcatttaaataattccattaattaatggtaacagtaactttggacataaagatcaaattagcagatatatataatgaacatatatatataatgaacatatatatatatatatatatatatatatatatatatatatatatgcttattagcttaactgtgaaccctgatgaggaatgtggtatgatttgttgattttatgccttaatgatcatgtgttctggctgcctgagtcattttcttttaaatgatgtatttgtgcattccttcatacttccagagttcttctaagttataaacacagaaaaatgctacagagccctggtactgcattccacatgtttccttatgatgtgtgaaaggtgtcgaattgtcattttctaagcttatgttacagagtaggtttttggtagctgtaagtctaattattccttctgaatatttaaatactgaaataggccacttaaaaaaaaataagactggggaggtgtggtgggtcatgcctgtaatcccactactttgggaggccaaaatgggaggatcactgggaggactgttgaacctgagttcacaaccagcctgggcaacatagtgagacctcatctctacaaaaaaaaaaaaaaaaaaaagccagctgtgatggtgtgcacctgaaatcccacctactgaggaggccagggtgggagaattacttgagcttgagaggtggaggctgcagtgagacatgagtgtgccattgtactctagcctgggtgatagagtgagaccctgtccaaaaataaataaaataaataaataaaaccaatactttctactacaaatatattcattattcattcataacgctttgattatgatgagaacacttgtcttaagtgacaatatgttcttcaatgttatgttaatttcggcccacctgaataggatatttcaaagaaaagtattaaaatggaaaatcttaagtctaattgataataataagaaacatattaccttgtgaacgtcccactttgtcacagtgttttgatttattttatgccataagaccatctgagacatttgtcgcacatttaacgctggagggttttaagtgatggatatttgctaagtctgatttagtcaattatttacttcaaactggcaatttattaatctttcttttatgcagcaataacatttatttactggaaaaactgaatgcaaatagtgtatgtgtccattagtatcaagtttatatttctattgtcaactggaatatttttgtttagtatgacaatctggaaaacaggttgataaattctgtgagattgggtcaccgttaggtagctctcacaatatagatatgatcaaagatgagtatttgaaattcactagtttatgttaatgaacattcttatagaggctgccagggggacagcttctattggaattaccttttgtgaatcctcctcattacggggtaagttcttactaaagtgaataattatctttcattccagaactacagtgtcaggcataatgagtggattgttaatacatttttcaaggtagcgccagtcttcatctgtagccattaatttggtgacagccaataattattttaactggcccctgatgctgaaatgcacagattgttttcttcctgtgtggtgcagggaacacttctaaatttctgagaggtttctgtcacttcccaaagaatttcctgacagcagtgacatttggtctaatcatttattccctcagtttcatgacttccctgcggtggctctcatagtcaggaaagcttctgttgttttggaaccacagctacaaacatctgctgccaatattttgcttaaagtgttgcaactttccttaaaaaaggagacccccttctttttatgcttttagttattttccttaaaataatgttaaactcttaagaagtttcatagaggtggacatctaaaattattaatgaggaagcttttaaagatagaactggaatttgattatcaatagtcctcaggaaaaaaagagaaaataataataaaataataattagaataatattgaaatgtttataaaatgttatctaaaaaataataaaaatgaactcatttttactttataaatgactcagttataataaaaactactcagaacaaacacaccaaaatgataatagtcattggtctcagcagtagagatacagatttcttctttgtgttctgtactttgcaaatattataaaatagttattacttagaaaaaattgtttgaaatgctaaaataatggacatctactaaacacgaaatacaaaaaaattgccaaaacataatatcttcaaagattttcaatatataatcttactataaaaattttatctataacatttataccagttacctatcactattgaatatactttgaagattatgcaggaatatttcttaattctctatagtttccatttgtctgagggttttttccttattcctatccttctccctttctctttctcctctatatctgcacttttaatatgaaactgtaaggaaaagaaaattagattggagatctctatggggcaacagcatatcggctgagttcagcatttcaaatttttgttctcaggtctcctttacactcttatgattatcaagaacaccaaaaactttttgtttatgttggttatacacatcaacatttgtcatattagaaatttaaaatgacaattaaaagttacattaaaaatgtacttaaaagacaataaaagcattgaaaatcaattaaaacaacattttattaaaaacaaccatattttctaaacaaatgaaagtatttgtgagaagggtgggcttattttacatttttgaagatttctttaatgtttgacataataaaacacggctaaattttcttaaatccttctgcatttcctatatcacatatcatgtagactctaaaagaacttcattctacctgttaagaatgaggatttttgaaagagtaaaagaagaccaataacatcttagtagttttatggaaaaattttgactttgtgaaccactcgaaatggtctcagagatacctgaaggtcctcagaccacactttgagaactgctggcatatgatagatatattttatttttgtacctagacagcattccattttaatgaatgtaccatatttatataaactgctctgcaaatgaatgaatatttgtattgctttcaggttttttttctattacaatgttgcaatgaatgtccctataaaatatatttgctcccatgcatggatttatgtatatgatggacacttaagagtgaagtccagggttaaaagttatgcatattttaaagtatgatgtattgacctcctaagaaaaagattctgtaaatgtttaatttcaccaaaacaatacaaactcttgtttcctagctcttcaaaatactaggaaagtataaatttatatgctctgccaaggtaaaagttagacagtgtcatgatattgttttatgattttcctctttactaatgagtttgatcatttttcattcatgtattgttcaattatatctctttcatcatttacctgtggttccagtttttttattatttttctcttgggttgtgtatttttatgtattgacctgttgacactctgtatattaaccaaattagccctcgatttgttgtgtgcctcacaaatttttttcttaatcagtacatttaatattttcagtagaccattctcaatataatgacttggaatgttagtaatgtacacatttcatagactatgcctcttttctacgttttttattatttcaggaatagtaaaattagaggaattgaataaacaaaactattttaaaacttgtcaattaagtttgttcagaatacgatttgtttcccagtattaactctggacatccagatatagacaggctataagcttctgattacatgaccagtgtagctagtttagattcaccttcacagagtatgtctaccatgtactgcaccttatttgatataatttaatagctcaataggtattagctgaatgaatgaataacaataattagtagtgacattaattaaacactccttttctccacctctgtttactggaaataatgcttttagatatagagatcttttgagactattctgtggtttcaaaaagctcatcaggaaatgatgttttctataattggagtaatctatcaaaatagatgaattctaaaattataataattcctgaaattgtcctgaggcaaaatttgttctactttcataagtgtttccattttcttgttaggaagaagagacacaatctgaaaaccaagtctaattttcccataggtgtaaaagagaagaccttagtaattacttgtctttttcatccagccacttagtgtcttttcttatttttgctaatgactgcaaaaaatgaagatctccacaaggagaaaatgttctccccttagaatggctgttcttagacttgagttacacttttaccatcatctaatttttgcaatattttacatctttgcccagtaaaatgaggttcctaagttaaaagatttttgagcatattattttgaagttgctgttttcagtgcaccattcacattattgtcattattaattgcattctgggaccaaatctattttgaaaaatgtttttcttgcatcttggataaactgaataagcaaagaaagctactcctgaaacttgtcattaaagttttctttagaatacaattcattcatcagtactaactgtgagcatccagatatagacaggacataaacatttgaatatgtggccatgtaactaatttgagctcacctttttagagtgtttctaccgcacacaagaccttatatgaaacgatttaatggctcaataaacgtttattgaatgaatgaataacagtaattactattattattatctacaacaatacttgcaagtcttctgtctttttgccttttctttcatttctttttccccagtgataggctagataattgcatcccagagatgtccatgtcgtaatctccagaacgtgtgaatatcttgccttacttaggaggtgtgattaagttaagaatctttagatgggaagattaccctgattctttcagatgaaccaagtgtaattgttaggatcgttataagagggaaacaagaagatcagagttagcagtagatgtgatgatgaaaagagagattatagtgatgtgaggaaggggctgcaagccaatgaatgtaacagcttctagaacctgaaaaggcaaggaagtatatgcttgcctaaagcctccagaaggaacagggccctactgatattttaatttcagaattctgacctccacaaaagtaagagaatagatttgtattgctttaagccactgagtttgtagaaatttgttacaacagccataggaaactaatatacttcttttactccaatttctttctgtattccatgccattagatattgcctccagaatcaagcatctatgatagtgcttagcacttaaattggatgatacatttaagttcaacccttgtgtcatagtggattggattttactctttataaaatgtatattgtgaacttctattaactcaaggtcttttctgtttttgtcacgagaacgtaaatacattcaaatgaaaatatgctgcatatttttagaagacaaattttccttgaacttgatccttatagaacttaactctgtttactggaaagtaatattagagtttaaaatctagagatagcggatcatatagataagcaatgcaggatttcagtgatttctatggtcaccagtacaggtgtgatcttaaaacatcgacactattgaactgaattcataggtatgtatttagcttgcatttgtttattccagtagccactgaggtgtatttctttgtttataatctataatcaaaatcctttgctatgacatacaaaaaatgtatcgagccacggacgttgaccagggttttcttccttcattagttgaaaatgaactgtatctgctattgtttatctggggaataaagagccaaatgttaaaagttgccttcagctaggagcagtgcctcacacctgtaatcccaacactttgggaggccaggaggggtagatagcttgagcccaggggaccagcctgggcaacatagcaaaaccccatctctactaaaaatacaaaaattagccaggcattgtgatatgcatctgtagtaccagctacccgggaggctgaggcacaagaatcacttgaaccgggaagcgggcagaggttgcagtgagccgagattgctccactgcactccagcctgggagacagaatgagactctttctcaaagaaaaaaaaaaaaaggttgctttcagttagtctgttcacagtataattttacatctgggggataagaaaaactgttgactgaaacattttctacattttttctttggttcatattaaaatatgtagttttacattatttgcttttggtagaagttctgtctctatcaagaagagtggaagagtgcaaatagatgtacaaattccttggttatataaatattattctaattgtaaaataactgaacatttttactgaggtgtgctgagaaagctctttgtttttttgttgtgttttgttttgttttgttttgtttgtgcctataatctgttcccatggggacctgcacaatccatgattctgataaaatgaagagcagtggagagttacaacttataaagcagttatgactaggctagtcaataaagtctcaaaatcagctattagagtacggtatttaaggtttgttagagaacacagagtatggaaacattgccattaactaatgtgtaatttggtcacatttcctgataagataataagactttttgctttcctctaatctaaactttctccaggaagttatgcaacataaagcactatgattaatattgccactgaataatgtaaatgtattttctcaaaagaaatgaatcccattaatgggactgaacacagtcttcagtggaaggttcagatttttgattcaaacaatccagcatttccatccatttactaattatatgatttgagtaagttatttcaaatcactaagacttatttatataatccatgaaatgcaagtaatactgtacctttactgaagaagttaaggaattaaatgaggtattgtatctgcattagtctaaataagatagatcatattgtggtaataagtaattcttcaaatcttagtggcttaacacttaaaaagtgtcattctttgttcatattagaaagttaagatgttgttggctctgctgcacagttattcagaatcttgtgaaaaggagaccacaccatctatagaaattgcagcctctgaggacatgatagcaggagatcagagatgaaaggagaacaccagccttcaaggcttagctcagaagtaacacttgtcacatttggtagtttataggccatggaggctcatgtttataaggaaagactgggaacatggatattggtaagcacagtccttcctacaacatctaaaatgcttagcaagatgcctggctcataaaatacctcagtaaatgttgtctttttcaccatcgctattattattttagagggagtgcaagttggtagttaagagtctgccactaactccatgactttaggcaaacttttaaaactttctgaatctccattgtaaaaataggtctcccctcataagactgttatagtgaccaaatgaaataaagtgctgccatttagtaagccctctaaaaatatggtagtttcattgctatcatgcatttatattcattttatctatcaattggttaaacccaattaaatgcctacatatgtgtgtttttattataacagtgttgagatttcctcatttttattaatatgtataaactaataaaacattgattttcctatttgtgacaaatatattacaattattaatcattcatttgataggtatttattaggtgtctactgttttctagaggtaacagataaacaatggacaaaatacatgaggttttgctctcataatatttgaattctggagcagtgaagagtaaatgaggcaaaaatcaacaacataaaaataaactgtaatttcaggttcgaataattcctatgaatttattttaaaaaggaggatttggttaagactgactggttaagacttacattttgatagtcagaaatgccttttctgaagaagcagtgtttcagctgagatatgaatgatgtaaagatatttgagaggaaagatttcctttctggcagagggaattccaagtgcaaaggttccaaagcaagaacactgtaactagttcaaatgtaattaaagcaaaagtgagcaacagtcaagagttgttagaaatgagactgtaaagataagtagtgacctttttgtctatgaaaaaaagtttgatttttttttttcgatatttgatgtggaactattcaaggttttcaaacaggaaagggatgtgatctgatttttgctttgaaagatcattctgactatgtatggaagaatgatctttataaagaatggttcctttataaaagggaccattgcagaattccaaaaagagatggtggtaattttgaatgaattatttggtggggggatatggatagaagtggaagatttgggatatattttgaaggtagagttaatatattttgaataaggtaggtaagagtttagagctgaaagaggactagatttagggcttcagccactgggtggatggtactgtgatgaaggctggggaaagaatgggctctttatgggatatcaagagacatactttgcatctgttatttccagatacctcttaaacatttaactgactgtcagtcacatgcaaatcttttggcctttcaaataatacaataattttagtttagattatgcctatttttgaatgactgcttgttatgaatgctattcagcgatgtgatgactcaatatattttcttttaggtgctctgctgcaagaaagtttaaagcatcttagtttagaagctcataaatactctctaaaaaaatgtgatagaatttacaaagataagcttataaatctaggaagatacattttacttcagagtcaaaaacaaaacaaaaaaatttcattgacaattcatccaacgcccaaatgaattgattagccaagaacaaagaggaatttttactaataataggtttgtatagcttccttgttttaaaaagaactatgttgtgggtttttttcttcccctaatgaaataaaatattagagtgaaatttttaattagttaagtagtttgttgcattctaccacatccatgaccatctgatatagtacccaggaagaagtcaaagatgcaaggcgccatatcgcatgatacacgataacaaggtaatgaagagtaaatacatttgtcatttcagggaagttatttacatgacacagccttgggaaagcctgcttgggagacataaatgaatgaagctttttagattgatgaattaagtgtgccttttttgttttcaataatgtccaataaaatagtttatattgagcaagaggtcttcttttctgatctaagacataatgttgtacaagaggtacattgtgtggatacttaatatgatgcacatttgtttacatataacttctgcaaggagatattaactcccaagttctggaatctttctttgtgcttactagttatgactttgtaacccagggtcagagttccaatttcagcacacaaagcccttgcctttggcagctaaaggcctgttattatgggcaaagattaaaattaccctaggccaagatctataattttctatattaagtcttgagtcagtgccacaatgcaagtaaagtgaagtatcaataactcatttaaaattatttttctcatgaagcaggcagactagtcattctgttaaatccagtaaagggcataagggataaatctgggccactccaattttgtgttttatttttttttttttattttttatttttttgagacggagtctccctctgtcgcccaggctggagtgcagtggcgcgatctcggctcactgcaggctccgccttccgggttcacgccattctcctgcctcagcctcccaagtagctgggactacaggcgctcgccgtcacgcccggctaattttcttgtgtttttagtagagacggggtgtcaccgtgttaaccaggatagtctccatctcctgacctcgtgatccgcccgcctcggccttccaaagtgctgggattacaggcgtcaattttgtgttttaaatgaaacactgtgaacctatacaaggggatgtggtctttcccctttgtattttgtgtagggctggaacactcattctcaatacaaaatagagccaactctttgttcaccttttttctaggtatccccctaagtctctgaatgaaggaattgattgttgtattgtttctcagtttctgttggacatttaaagagagagggtagcagtgctcacagaagttcttcccttcaaaggcagcctatgtgaggtttcacacagcagtcagccagcgcacctggacagtcaggcatagatgcatttacaggatctttctccaatctgccataagtcatttttcttcctatgcctgtgctgtatgaactatgccatttagcggccacgtgctcccttactcctttataattcacatttagcgtcaatccagaggtctctattttgtcttttctttcacttgaagcttatgtatatagttatgatatgctttacattttgtccagggataactatagtttctagggcaactataaaacttggggaatccaacaaaaaagtccagggggttaaacaataatctaagccttttatttgtaaatctttgcatatctgtgaattgctttaaaatgcttcagccaaaaagggcagggatgctgaatcagacaatatggacaaaccatgaatgcctatggaaactacatggtgagaatatggagattcattatactattccctctgcatctgtgtgtttgaaaatttccatatagagaaattatttttaaaaaataaatatgtgaaagcaaccatccagggatgattgagcaggttttttgtttgtttttaaacagacttgtaagaggttttttttgttgttattaataagttaggctcaaaaacatatggggacaaactaaaacctacataaagagaaaaagaaaacaatgctaccatttttggacattgctcaatttcacattgtgaatgctagaatttgctccttgaagtgcaattggaatcattttctagatcttttgtaaaatcacaaaggatatttttgtgtttattaatatctttgcagccccttagagaccttgacatttttttctttaatactactaaaataatatcagatatacactcaggtctattccatttttgaatattgtctttcacacatacttatgcacatacaaatacaccactcctccccctccaccaaaggaatgtgtgtgtgtgtgtgtgtgtgtgtgtgtgtgtgtgtatttcacatataaaagcaggccaatgttgagcgtagtggctcccacctgtaatcccaggactttaggaggcccaggcgggtggatcataaggtcaggagttcaagaccagcctggccaaaatggtgaaaccccatctctactaaaaatataaaaattaaccgggcacagtggcaggtgcctttaatcccagctgcttgagaggctaaggcaggagaattgcttgaacttgggaggcggaggttgcagtgagccgagatcacaccactgcactccagcctgggtgacagagtgagactctgtctcaacttaaaaaagaaaaaaaaaaaaaaagcaggccaactaaaggtttgtttttgtcaactgtagtatttgggttaatcaggtaatgctgcacattctctttcaaatttagatttttatatggtaacttgtttgatatagttatcaaacaaatggggaaggtccaataatgttaaaagaacaaaatcaacaaacatcagtgaagaacttgatttgcagaaatattttaacagcaagaagcattctacagttcatttccattttgatggccattttaataacaatgctgaatgagaatgcatctcacctatgtaacagaaaatttccttgattccatttcatttaaggttttaggagtatcagctcagacactggaggagtaatcaataaacatgccaattatgtcagagaaaaattatgaatgcctgaatatttgcagccttatttctttctttctttacaaagaatatgcctacctgccttttgcacttctggtaaagatacgaggtaggcagacgtgaagatttgcaaagaactgggacagactggcaaccttcccttttggaaggcttctagcaagagattagactggatcttagaggacaaagcatgggggtacaaagacaagtttctgtggagactgagaagtaatcctggggaggaggggatacgcagaaaaagtgaaaaacacagagagaaaagagcttattaatgggaacttcttgctgttctgttagtttctttaagctcctagggtagactgaataactttttaatgcttcttaattgtttctctttacacttgacttcttgatgagacaggaccatgaaggaggccatctttattgaggttacataaccttcaatatattcaatctacttcattaatattcactgaagttacaagaaagaatgcccacaaaagaatctctttattttcctactgtcatcccttcttccactgagactctgatattttttgaaattacatgtttttttagttttttgggctcctttgagtataattgaaggaaatttctatcctgttctccattttcgctaggaaattgggagctacatgtgtaaggataatgtttattgattcttagaatgaaggatcttagattatctctcctccaacatcctcttttaaatatgaaaacatgtagggatttgctatctttacaaacaaataaaacccagatctttaggtttggtaatggaagtacctctgtttgattaggaacagctagaccttgaattctgattctcatcccttgagttgcacctttctcctcaggcatcctgctagcctttagaggtcgctgtcactctagcaggaaagggatcgagaaaggatccctactagttcactggtctcctctcccatcaccctccccctttttcattcattgccatttttccaaagagctgagtacacactaacctcaagacattttgtacttctaaccttttgcctacaacacttttcttcctcatatttccaaagattgctccctcctttcttttagaacttcactgagatctttccagattactgcatctattacttcctcttctgtcagtctctgctccttacattaccttatctttttttagcacttcacaattgaagttttatttatatgtttacttgtcttttggccgtcccttttactaaagtataatttccatgacagcaacattccttagtctagttatatgggatttagaataatgcctggaacatagtaagtgctcaatagttgtgaatgaatgaatgttcttctgttactgttgagcacaggctgcaatcactgaagattctggtaaataaggaggtggggatcgtttgatccaggaaacagtatggaatgaactatggaatatcaagacccgggattatatactggttctgacacttattagctgggtatacttaatttacttaaactctctcatctttaggactttttccatctcaaaaggggtttcaactcaaaaacaggtagtttggtggaataaaagtgaacacattaaagcatctaccacaatatcaaacatgaaggaagcttcatttaaaaattgataactatgcaatttgccttttaaaagttaatctgcttcttagaatttataattcatatcagatcttaaattgcaatttactttctatttttatatataccaagcagggccacattctggtaaatctgttctaatattttgaaaaaggcaggggattctccctcctgaccacataaagccagtttccttagaattaaattttcctgtgaggaacagaactagaaaaaactattttaagatgcatgtgtaactaaaaaagaacacgaatagccaagacaatcctaagcaaaaagaacaaagtggaggaatcatactacctgacttcaaactatactacatagctacagtaaccaaaacagcatggtactggtacaaaaacagacacataggccaatgggacagaacagagtccagaaataaggccacacacttacaactatctaatcttcaacaaagctgacaaaaacaagcaatgggaaaaggactccctattcaataaatgatgttttgataactagcttagccgtatgcagaaaattgaaactgaaccccttccttacaccatatacaaaaattaactccagatggattaaagacttaaaggtacaacctcgaagacaacctaggaaatgccattgtggaaataggaatgggcaaagatttcatgatgaagatgctaaaagcaattgcaacaaaagcaaaagttgacaaatgggatctaatttaaaattaagagcttctgcccagcaaaagagacaatcaacagagtaaacagacaacctacagaataggagaaaatattataaactgtgcatctgacaaaggtctaatattgagcatctttaagaaacttaaacaaatttacaagactaaaacaaccccattaacaagtgggcaaaggacatgaatagatccttttcaaaagaagacatacatctagccaattcaaacatatgaaaaaaagctcatcatcactgatctttagagaaatgcaaattaaaaccacaatgagatattatctcacaccagtcagaatggccattactaaaaagtcaaaatacagcagatgctggcaaggtggcagagaaaagggaacacataaactgttggtaggagtgtaagttagttcaactattgtggaaaacagtgtggcaattcttcaaagacctacgaatagaaataccattcaacccagcaatcccattcctaggtatatacccaaaggagtataaattgttctattataaagaagcatgaatttgtatgttcattgcagcactattcaaaatagcaaagtcatggaatcaacctaaatgcccatcaatgacagattagataacaaaaatgtggtacagatacatcatggaatactatgcagccataaacaagaaaagatcatgtccttttcaggaacatggatggagctggaggttattatccttagaaaagtaatgcaggaacagaaaatcaaataccacatgttctcacttataagtgggggctaaatgataagaacacatggacacatagagaggaacaacacactgtggcctctcagagagtggagggtgggaggagggagaggattaggaaaaataactaatggctactaggcttaatacctggatgatgaaataatctgcacaaccaacccccatgacacaagtttacctatgtaacaaagctgcacatgtacccctgaccttaaaataaaaattaaatttaaaaaacttaaaattggtaactatgtaattttcctttaacaagttcatctgctttttagaaattaaaattcatattgtatcttaagctacaatttactttctttttttttttttttttttttgcagttgcaagatttaatagagtgaaaacagagctcccatacaaagggagaggacccaaagtgggtagccgttgccagctggaatgactgggtttatatcctgatcattgtccctccccctgtgctctcaggcgacagatgattggctacttctttacttcctgtttttccctaattagcattttaatgagctctctttactacctgattggtcgggtgtaagctaagttacaagccccgtgtttagaggtggatgtggtcaccttcccagccaggcttagggattcttagtcagcctaggaaatccagctagtcctgtctctcatcacctgggagctttggctctttgggtggttctaaacagcatcaaggttgagaccaaggttatctttggggtctccaccccctgaaacctgcccctacttgctagttcctgccagggagacctgggtgatcagcttccctcaaagcccagggcagaagcattctggtagccccaggtgcctagagacaggcagaagggagacacttatgagtcactcctccacttcttccagagaccatactgttttgtttgtttgtttgttttttgaaagtgtcaaaaagccgtgagaacaaagcatcccctctgtgctgtgagtctgggaatctggaatagaaacagaagttctcatccccagggacacctttcctggcactgctccccagcctcctcccagctccaggctgagaagggcgtccctccccgcgtccctgcagcagccagcactgaggtcggcctccaccccagccacagtgtgctgccatgttgtgtttccgggcctgtccccgatgtcaaatcctagaggctaggcctcttacaatttactttctaactatttgtatatataacaagcaggggcaaatctggcacatctgttctcaaattttgaaaaaggaaaggggttcttcctcctgtccacataaagccagtttcttcagaatcaaattctcatgtgaggaaccaggtaattaattctagatttgagacaccttcaggagaccttctctctactccgctaaaggtctcaggatatgtccgttactaaattaggaacagttcaccaactctggttggagaattgtttcatttcatggtcgtagagaaaggaaggttgacttgattgttagctaactttcttcgagataatccaaaatggaaaaagtaaagaatggttttactttgccctttgtattacctggcaaatttgacagggtctctcatgggcattgtctacaagagtgaaacaaatgagagagctttatagtaatgtagcatatttaggtcctttcacaaagtcaacccttgttaaacagatcataattcatataaaaagaaagctctccttcttaccagtttaagttttatagtccaaaatagagcctttgaactctcttcaattctaaaatgcatcactgtgatgcctgcaattgactgtactatttctatgctggaaataaaatgagaggcatagctccaggaaaatggccctaaaaataataatttttgcatgtgcctcaataatgttaataatatctaacatttgttttgtgtctttccatggttcataaaagttattcccctgtttaccttacataatgctgcaagttactcccaatcttttattcattcaacagatatttactacatgctactctatgccagatttgggattgagtgttcagtgtaaggtcatataattctgttagttagggaaattttacattgctggtccgcttttacaatgagtaagtggtgaaactgagttgtgaaaattaagtctattatcagtaaaaagatcatatatatcaaatccttgactatccttaatttgtgaaaactacatcaaatatgactttttcctataaggaaagcttttacagattcctagatggttaaatttaattgcttctacatgttttatatctaatcattatatgccaaaaatacacattatgttcaatacaaaatatttacttctttgattatgattatttttaggtaaaaaaatgaatatgctgccaagctgcaattactatatttagaatatgtacaacttgtgactagccaaatttgcaatgatcttttagaaaataggggaaagatttccagtgcctattttaggtaagaaagccttcctgagagacttattaaatattaaatgctttattaagaaatttagagactctttatgcagatattttaaaagcctgacagatatatccaatgtcggactgaattaagttcaatcttggcttattcagctgagagggtgctttgctgttgtggagccataggacagttgtcagggtgccttccacgctggaaaatacataagcttgctaaaattgtgcaggtgcatgcatgtgtgcatgtatgtgtataatctactgcattctaggaactacattatacttgggggatacaaagataaataatgcagagaccctatactcgagagacatttaaattgttaaaaaaaggcatataaataaatgagtgagctgaggtgttccacagataccaaattagaagtgtatataatagactcacacaagaataaatgaaattgatttataatttaaaaaatatttaatgtctgctttgctatcagaaagaatattctttaagaactaggactttttctattttattcattacttagtctttcatgaatagcacaacacctgatatatagccccatgttcccaatgaattttgaatgaatttcaggcaagggtgaataaataagttgaatgaatgtattaaaaattaattaataataagttattttatgggaatttggtggggtgggaaaagcggtcaggaaatattttatgaaagtgattaagcaggaaaagagagaagccagttcagaaagaaggagcagcgtaagcagatctgggagattgtgaaaggtctcagccctttttgagaagtactgtatgtggaaagtgagatgcacacatttagatcatgacattggatggccttttgtgttaaggagtttggacgttatccgataggtgggcatgtgggtgattaaagtaaaatttacactttagaaaggtctattgacaatttgaatccatataagatacctttagtgctcactcccagtggaaaaattggtacctatctaagaaaaatatgaatttctggacagctattcaaccttctcctggggtagtctagcactaaactagtttatcactttgtttctatagcacagaagggtgggtattgtattttatagtcatttctatgcattgtttttacactaaacatcttcataggcgacgtcgttgccaagttatttatttatttttatgattgcttagattgatttatccatagatgtttacagcacaaatggtctttaacatctccttgaaaaactcagtttctaggacctggattaaatttatattgtattgattagtatgtgattcaacttacatgacagcactcttcaaattgtcacaatttcagtaccttgactcttgaattagaaaaaataccatctcaggtcattacacctgtaaatcttttacctactgaaagcaaggttttcattctagctgatgcctccagccttgttaactcatacctgcattgtaacatagagctttcactttgaaaccagaattgtatttatttctactaactgagttcactgcatcctgggaattctttcagcctctagcacaggaaatatatgcttaggaacagcatgaaggaaattgagatgtgttttcttgacctgagttggagttcagtctaagggtgcgtatgtatttgcttccttgttggagaatcctaagtgaatgctctactagaaaggatcctgatgttttacattaaaagattcctccctatctacccccacccccacccccacggggccccgatttgttttttcctagggtggttaacatgagtttcacttgaaatcagagttacacctgggattatgacttggaattctttcttgttattacttttttttctttttcaagtaggttggctaattatatttacttgtggaaatgtggggactctatgctttttttgttaaaaaaaaaaaaaaaaaggttgtgcccctgctctccaactacatttcattatagaagtaatattaagaagttattttgtctgtctacatttatttaataatttgatcacaggatattgacatgtgtattaccctcagccactctgcaggaccagtgaggtagacactaggcaatggtgaatagggcccagctcctgacctcaatcagacgagatcgggcgcgttcagggtggtatggctgtagacatcctgacctcaatcaaatcaaattctcatagtagtggagaggaacatgggaatgcattatggaaagttaatgacatttagctcatcccctattgatgaacatctataaattatgatacatcataattatgccacaatactaagcagcatttcatttatgtgtgctaatatggaaaattcttcatatataattaaggtaaacaaacaaaaccaacatactaagcaaaactaccatctttgaaattaagaaaaagaactaaataaacaaattggtagatgtatatagttatgcatttttgaaagaaatcataaaaagtggtggatttaaaagaggtatttttatttttaacctttctatagtttgaatttactaattttttacatgtcctttttccattttttaattcatttttaatatcaaaggggtatctgcactgtaagattatagtgatatttttcttccttgtacctctttctaataaaaaatttcatcttatatgtagtacatagtaatctataaatataaaatacagtatgcaaagagctgtctcagaggaaagtgcaatactctggagccaaggaggagggaggaatgaggcaggatcagaaacagttcatcctggtcaataaataagattcttctaatttcaaaggtgcttcatcttagtaactttttccttggtgctttgccttttagccacacaagtttcgctagtctgttgctacatcaaccaactgatatttcttggaagtgctggtactttccaatttcttggtgtcaaaacattgccttcattcagcaccaataatgttccagccttttccccaaaaagtgaactaaatttaactgtcagtgaaaactttatgtcccgtctacttgaaacattaactttttccacttgaaacaatagcgttacattattccccttatggggcatggttgttccttttagaaccatctttttatatagggaaggaattatcagagaattgttacaatttttttaaatgatggtgttttaatctttaaaacagagaggagatcttgagatcactatttaggccgtaatacaatttgtcaaaaggtgatttcctctatgttgtttctagtcaaatagctgttctctgcttttatcgtcactgtggggcattttctttcttgtaaggctatttcacatagcacagaattatatataaaaccaaatataagcagtaatccattactgagggataaaattaggcatgtgcatgaaaattacattttttcaacgtatgctattttttatttatttcctctttttagtgtatattccctcaccagtttttggcctaaaggataggcgtaaacatgagcctgacacttataaatataatccaggtgatttgtttattattttaaaacaagccattattagaggggcagcatacattcttttaggagaactaactggtttcctagctttcggttttaattctaacctggcccagagaaccactgtaattatatttttgtgagtactcaatctttttgccccattccaaaatgataaagtcagtcataagaactgctcaaacttcattccctattcctgctgatggtaaagagggtagaaagtaagcagttggagaaagcgttcacttagatatcaaaagaactgattgtaactttgccaccaactaccacaaattagcaagcaattcgttaaacttttatttttattttccttactgacaaaatcaagagtttgaattaagaaaattgtatagttatatggcagacaggatctatacgccattcagcatgggattttattacaactaagaattacatacctagctacgccttgcttgttattgtacacaaaacataattaaatactaaacaggatgctaagagtcaaaagaaaatgtaaccaaatagcttcctttgccatatgcaggttttctaactccaaaatataataattctgtgttgtaaccttcaagtaatttttgccatgtaaattgtggttgaaattgaaagcttgccagctctatatctagaaatacatacatacatacacacatatgcatgggggcacacacacacacacatacacacatacacactctggtaggcatcagaagtctatcatgcatagggcacatgtggaaaagaaagtggacgtttcctaacaaaaccttttgcaaacatttcagaggacttattctgcaagaccttcctggatatgacaaacaaaatagtgttttgggataagtgaaaatgattaaaggcatgggttccagcatacagttagcttcagacacttatttctagcatttttccataaatattttttgttccaaatcagtataaactacttctgtctgcatttggaaggactgtggagtgttggagcaagtacaaaagcagttctaagtttttgttgcaaggctaccagttctcaacatcaggtctagatggccccagacgttcttaaagcattttgactaaatcttagcattgcatccactttcctaatttatattttcatttaacaaacatttgattaaaacttgtttttatccagagtaagtgaccgttgacttgttttccatgtgctagttcataatttggcagttggcatggggtgggaggtggggcatatatgcaaaccattgttttaaaactctgtggaattggatgtgatttctaagctaaaggacattctatgactgtagtgctggaggttgacatccattccatgctctacgaatgcctatctatgtctctattatagcagccattgtaatcttgagttttccttttacttggctttctccccttctagactgtgaccactttgccaggagcaaagtttagagtagtgccagtattagttggtattgaatacatgtgggtcaaaaaataaataaaagatggactgtgttaaaatgctcctgagtttcattatcatccttctattagtatcatgttttcatccattagtatgaacagctttttaatgtacaagtcacccagaatatcacacgaatagtttaggaaggaggtttcatttgtttcttttcttttctttttttgaggcagagcctcgctctgttgcccaggctggaatgcagtgagctctcttgcagtgagctccgcctccccggttcacgccattctcctgcctcagcctcccgagtagctgcaactacaggcgcccgccaccacgcccggctaattttttgtatttttagtagagacggggtttcaccgtgttagccaggatgttctcgatcttctgacctcgtgatcatttgtttcattttttcaattgagaaataatttacaacctcaaaatttttctttaaaggtagctcctggatcaaaaatttataacattttaacttttagtttttgagattcttttttaaagtcctttattttgtctactcttatactaagattttataaactcaccttgaataaactgcttctgttgtcgttagcttttcttctccatccagctcctcccactcttattttttcctgaagatttggaacctatctgaaatgaggaatttttaaatttaagagttaaagtaccagaccagtaatgttatagcaataaagaaatatttaaaaccatcaccacagtccaatacaaacactagaataacttaaataaattgaatgttaaaattaaaagtggtcagcttctgtaaggaaagcaggaattctgctgtcgatatcttagatgtcaatatcttctcatcaatagcatattaaagaacattttagtgacttatcaaactgcacgtattttaaattgtaaacagaaaatcaaaatacattctcataccttaattttgataagcaaaatctttgtcattgttttgtttgcttgcttaaaacaccaaatcctataagccatctgatcattatatcagtttatgcattgtatgttgcatgtttaatacaaagtttggaagactagaaatactccactaagcaagcaaacagtaattactcctttataattactgtgcaactttattgccatgtgttgttataattatattttaaatactccccatttgcatcatagaccataatgtcttctagcacattaaagtctgtggcttataatggcatcccacttccacaaagacctcttcttcatttagtctctattttaactactgttaaaagagactacatgaaagtaattggcaccataatcctacagtaaggaaattgtaagcaatatactatttctgtgctactgaagtctctaattattcagagtatttcatgtttaacatttaatatgcattcctctttcagttatggagccagtcataaccaaaacagttcttctcaaatcttaacatacacagaaatcacctggggatctggttaaaatatagattttgatatagttggtctggaaacgggcccaagagtctacatttctaacaagctcccaggtgatgagtccagtgctgctgggttcattgaccttactgtgagtaacatcactttcatgtattatctataactaagtgcaaaatgctgttaagtgtgcacacacacatacacattgcacacatacatacacacggcaaacttcactccaacctctcctatgatcagtttctaccctcagacctagaaataaattaatcctgtcaaaggatttatttaacacaaagagaaacagcattcaacctgtgaaagctggccaaatacacactagataatatcactctgagctgggagtcaaagagggcttccttgtcatttgccagatggaggggtgtgtgtgtgcatgtgtggtgggggcagttcggaaaagaaattccaggcagggaggaactgcccttagaagtgacgagagtgaaattagctaagtgtggcggcgtgtgcctatagtcccagatactcaggaggatgaggcaggagaatcacttgaacccaggaggcgcaggctgaagtgagctgagatccaagatcaagccactgcactccagcctgggagacagagcaagtctctgtctcaaaaaagaaaaaagaaaaaaaaaaaaaaggaagtgacagagtgtaaactattcagggatggaaggatactaataaagatatgatgaaggggaaaaattcttattttctaatcaaagaatttggattttatcttaaaggtatttaggaattacctaagaacaagacgattatgtgaattttagttcacctattctactaatgttttctctgccactctcaatgaaatatttctctttaggaaattaatctgaatttgactcctgaaatttaaggataatatggaaatatattcattgtttttgaaatagcacatttgaaaatgtacttggacacaggaaggggaacatcaaacaccggagcctgttgtggggtggggggagagggggagggatagcattaggagatacacctaatgtaaatgacgagttaatgggtgcagcacaccaacatggcacatgtatacatatgtatacatatgtaacaaacctgcacattgtgcacatgtaccctagaacttaaagtataataataaaaagaaaatgtatttctggaatttttttaaatgtatctagtaaaacattgtggctgtatctgtcttccattataatcatcttaaaattaacagtatataatcatcttaaaattaatagaatcagatgttttaacttagcaatgtcagtaaatataaataggtcattatcaatattcatagcctaactgcttatacagatcccccaaatatcagggtggctaaatttttagacctttaaaaaaattgtaaaatttatgaagacagtgcacaaagagatcttagttgaaagctaagaaaatctcaccctatgacttttaaattttctcttagtgttaaaaacaactatttgaaagttctctttacaataagggaaaatgttaaggtaggcttaaaatccagaatctcatactctttatatatttgatccttggcaatctagaacattgttatttggtaatatttgtttaagggatacctctgctaaatgtttttatgccagtcggtagaagaaatattagtgtaaataactcatttagagaattttattttatttatttaatacaaatgtttaaataagggaattgggaaagacctgcctttttggaatgtaattatagatacgtaattgttttagggagaggtaacaaaaggtagagatggtctcttttaatgaggaaagattttctggaacttagctttagcaacagtaattatttaacattttaatatgggatctggaaaagggaaaccccagtgaaatctattactatgtagatggctcaatagtttttctagtagtaaaatacaaccctgatggatttaaactgccagcagaacttttgcaattgagtggcaaggtaatagtaatagtactaatgatcagaaacaacagcaaaggaacagagagcattcatcataggcaattggaggttaacgcagataataataacataacatgcatcatacctaggagataatgaaagccaaattctggcaatgactcaggaaagggacctagtgctgtagtggccagatgacccaatgacaagctatagcaaacaagaaccattttagaaacacagatcttttccatcaacacatctttttgttgttgttgttgttgaagatagttgcaagttctgtatgttgacgaagcctctatggagttaaaatggaacagaactgatgaaaataaagcttaaacgttccaaactctctgacactgacacatgaccgggtttcacagttgggaactgggaagtggctgacagagattctaatcagtaataatctttgcagcaaacagattcagtatttatttagatataatacattctttaaaaaaaactttcacaatagctctatgaagtatttaacattatttccccattttatacataagaaaaatgagtcacagaaatgtaaaagaaaggaaggaaggaagggaagggaagggaagggaagggaaagggaaggggaaggggaagagaaggagggagggaggaaggagggaaggaaggaggaagagagagagaggaaggaaggaagagagagagaggaaggagggaaggaaggaagaaaggaaggaagggagggagggaggaaggaaggaagggaagggaaaggaaggggaaggggaaggagaaggagggagggaggaaggagggaaggaaggaaggaagagagagacgaaggaaggaagaaaggaagggagggagggagggaggaaggaaggaaggaaggaaggaaggaaatttgcctagtattttgtagctagcaagtaagggagccagacttcaaacccaggaagctggcacccttaacaattaagtgcccccaaagtatgtgttaaagcctatggaaatatgagcctatagaaactacctaaagagaagtcatactctagactattagaaccagggactatcctataaaccttataagaaccattgttaggggaccataaacaaccctgcttcaaagagtagaaatatgtttcataaaagccattacccaaagacgtataaaaggtaaaacttaaataaaaatagattaccatttacaacttggaaaagaaacccagaattttctgtagccactggtcaatgtgttcttacagccgtaaggcagaataaaaatctggaaattatcagagaaggttttaagaacaaaataagcaagttggtctctttttaaatataaatctgacattaacagaagccttatgatattaagggaaaactggtatgggaactaaggaagggagtgaaaacatgctcctcacctatgaattagacatccaagaggacaatcaagttcgatctcatgccatattgggtcactgatggcccatcatgcatggactgtaggactcacaaataaatctggacacaaaagttcttatgtatgggccaattctgcttatatggacacagtgcaaacaggtacgacaagatattttcttcctcaaggatgatacctagcagataaagactgatttctaattcagtattgttacaactgcaggtgtgtgacccgtagcgagccactaaaccattctgaatctcacttccttcactggtaaaatagggaaaaatattagttgcctcatagagttgtagtaaagattaaatgaatgatctatgtaaaatggaagtgcttgataaactttagtctattattaacaccaaatactaaaaaaaaaaaaaaaaaaaaaaattcctcttcttggataacattccttggttaaaaaaagactatatttgagtagaaagaagcttctgactgttaagggtgatggatatgttcattatcttgacaatggtgatggtcacataggcatatgcatatatcaacactgacaaattgtatattgggaatatgtacagtttattttatgtcagttgactcaataaagctgttaaaaacaaacaacaaaaacttacctgtgggtgtaatgtgtgtgtctgtgaatgtagttgctaggaaaatttcttacctaacagaggcacacaaagctgccatccctcctcacaagaaattggaaccagtttctttacagcaagaaatgtaaggtgcttctagatttaccttttgtgagaaatttgtaccactgacagtgatgaactcatatgtcagcatgaccatcccattttaatacctgtatgtacctgaatctttaaaatggcaagagagaaaatatagagcaggatgagtttacatgtgatataaatacatagttttggaatctcacaggaaattatgttactcagagaatattgggatgcaatgattgcatttagcatttaggtttttcatctggaatcagaatttacagtacttataacataaagaattaggaatcagaatttacagtacttctaacataaaggcagtgactatctacagatattccatgatgcagtctctcttgtgtgattttcctggcttcacccaagtcactgaagtcagaggctcatcagagcagtcagtgtgaaaaaccacttgtgttcagtgaggcaatgatatttattgaatgctctctctatacagaactgtgtgctctgtatagggcagaaatgacattttgtttcttatttctcttggtcaatggtgacccctgtctctttgagtcattccctccagtactgataaacagagttgctgctaatagtgagctaaaaggatttgacaaaatatgactcccccttagagccaaatgattttcaaatatttatttttaggtacctgtttgattgtactctttttccactgttgattttggaaacaattttgaaattctcattaattccttaaaaatgtttaactttacccagataagtaaatgcaaggaatctagctggggtgggaatgggggagaatgggtgttggggaagttgtcagttatctattaagacaataatgccacatatcaattgtaacatcttagtggcatgaaacaataaagatttctttagcttacacattggtgtggtgggctcagtttatatcacctaggcttatatatttttttctgttgtgaactgcaagttaactctgtaccactaccgatcttggatgtgcgggttcacatgtctgggtggtggctggcattggatgatctagtatggccttggctggaatgttagcatgttaaggatgacgtacctttattcgcatctcatcctccagcaggctaacctgggcatgttcacatatccatgcagaggagcaaaagaagcaactctcaatacttaaacccatttcaagctcctggtcatgtctcatttgctaacatcccattggccaaagcaatcacatggggtcagacctagagtcagaatgagagggctccacaatattatatagcaagaggcaaggacacaggaattggtcaagaattagggcctttagtatcattaatctttagtaaaacatacttttcctaatgagtaacagttgtgcagggtggtcattttggttttcagactgtaaactgacaaattaatatttggttaattcaagcagataaactaagaaattaaccttcccagccatattaatgtattaaaaaagtttgtcaggccactttggctttcattttattcattcatttaaaaatatatttattgtgataacaagcagcaattttccagtcaagcagggatgtgaaggagaacatcagttctcaaagaataattttgccctgttgggttttaaaagattgtcattttccaatgtaattgttggaagagaagttcagacatcagttttggtcactttctcttgggaaatacatttacctgagtcatgtaggaccacatcaagcaatctgggactcacaagttatagccatatcctttggctatatttttatcatgtgggttcacttaacattataataattgttctccctgggattctgactagattttactggaaaattggagtgaagagtgttgggtggagcatcagcttctagccatttagaaattacaggggactaattttttaaaagctaatttgattgcagttagcaaaatgtctctcttttgagaaagaagctcctaatcatctttccaaaattgaatccttcagtttctacagtgcaaacacggttgctttgaggaagaaatatttatccacatataaataccgattatgaacacgtttctgacattactggaagggtcggtgcttgcctctttacttctaaaacaaattcacattctgcttcaactgattattttttcaacaatatttgttatattcttttatgatctgccagtacttttttgaagcccagttagttagaacagcggccaacagagctgagactaaaagggggccaaatatctcttcagaagcaagatgttacttcaaaagatactcattacaaagcactactgtgactcacataatcacttagtttttaagggggagttgttaatgtagaattggtttcttatcttcccagcccccagtgagcctttgctgtgcaaattcgctgatggaggacaaaagaagcgacagaatcaaagcaaatatacccagaatgggaggccttggcccagggaaggagaggtgagtcctgactgataacatttgctctgaaatttggcagtagatatccctcagaaggtggcaaggcagacgtatggtgccatgatgaaattgggtcccatggaacacccaatgtcttcaaaggggcaaatgagcagacccatgttaatgtgttctagatgaaattattgaggagtagaggatttcaaatttaacctcagttctgcactacagcaagtcttctgtctttaaccaaactcaaacctgaaaggaactcactgaaatacttatctacaaagaattgatttctatttgtgtaatagctataaaatgagggtataattacttaacaaaatattttcagtgaaatcaatagggaaagttgaatgtttgtgttttgaaacaggcagacaaaatttggctgtttttcattctgttattgagatgatttacttgcacatgtatgtatatttatgcatattcccatatgttcataaatgttttgatatctgtttatatatgtatatacacacacacacacacatatataaaataagatattgtcttggtcaaaaaagagggagaaaagttgatacatacagcattttgcttttcacaaggagaaggaaaagcactgaacagctcactatccatttaccctcaatacaaactggtaaaaaagccagtttatggatccagtgccacttaggaatgggttctttttgttacttttttgtaagaagacaaggaaaaggtgactgagcttccatgaggtcttttcattatttgtgaaatggaatagagttgtttgaatgacttgaaaaaatgctattttgtaccaaggccatactttcaagagaagagctttatttagtatttcattcaaagcacctacttcatccatttatcatttaagaagcattgtacttgatgtagcattttacactttcaatactgacagaacagtggtaaagaagaaaggaagctggaatttttctcagcaaatcctttagccttttttcagtttctgtttctaagaccattgtttgctttgagtgtttccatgcaggtctcaaaacccctcttaaaggttatagttatgttcaagtactatataaactgtaactcattacattaagacatgaaaaacagaatcatcactgagcatcaaaagctaataaaaaagataaagagttttaatattctcaactttagaaaggcagtgggtattacgttctaaaaaggaggtggagggggtgatccatgtgtttttagcatggagtccagtgcatcagcagataaccctattggcctcagaagacaactgatgcctgatagcactcattatcacatgtcccctaccaaacacccattatctaaaaagactcatttgacattttaaaatttggttggataaaatgcctgctgattagagatatctttgggtcacagactatcatcacaaagccccaagactcaattagcaacttggcattaatgacagaagattcagtttctgtctccttaaggaactataatattaccttcatacaatagatggcaattgcagcaagacacttcctctcactgtacatttcttgaaaatggaatcaataaagacaaaatgtagagagttacagctgccacctggctactgtatatagaatctaagactttgcttcaaagcatgaaaaatgctatatgtactatgatgtggaagcactgtggagttgagtttaggacccagagcaccttataatttaaacgtaggttttaaaggtatattcctaatctttgttttcaaaagttgatttttaagagctataaattttcctgttgatctatgaaaatcaagggaccatgataaaatttatctgtgaccaataaaatatatttcaaatatatatacacattgagagaagatagattaggcagagagatagcatgccctagaaatatgcttatcaaattttttggtttggggatgcacatattaatttgtacactttgattgtggtcttagaagtaaatacccaaagaatgttggataactgtgtgcccatcactttatattttttgcttccatttcccccttgcattttacttgctaaagtatattagcaagttgataaagttgtcatgatacacattaatcctatataagcaatatttaattaattttatatgccaggaaattctggttactgtatttgattctaagacacatgtttttgttgttgctgttttccacactttaaagcttctgaaattggttctcttagactaagtggtattttacaagataatatgcattttctcctgttaatcacttgagggcactacctacattgtcgggttaaggtctttgaccacactggtttcataaataaaagcactaaccaaagccaggatctgggtcagattcttaagggagggttttttgtttgtttgtttgtttgtttgaccccttccttcattcagtgtcatgactgagacaagtaactttctttggtgtctgtttttaatgtgtagttttgtttttcatttaccattatactaaggttggcaaaccaactttataaagagatcatttggggtgtttgtttttgcttgtttgtttgttttgatatatgaaacaatggtacacctttgaatccttttcttagataaaatgaaagatggtagtttagattatgctgctgtggaattgaagataatagcacagactgaggctaatgtttacttttcctctctcctaaaagatgagtaaaaatggtcatgtgaaagggatttctgacgaaattcttaggatacaaaaccaatagattacaagtattttagaagtaccatgagcatgccaattgatagactaattaaaattttaatttactgtttaaagctgttttttcctcatggcattttgataaaaattttattagcaaagtttggctaaatgcacttctttatgaaaaaatctaatacagaaaacttcatacacagaaattagtataaattagcaagattttgaaatataaatatatgctagtggccatgttctacataagtgaaaaatgcaggaatattttaaaattattaactaatctttcaagagacaattggaactctgaataaaatgatcgagggatgggggctattaggctcttcttccttggtgttctacagttcttattgttttatttccttaagtagctgttctcaaactcttggtctctggatccctttatactcttaaaaattattacttacaacaaaataaataataacagaaattaactcatcatgtgctaataaaaacagtatattttattaaaatatattttttaaaacaaaggcaattttttgagaaaagtggtggacttttctatttttacaaatcgctttaatgtctggctcagtaaaaaatggccagatttgtgcatgtacttcagcattctctctttttctatactctgtcttgctttaaacatgtagagaaaaatctaccttcatctagataagtcatttaaaaagggagaaccctatagatcttctaatacgatcttaggaattcttggtcttcaggccacactttgagaaccactgtcctaaagaagctgaagccaagggcaaggctgatgttcacttccatatactagaaggaccatgcaacttgttggtatattaaaatatatcttatcatttggtaaatagacactgcccctaggccatcagtgcaactccacttccccttcctccccggtgcctcctccaggagcatcatgatccagcaagaatggggtactggctggcacagcaggatttttatacatgatgtaagggaggggtccagcttcaattttctgcatatggtgagccagttatcccaacaccatttattgaatagggggtcttttccccattgcttttgtcagttttgttgaagatcaaatagtcataggtatgcaaccttgtttctgggctctctattctgttccgttggtctatgtgcctatgtgtttttgtagcagcaccatgctcttttggttactatagccccgtggtatagtttgaagtcaggtaacatgatgcctccaactttgttctttctgcttaggattgccttggctattcaggctctttttttgttccatatgaattttaaaatagtttttttctagttctgtgaataatgtcattagtagtttgataggaatagcattgaaattgctttgggcagtatgaccattttaatgatattgagtcttcctatccatgaatatgggatatttttctatctgtttgtgtcttctgtgatttctttgcatagtgttttgtaattctcatcatagagacctttcacctccctagttagctgtatttctaggtattttattctttttgtggcaatcgtgaatgggattgccttcctgatttggctctcgacttggctgcagttggtctataggaatgctagtgatttttgtacgttgattttgtatcctgaaactctgctgaggttgtttatcagctgaaggagcttttgggctgagactatgggatttttttagatgtagaatcatgttgtctgcaaacagggatagtttgacttatcttcctatttggatgccctttatttctttctcttgcctgattgctctggctaggacttccaatactgtgttgaatagaagtgttgagagagggcatccttgtctggtactggtttttgagacgaatgcttctggcttttgcccattcagtatgatgttgactatgggtttttcataaatggctcttattattttgagctatgttccttcaaaaccttgtttattgagagtttttaagatgaagcaatgttgaaatttattgaaattcttttctgtatcatttgagataatcaagtgttttttgtctttagttctgtttatgtgattaattgcatttattaattgtcatgtgttgaaccaaccctgcatgccagtgatgaagcctacttgatcatggccttttttacagcatttggctgtcactagctgttattaatgctaatgtaaagtatgtgcttttgggcattcttagaagtgagggacagaagacacactccgtaaaatagcccccttgtctttagttgaatctgctcttaatggtgcatccagctcattaaacatttgaccagtcaccagtcagcatacttataaatatgaaaacttgacaatgcagtctgggaacacaacatttctattagctttgaaggcatatggggtgcaattgaattttataatactgaagagtggaaacttgacatttcagagacatagaattaaaccactggagataaaaataaggagaaactgaagcacaattcctagaaaatagtatatctaaagaattatttggaaaacctggtaataccgtctaggcttagaatatcttagatcattttccaaggtaagggcatcatctacatagtttatcactattttctttgtttataccacagtgcttggcaattcgttgtccaaatttttatgtttaagatgaccttgaaaaaaattaagatatgtctaccaacactgccaggttctgcaaatagtctttttaaccttaaactgaaggagattatttacatatgtgatcttgaaaagagtttttggccattatgatgcatgttagcacttgcaagttggttttcgtaattagcacaccagatatggttgtatttattttatgtgctttatctgcaatttagagagcaagctcaaggttaatggaacttctagtcttaaaataaaccttttttttggcacaagaatttgaattctcaataattcagcatgaaaactttcttatttagttaagtgttctattttaaaggtactaagcccaatatttactaacctatgatcactaaggataaaaggtaagtcatgtaaatccctgtactagtgtaagtttggattaatgtaattggtgatgagcttcagtcctctgcctagcctatgttctcaaggaatagggcagtataacatacttaggttcttagggcggggttggcagtgggaaatttaggaagggcttaaggctgggaagattacagcaagtaattacaagtggaaaagttggcaggaaatatccatgtaccatgattgggtctcctgacccattctccatggatcaagacaactatatgtggcacctaccaactgggagatttctggagttgttggtagtgtcctggccatcccagcctgccacaagattcagaattacccccactaatgtttaagcaacagtttacaacctccaggtaacatcaaactataactggaacctgaaagaatatgggtcaattagccaaattcctggaactctcctctatctagctgcccaggctcatcttagtagcaatctcaaagttgtatatttttcatcctacttaaccatgttatggtggggtttaacagtataggtactacatcattgactataagacaccattgattaaagatgaaatattactttaaacaccactaataaaagaaaaggaacttgacatactataaaatgctatcaattatcatttaaatcccaatttcacagatattaaaatgtgaaaaaaaaaacctgcatcttggaatctatgaaattcagccatttaaattgagataaaaacagatgaacctacataaaatatggtaacactgttttgtcttttttatggtatcaattaaggattaatttaactttggttttaatgacaaactcagattaaaacttttttttccaagattttgagatctttagatagctatattatattatacttttcttctgcttctcgtttagcctagcattttctgtgccatagtctttctcaggcttccagtcttagttctgatggcatctttctatcttgtccttctttattgccatatagggaaaaattctgcctgatagcactacgttagcaaaagccaaaaagaagaaagactgtgacgatatagtgcatgtaaataacaatattaagacccctttgatgttcttttctcaaacataaagaagttaattttctctgttctctgaccatttagctacatttaaaggataaatcccctgcatgttattggcttgatttttgaaaaacttcttgaagctgtcaaaaggacttttaatagtttttctcttatcctgattctaggccagtaatttcatgaagaagggcctccaggttttcagcttattctaattcctcctaggttcctgcctgtaatttggtttgagcccacatcatcaggaaggtctcttagcaatctcagtaataagcttgcttccctctatctctttgaccaatcaaaggctaaaaaaaattatctttagaagttcagctaagtcaagctgcagcttttccaaagtaaattttactaacaaaataggaaaaaaaaagcttcaaaatattttcaaataaaaattaaaagttcaaattcaaacatttctttaggtgaattattcatgtattaattcatttagctaacatttatagagcctctgcaatgtcccaaacactgggctagaaagaggcgatatcaagatgagcatgactagctgggagacacacatggcaaagcatggtcatattagcttccaccatgggtcatgggaggaggacaaaggcaatagttaatgccttcagtggcacctggagaaagagctggctttaagaggctatgacatcttatctgaggctgaaagaatagaatagaaatattcccacagaaagtaatggagaatttccagccaaaaaccacccctgcgaaggcccaggggtaatgctccagggcaaggcgagtgtatgtctgagtttggtaaagggtgaagtctagaggtgaaaaaaaaaagatgtggagaccaacaggtacaaaggcacttgatcatgagatttctatgggccagattttatcttaaggtaacaggatgctgctgaaaggaggaccataatgtggtcagatttgcctctcacaagagcaatcctcataacacaatggtgtgactgatggattggaaagaggttttgagcaaatataggagaagatattataccaacatatactcataaacaccgaaacaagagatgataacttgtaagaaggcagtaatcatgcattgaacttactagttaaacttgatgatatgtgtctggaattcaggatacaaacttgactttgagacaaacatttgggaatcaccaggaaataaataatagttgggataagaaagtgaatgtcaccactgtattgcagtaaaggagagagataaaaccctggccccctgagcactctggcatctcataggcagttgggtcaagtaacactaaagaagaaattgctttctgagaggtcagaacaaaaataaggggagaggatcacagaaaccaaagaagaaaaatacactggtcaaatgatgcaaatgaatgtaattattatttggaatcaaagtattccttggattcagaaattatgaaaatttaaagagtatagtgaggaccatttcacaggttgcttgcagccttttgtagaaccattagcccagattttactgtcttatctcagactgcatagaccttgggaatttccctatttatgatcttatttgtagttcatcttctcttcaagagagcaaataactgcacagtagcctaaggagcatccctttagcaggtgagagcagataactactgtacagggttgactgcctctcctggtagaaacaaaccattcagtagtctcctgactgtgccggagttgttccccggtaaaattctaccacttgactcttatgaaggtcagaaggtgatctgctcatatcccctttcagcaagtgaactaataaattgccctcagttttgctctaggcatattttttccgagaatagtttctcccttgacaggaagaaggttaaaaactctttctctggccaaaatattggcttaatgttggccatctagtaccgtggtcctcatcattcttggcattaggaactggttttgtagaagataagttttccgttgacaggggtgttggggagggggttggtttcagggtgaagctcttccacctcagatcgtcaggcattagttagattctcaaaaggagtgtgcaacctagatccctgtaatgtgcagttcacaatagggttcccaatccaatgagaatcgaatgcccctctgaaatgacaggaagcggatctcaggcggtagtgctcgcttgcctgctgctcacctcctgctgtgcagcccggttcctaacaggccatggatggctactggtttgcggccccagggttggagacccctgatctagtaggtttctgatcattgatgatttttattggtttctctgaatatcttagttatatacacttttagtatcacataggagaccctcaatttctcagccagggtgtagccatttgaatttctgaattcttagtggtttccactactagaaacactatatcatttcccctgaattttctttctttattactgacctcctgcccattctcaccttgacccttctggttgtagcaatcccattctgtcctacttttgtattctactgacccagcaaagctaaatgcaccctgacattttcaagcttacttctgaatcaggcctctgacctacattactttcataaatgatatgcccttttttccctcttaaaaattttaagacaagtcatagaagacataatatgctttataaattaaaggatcccctcaccccacattatggaaatagtattacaaagaacttttaaaactcaaaagtcatgcctgtaattccagtgctttgggaggcaaaagcaggaggatcacttgaggccaggagtttgaaaacaacttgggtaacacagtgagaccccatctctacaaaaaaaaatttaaataaaattagctgggcttaatggtgcacaccagtagtcccagctactgaggaggctgaggcaggaggattgctagagcccaggagtttgaagttacagtgagctatactgtactccaacctgggcaacagagtgagaacctgtgtctaaaatatttaaagtaaaaataaaaataagtcaaaacaatgcatgaaaggcaaaaaaaaaagttattgttatactacgccagtattttaacattttgttgaaattcatttttagttttatttccagtcagagatacttaaaatatttgctttcaacacatattgtacacataattttgtatcgtgacttgttcactaaaggtttctaagtagaaatactagcaaataaatatgagcaaagttaagtgaaattttacttcagtagcagtacctagatgtttatgtcatcataattttaagcccctttttatacataatttttaattaacttattttttattgaatttttaatcttaacaagtgaacagttgtaaatattgttaaaattggctgcaagaaataaacactttaaatataacatccagaaaacaatattatatttgtgtgtattagcttcttggactcaacttgtgctaattcagtatacaatatttaataaaatattcaacattttctatacatttattaaagtgttgttttaattatgattgtagaagactataaatctttataattatttgtttgtaatttacccaattatgtatcaggccagacctcaagaaaaggagaaatattaggctaaaatatcaatgttttatttgtccaggaacttcagtctgtatcagtttgtataaattttgctgcccccaattttttgatccccatttatcttgcagtctaaaaatactttcaacaatggttaaaaaaaaaaaataattcaggccatcatcattttggctttgttacagtcaatgattctctgctcctcaactaagaccaagcattgcagtctaggtaatctttctgaagtagcaatgcctggttcctaatgtgtactctttaagcagtatttccacaattattacctcttgatataatgtaatcatttacagttaagaatatcaaataactatctcctaagtcaactgatttgtctcaatgaatttattaaaaataaagatgcatttgttaataataaaaatcccctaattattccaatataccattgaaaatcttttcttctaaaatatttagctcctatagtaaaaatcctgtctggaagatctaaagtgtcctattttggctgaaatactaaattaaaacttaactgttgttgaaaaatgacaaaaataccccactttattttaaataaactatgaatgtctctattacacaaacaatggaaacctgaaaaatggaaaatatttctgaatctaataactcctttttgaaaataagtgacaattaaacatcacttttctacatacatggtgtgacattttcattttgttccaaggtattttactttttgtgtgattcttgagtttgtaaacatgccataatatttagtgattgtataatgatgatttcatggtcctagcttagtataaaggtagctcaacagagcagcaaaatcaatttccttttttcctttgtggaaagagacaaaaggaaattgaatgcaaagtttgcattaagaccatattagaattatgactcaacaatctattacacatgaagtggaaaccaggtgtatccaagtgttagttattgtgctattatattcagccaatgggttaagttcaaacaaccctttgcttaacccatgccatgttgttacccacaatgttccaaatgcatatgacctgacactatctcttgttgtctcctcttgccaaaggtactcagaggcaggactgtccctaggcaaaatcgtgaagtaggtgaatcttgtattcattcccgacccttttgcaatgaaaatctcaccttagattctctccacctccctctcccaaggtacctactctagttactcattcctctggatttaccctctgttttccagggagctcatgctaactcctgttccccaatcactctttaagtatataatgtccccgctctgaaatactcagtagctcccccaagaggagctgggcaatcaagatcctccatccttaccttttgagtcttatttcccactctcccctttacatgttctactgaaaacagctcactcacctttccatttttatttacacacctttttccatagtactcctttttgcctgagctggccttgacctctcatctccatctgtggaaattctcctcatctttcagggctctgctcagctgtacttccctacatgccttatctgatcacccccagcctctctcatctgcaccccatccataccactcatatggcacttaacacatattgctttgtattataatatttatgtatgtgtcttgtctccaggcactgtgctgggcgctttacaaacgtaatctcttttaaatttcacaacaatctgatgaggtaggtattattaaaccatttaaaaattgaggaaactcaggctcaaataggttaaataatttgcccaaagtcacactgctacaaagtaacagagctagaacttgaactcaggtctgtcttatttcaaaacatgatttccactgtaccctactgatgtcaattcctttccatcttctgaaagataggatgggggtttaagatgaagaaggaggtcaacatagattttttccttaacaaatgtgtgttgaagaaagacagtttattgataattactgtattcctagctagaattgattggttagctagaatctatgaggaattcaagtaaaatgcaagaaaaaattcttaagtggccagaacaaacaagcatggcataaaaagaatgttcaagacagtttgtaattcaggaggggctagatagcattggtctctttgagcaccgtaggaaaataagtacaaggaaaaagaaataaatgtgcagttgactagggaaggcttcctataagtccccaggacttaaacaatttgagataattagtagactgaatatatgactatcatcctaaatctctcatgcactaataatatctcgattgaatgtaaagcccacctgttttattctgcctgcagtgccgcatcttggataaattaggggagagaagcttagtgttcctaagagggaaatctaattccaaatggacagcttttacgactgccctttcctgtgcctgagaccagagagtttcagctaagtcctagacagctccattctgtgttcagcctaaggccaacctccagccagtcatgtggcagagccttcatcctgggaagaatttaaacttagaatctttgttcatcttgacaccactatcttcttgcctctcccatggcaaaaaaacaaaaaccttttttcttttctgctgtcgtattctattctcatttctcagtcccccagcttgtcatattatcagttgcatatttctttaacatgaatgagattcataaatttaaagaggtcatgcagttatcattaaacatgtgttctcagtgcacctctgttaacttctgacagtcatttcaattctgtttgcaaactccgtttcaatttatgtatgctccctttataccaattccattcacatgtgactctacacttttgttcctcataccaatcttcataataatttaaaatttagtatttatggaaatactgcatgcaatctaagcttgaaagcagcaggctatactgtacatcaggccctctgttagaagattgagaattttcatgtcaattataagctaaatttgaggatttcaatgagcccaacaagaaaaccatcctcaaccacaatggaaaaataaaaaaactcaaacaggcaaggtattttgttttctttaaaatgtctatggtttcttatcctttacaaaactcttcatagctcatccactttttttctaactttttattttgaagaatttatagactcacaggaagttacaaaataaatgtacagtgatgtcctgtttaccttttactaagtttctcccaattgttatattttaagtaattatagtacactatcaaagccaggacattgatgttgatctaattcagttttaaattcgaaaaaagaaaaaaaaatctaccctaaagataacttacttgaacagttttaaattccattcaacattgtaagcattgtaagtattaaccatgctgacagtcctggtaaacaaaggatggtatgcccatatggccacagagaaactttccccatattgttggatattgatactcaggtctaatttaattcttgggccaatgtcatagctgaggaatggaaaggagcccatatcagaagacttgggttgaaatctggttctgcctccaaatgtgtgaccttgagcaagtcacttgacctttccaagcttcagtgtcttcatctataaaatggagaaaatactcctcctgcctacttcataggattgttgtgaggatcaaatgtgatgatgtacatgaaggaacaaggtagactgtgaatcagcactcatgaagtttatattcttttcagaaactatatccagttatagagaagtgtactttttcagaggtggtcttattcctaaaaacaaaacataactacctccttattagccatgtgttctagaattttcttcatatgtaaatgacctcccctttctatcactcttgttaagataagaaatagcaatatatcaaacaagcactctggactcattacctacaaaccccttaggcatatggtctatttttaaataaatacttttttaaacattttcttctttaagattgaatgcatttttagtagcttttatttttatcctaactgcaggattcgttcttacttttttatcatgccatgagatgtacaataggtgttcttgacaatagtgtgaaattataacaatgtgaggttagacagtggatgttttaagaagtaaaaatggaaatcatccaagctgcattgtttcttggtatgtctgaatatataatataaactcccaactcactggtatattctggtttgtggatagtaaaaatgctagtcttggcagtaagcatagagatatacataggagaaaataaacttagatcatggaaagtaatgataagagtctttgtgtgtactaaatgttttgggcaccacaataaaaacgttaagatttgttttcttccctcttcatcctatatacaggctggcatggctttgacctatgaccccacagctgccatacagaatgggtaagtagatcacattttctctattttaattgtgaatagatctttgagctctgaatcaacatcaaagaaaaatgttaaaatttgttttgcttttgttttacatccttaaacacaaagtttaaaccaagcatttttcatcattatagtttttttcatcctataaattattctgacctcccattactcacaatgcctgctgcccacattaaaccctgttctctctctatctctctctctctctctctctctctctctctctctctctctccccgctccctccctccctccnnnnnnnnnnnnnnnnnnnnatttgttttatatgaaagtgtgagtaagaatttctcgaggggaaaagaaagaacgcgtggagaaaagcgcggacccacaataaatggaatattttttggccgccccaaaagaaggggtggggggggcgaggcgcccccccccaagaagaggggagcgggcgcgctctcccaagggaggggaggaccgcgggacccaagccgcgaaaaaaaagtgttaaaatgggtggagagggcgcccccatatccaaatgtttaaacccgggtttttgtcggggagggaggggaaccggaaaggagaggggggccaccctgtggcggagagccggggagacacaggaggcgggtttgggtgcggaaaacaaagcaacggcgggccggcggaggcggggcacaccgccggctaccagccctccctccctctttctctgtctttggagaacaggtaaagctaggctgagagaataataactctagagttagctttcaaacactttttggtgtgtgcccaagtcaatttattctttctttctggtgatcaggggaatggtaatggaggaaagtcaagttggtaactcaggtgattgcatcttcattttcataagcatctggaaatttgtatccacctacttagaacaagtcatatagcttaaacttcctcctctgaaaaacaagtgtgaaactacatggtgtggcaactctaaaattctgtgacttctaaatatctttcattgaaactttcttcttacttcctaatgtctttgcttaggctgtcttgtaattgacaataattattctttggttggttgcttatttcctgtcactgtcttttattttggaattctccaaggctttcagttgtctgtctttcagtctcattataaaagcctcattgaagatcaacatagagggtagaatgaattaaacttcattttctattttgtcagttgcctctaaagaaaatctgtgggatattgaaagtatttaaataattacctcttattcttatattattcattcaggcagtcatatagtcagtcattcaacaaacatccagtaagtatcccaggcacaatgctatgttctatagatttaaaaaaacaatgtatgatatgagaccctttccttcaagaggctcacaatctactcgtccatgaaaaagtaaacattaatggtagactagggtaggagtatagtcctttgtccttgggttgattaaaatttccctctagaagtgaaaattaaggatatcttttcatatatccaataggcatttacttatttccaacaaaattctataaactgggtgtgtagaaagaagtaaagatatggagaagaaagtcctctagaattatattacgtagttggagataaataattaactcacaaaggaaaaaataaggcattatatattaagtgatagtgactgaaaatagatgttataatggaaaggaatgacatttattgaacacatattttgtgcaaagtactttgtaatttagtggcacatggtttcaaatgaatacatgtgattacaattataaatttatattggaaatttatacaaaggaaaatagaaacaatagttcaaaaaatacctgtatgtccagtaattggattcaataaatattcatattttataatattttacatgcatgcatatgtatgcacatgtgtgtaatatatacatatgtatctacctatctagagtatgtattatgtatgtatatacatatctacctgtctatagtatttatctatgtatctacttgtgaaaagtaccttgttgcccaaggctctatgccaaggattggggatgcagcagtgacccagacataacttgtttttgcatttatgaaacttacattgttaaggatagaaataaaataaaaattagcttttatatataattatgtagtcaattattaaaattgtgtttagcatttttaattaaaaagatagtttttgctggaccatatcaaagtaaaatttaaacatcataatatttctaacttcttacatcttcgaaaataaagacattagtcacatgataaaaatgtcatcacaaaaaataaaatcagtagtaatttcaaaatatcatctactatccagattatttttcaactttgctcagttgccccaaaatgtattttacagctggatgattccgaagcaaaatcaaaaagtcatatcaaaatagcttatatggattatttcatttatttattatattcttttgggtgagtgttaatatcccatttacagataagaaaatgaggccatgtagtccgaggtagagctgggaatcgaatgccagtctgtaacactaaatagagcctgctgtctttgtccagctaggacaaagggaaggctatatggaagcaatgagatttggcatagattatccaggatgacttagtttatcaaggatagacatagggaaagatgcttatggagaaagtggactgctatgaatggaagtggaatttgtagagattaacaagccaacaagttttactggggtgaaagtttcttgtgaaggaattttataagtttaaaaagtttttttgttgtcagatttggaagttcaagtatttggtttttacttcataagcctggggagtaattattatttttttttttagcaacagagtggtgtaatataaataatgaagactatattggagcaggaaaatcctcttagtaggaagcatcattaagaggatattaaaatagtacagttatagaagtgtgagagtttgttctggagtggccaatgtatgaatggaagaaagaaaccaaaaggagagacaacctgaagaaacttttcaatcatgcattaagcaagtggccatcaaagaatcctacattcagggttctccatcaagggctggggacatactggtgaataagacacacccagtctttactcatctacatagtagcaaaggaaatcaacattaaaagtattttattacttatataccataagcacccattggtgaactgcagggtgttatgaattgtctagtcttgcttgagtggttaaaacttctctaaacaagcgattccttgagctgagctctgacaacatgtaatgaccgaccgaaactggatgttatatttgatggcaaaagagagaaacaaaagtgaccctgtaccatcagcagaaagacaaggaaataaagtgaagaaagatgatgatatggttaggctttgtgtccccacccaaatctcatctctaattgtcatcctcataatccccatgtgtcaagagagaaaccaggtggaggtaatagaatcatgagggtggtttcccccatgctattctcatgatagtgagttctcacaagatctgatggttttataagaggctcatccccctttgcttggcactgattccttcctgctgccttgtggagaaggtatcttgcttccccttcaccttctgccatgactgtacatttcctgaggcctccccaaccgtgctgaactgtgagtcaattaaacctctattcctttataaattacccagtttcaggcagttctttatagtggtatgaaaacagactaatgtagatgatatgctcaatttcaaacatgcctgattaatgtctcactaagactcactaagtctcactaaaacaaactaagactcattaagacaaaaaaagatcaagagtcagtggtaaatgtggaactgaagttagggaatgataacttgttatgcatgattttaatcagtcattctctaatgcgcaatttaaaattctacaaagacataatttcccaaatactcacccttaattgttacaaatcgacatagaaaataaatcgaggtttcaactgctaatctgagaaatcaaaggtgaactttgggcagtgcaattttcaaggcagtgaggacagcctagaacacagtgagcatttctctttttttctcaaaatctccacctcatatttcaggttaccactcctggaccctattggagttgctgcaggtacatccgttaaccttaaatcacctgaaatatgaaatgtctttatttataccttatattaacaatataacattgtatcctttaaactatttgaacagttgcaaaaatggttcaccctctgccactacccacttagacatttacaacaatgaatattttcctcaagaaacacattttagttaagaagctaaagatatccaaatcaagagattttatatactattatattatctcatattatattatctaatctcatatctctaatatcatgtaataaataattttagtccattgaaattgggcatattatctttcctcactttattttcttgtcttgctgctaatggtagcaccagtccctctcttcagtacttcctgtgcaccaaataatcctacccacttttactaatcttactctggtcttttctcactttctttcttctctctagttgctctcgtctacctctcttgctttctggaaagtaagactcccaagtctatacttcaagtgtgtaactagcttcagagatcaatgacctgtggttctagcttactaggtactgctactatgtcattgtcccaaactgaggtcattatcctcatcaatattttgtaatacaaactacacaaattcaaacaaaacgcacatatcaaattttgttttcctctgttttaaattctctaaatccatttaggttatgatctccactcctcaggactctttcttatcctacattcttcacaataaaactagtcattaagatgtgcaatctgtatccgatgtatatcttcaacctagcccttcctccgtgccactggttgaatttattcattaccatttcctacctacactaagctttttactccctttaatatacctccccccacgaacaattttcacattaatttttgaataatttttaagcaaatgtaactacagaaatcacctacctacctggtttaaagtattacgtggcctttactaactacagaacaacactcaaacttccccagatagtacgaacagaacttcataatttggttactgcaactgaactggaccgtctgtgattcttggaacatcccatgctactttgtacttctgtgtcttgttgaacgtggaattctgtctgcctgagttcccatatggtaaaactcactccccatggccccaccaccacacacatacacatgcacacacaccatatagatatgggtatcagtaactacgtaataatatactttttaaaaatattgttttcatttcaagaacatcattaaatcataccaggcagagctagttatgctattagtcataagaaaaacagtttaagcaatggttaagagtgaaaacttcagaatcatcctgcccagggatgcatccaaactctgtcatttaccagatgtgcaattatggacccattgtccatactttagtttcttcctctgtgaaataaagataataatatcagtacctttcataagactttgtaaagattaaaggaacctggtgtggtacaagataatcatcagtgtaaatgttgacattattgttgccctatgtttggcctttccatgataagtttgacaattagtcttttttattgtgtacttcttgatacccatatctataatagttccctgctagaatataactcaatgaagacaggcaccatatcttattcattttcatagactgtttaacccagtattgtgaatgctaaatcaggactaggaaatgtgacagatgacatctgcttggctccagcaagttgacatcagggaaaccatcctcctccccagccatcaagtcagtctgtccccatgtaacatcttaacctaattctcctaaaatattacctctagtttcacccaaagcagccaaactacccatgagtttctctgtcctgagtgaaagatggaattttggaaggcttggactatgcattgtgttgttggcaacaaggagatagaaattttacattcagaaattaaagaaataggaggattatagctaattgatcttatttatttgatacttctttatagaaattatgtttaaactgttttgcttatctttggtttcattacctttatatggtaacattcccagtagtaggacaccagtagaacaaccatttctatgcatgtgagatgtcacacaaatatatactgtttcttgagttaacattgggacatgccttttagaggtgtggaagctgatttaaacaacttactcaacataccaaggagcctaacataagtgtccataataaagtatattattcctcattcgcattgctctatgcaatttagccgtcaaatataactcagagataagtaacctaacagaaagataaatattactgtagagaagagcctggtcccattttacatagaacacagggtatccaaagatgtagttgcagcttactccaatccagttattattgttcaacgttgcttaatgctgattcacttgaggtcaataagcttaacaatttttttcaactttctatctatagtacagtctaaaattagaaaaaagaaaatgctcacgtcatattaggaacaatggacatatatacaattgtaataggagatagaatacaaaactattgcgattaaaccacaaagtactataagatatatgtatatattaacttttatatgtataaaatgtttctgaaggagtacacaagaaagcatgatggtgattctctgggaagggccaacacagtagtgggaaatagggtgagacggaaacttatctttcaccgtttacgtttttatttatttttttttcaaaaagaaaaataaagcaaattatttccataggaccgtggaggagaggcagttgtgttctgatgaggaattgggaaggcttcttgctagtgcagtgacatgagcttttcctcttggagaggtgccacatcctagctaaatgacatattttgtgatcctatggaatcctgtaacagtaaactaagccatagggcttttttagtatcttaagcaagtatgtgtctgagttgtagctagtaggttaaattgtgtaaagagttaaacggtctgtatctcataaccttcacattaatacagaaacatgacactgaaataaaggcccccgaagttagcttgattgttagctaaggaagaacaaacagttcataactacaccatggtgaatctgtgctgtttgcatttaggcagtagaaaatgtcagttctgtcatctgcctgaatctatccaagttatcacttaaaaattagatcaatatcacttttctctaggactctgaagggtagagagaagaagcatctgtgtcacaacagaaaagtaaaaatcgtagtactttttactgtaggctaacttacaagaataaaaatgtccattctcttagagctatgtggtaaaactctaatttgtttttactattgccctattgctcttttagcaatccaatatgaaattccatccctttgaaagatgagcaggggaggtgggaaatattccctcccatattcaaaatctcatctttcctgtgcccttttcattgggagttgctgtataaaagcctcttggattgtttttatttgaataaaatatattcttgggggagacgtgaaaaagaatgttttctatagcattggtttgctggctgctttatgtgggcatttggtattaagcaatatggaaaccttatcttattacactaggaaaggaatctaatgtgaaggatacgttggtattacaataaaaatgaccaataccttattaatcttgtactattgttttaccctgaggatagtatttatggttccagccctaacaatattgcctgtggacatgaaacacaagccagtgctgtttatttcaatatgtaaataggatttgctttttgtacagtaaaaaaaattaaaccctggggttattgatatattaatgttatttttattgtcagtgaaataagattttaccatattactactgaccgccaaatcccctgaagatgacttttctgcaggcaaaataatgtcctattagtgacctagatttgcattttctggatttctggaggacggttgcctttaatgccaaagaaccaagtgattctttgcatttcttgaaaatactaagtgtttcaaaggctagcttagacttccgtggatcacacttagttaacgtctcttagccactttgcatttaatattttgttcatgtgaaagaaaccccagaagtaactagctcatgtgcttcagcaaggtgtctcaatcttcatgctactaccgttcaggactcgataatgtttgtataggagctgttctatgcattgtagcatgtttagcagcatcccaggcctttatccactagatgccggtagctcccccctctcctccagttgcgataacaaaaaatgtctccagacattgccaaatgtctgctggagagcaaaatcacctgtggcttagaaccactgggttcagtgtaaaagaggcacttggtatatacataatgctgtgaatcttggtgaagaagtaaacttttttaacaggaaaataacttgttaagcaactcattcccattttctgtaacaacatttgcaaggcataatgcataatgcatatattaccaaatacaaaaaacataaattcatatgtttagaattaccttattttgttattctgcctagaaagttccccagtagcatgacatctctgcttgaagtatgtatgtatgtatgtatgtatgtatgtatgtatgtatgtatgtatttatttatttatttatttatttatttatttttaatgtgatgcctgtgtgaaaatgttttcaaaccctgaccatggcagggactgaaaaaaagctaagagatttggaaacacattctgcagttccctccttggagtctggccttgtgtattttctttagataggtacctctaagcctcagatgcaacagtagcctctcctgtcatggtttaagcaggggtttcctgtaaattcatctggtgtatgtttggacttgagaagagcttatttcagaataccagaattaggagatcaagacggtatgccgattctgttcttcccagaacattttcagttctaaatgactctctgacttgagtggcagtattggaatttgctgggaagtatgaaatgtaattcttgtttgatggataggattagagcagataggacaaaaatgcattaaattttcccccaagggttccttttgctagtatccgtttacttggctgctttctttatgtttctgttctctgttttccccatagaatttcctgtaaactttgcctgtcaatccaatctttattgctttcatttttaatactccaattggcgcattttacaaagtcgaccagccacgctaaaatgtaatgtgtggtttgctttgtctgtataagaggctgaacctggatttctaccagaagttaaaccactgcatggcatatgaggaagactgtttattgagtggccttgggtgcctcacgtgtcattatgagccccaaatactgttcactgccttacaaataagatctgtcaaatataagacctagaaggaattttcaaatgcaaaccttgatttttcatagaaaaggactgtcttttttctagtttctaatgcccctgcatgcttagaaatttggtatattatttaagcttccacttagcatttaatatgtgatattggaccatcttctctgggctctcattcctcagcttcctacctctttcagggacccttctcctatggtcctgccaccctggtattgatcttcctgtatggtaatcactactgaattccataagctgctctgcatttattcattcattcattcaacatagagttatcaagtatctactatctcccaggctctgttctaggcaacaatactgatatacactcaacccccttggagctgacattctagaatgagaaatgtcaataaatacattgtattcgtcagttcaggctgccataacaaagtggcttgattgatttggtggcttaaacacaaaaatttatctttcctcagttctgaatggtagaaattcaagatcaatgtagccgattctggtaaaggctctcttcccctgattgtagatggctgccatctttttcatttgtttgtttgtttgtttgttttttgagaaaaggtctcactcttgcccaggctggagtgcagtagcacattcatggctcactgtagcctcaatctcctggacttaaatgatcttcccacttcacctcccaagtagaagggaatacagacatgcaccaccatgcccagctaatttttgtatttttgtagagatggggtctcaccatgttgttcagactggtctcaaactcctggggctaccatcttgttatgtccttatatggcctttcctcagtgtgtgcgtgtgagagagcctgagtgagctgtctgaagtatcttcttaaaagaacactaatcctatttcattaaggccccacgcttatgtcctcatttaaccccaattacttccttagacaccccatctccaaagacaaccacagtaggggttagagcttcagcaggtaaatttagggggtcacaaacattcagtccataacatataaaaataattttttaaattaccacttcagatagtgataagagaactatacaaatatatcaagagaaaaggatagaaaacaattgggacagacatggcagttgctaatttagctacaatcctctctgaaaaagggacagttgagtgagaccagaaatgaagaagagacagccttattaaactttggagaagtgagcattttaggtagagagaatttcaagttcagtgtagagatgagagtgagaatgatgagatcaggacagaagaaagtcagtttggttcaatcctagtcagctatggagaaagggttaagaaaacagtatcacagaagtaggcaatagcctgattgtgctagccagtgcaaagagtgaacatttgttcacattgcaatggaaagcctatggagagctttaggctgattaatacacaaatacagtacaatttaagtgactaaatagagaaactcaaaggggtattttagagtgttattcgtctttgttagacaaagtaaatgttcaataattttttaaaatggaaagatgaatgttttcttacatagtaattatcttttttaaaaaaatcagatttattagatgtaatttacatacagtatattcactctctttagtgtacagttctatgattctgacaaacacatacaatcatgtaaccaccaccacaatcaagatgtagaacaggtatctcccctcctcaaattccctcgtgctcatttggaatcaaccccttcctccaccccgctatagttttgccttttccctagtgtgatataaatgaaattatatagtacatacccttttgagtctgacgtcttccatttagcaaaatttacttgagattcatcatgttgaatgtttcagtagttattttctttttattgctaagttgtgttccattgtattgatgtgccacagtttattaattcagaggaaggacatttgggttgtttccagtttggggcaagcatgaataaagtctgtataaacatttggattaaagtttttccataaacaaaagtttttatttaattttggttagtatggagcattgctgggccatagggaaagtgtatgtttaactttaaaagaaactgcaaagctgttttccaaaatgggtgtaatgttttgctttcccactaacattgaatgagaattccactttctctgcatccttgtcagctgttagtattgtctttaaaaaaaaaaacaactttgtattttctctttttgtcattatatcaggtgtatagtcagtggcttcttttaaacgtcacaactataaatttaagggtctggtgagtatggatagtaagaatgtaatgtatgatgggataatttttttcatccacactatttttttttacccaaaagagtatgatcttatcaaatcattgttaagagttaaagtacatttaagactataatttaagtacatttaagactatatttttgcttgaagacttttacagaaaataagcttaaagaatttattccttgaatcctgacaaccttgaattctagtcctcccatatttaatgggagtctcatgggatgctttcttagaaagacaactcatgaaaatctctatttaaaatatcactgacccctgaggttggatgaagtctttgtcccataaattccaagctcagtcatactattaaaaaaaaaacaaaacatagtaattgagttttgctaaaaatccaataaagcaaaagaattataccattatttctcacatgcatttttccaacctatcctcacatcgctgacatactccatctcaggcaacctggttttgtctgttctgtggctcgccactctaaccttttgcttaccagtaagacataggggaaacacaatttaaattctgctgaaggatttgagcattcagtaactcatcgactctacagtatagtctgagcagaaatggacatttcactgattttcacatccagaagctaccctttaatagatctccaggagaatcatccctcctctgatttgtgaattcctgatcttgtagcattctacagttgttcaatgagaggctctggaggactagaaaattcagtgctttttacagagtctataggagcctatcacataggttcagtgtctctgccagtgccttgacttaatccagaaaacattcccattccaacctcgatacaaattgtcctgttgcttctcttttcatggagaaagtattttctgcatgagggcatggacctatgcctaacacaaaatatccataactttctaggaactggtctttatttcctgacagaagacatagatgcaattcctgtatttgtaacatcagtcacttttgtaaagcttggtgctttcattttgtctttctttcaaagccttttaaacaacactcatggcttttctcctcctgctagtgggaggcagtattaaacttatctggcataagaaagattttgtgcagctaattttatcagatgactccaagtcatttcattcggagctacttatttctcttagtggaatcaaataatgtaaatctcctagacgttcttgttaatggttggtggaaaaacgtgcgggtggaaatatgtctttcccataggtacttgatagcatttgattagaggccaggcatgtagcagcttcgtgaatcttcctttttgttttctgtttgcagattttattcttcaccgtacagtattgcaaccaaccgcatgattccacagacatctatcacgccattcattgctgcttcccctgtctccacataccaggtatgtccaatttacctgcaccttaggagatatctttcttgcagtaatacagtatttagaggcaaaaaggacacagtagaatgaaaagaaaaaaattctcatacactttaatcacatcttaatgtaataatactcaagttatgagttagcctatactttcaagagcctgtttgcatcaattcactggataataaaatccactatgcttttcattcttcctgctgagttttcatgattatgctactgtccaaccaaccttaatacagctctctcaccactgggaaattattttgtttgttgtctgttactttgtttgttcatgttccctattgtgtcttttctaaaagcacatttctagcaattccttcactcactccaggatattttatcactgtcatctcattttgtcatggttgtcctggtaaagctacacagatagatgttaaatcatacttcccaagaaacagaagaaattatcaaagtggtaaaaagttgttcgtattccctgctcttatttcattctcagttccagagagaccaaaagagacctcaggggttccgcatgttggaatgctggaaagtctgagactcaatgtgtgtcctcaactagatattatagccagttaattccaagtacataggtcgattaaaatagtcacacttctccctcaaacaatactccttgttttattcctctgagttattacgtatgtgatattaatctcctctctacctaatattgttcttcaaacagttcttccaattctaattagaaaacgcctatatatatgctgcacgtagaaagtgtctagtgtcatttcttaaaagtttggagggagaaagagaaagagagaatgcaagcgtgtgtatgcatgtgcttcttgaattttgcagctggtgggggtggatgttatataatgagtaaaactgtaatgatactgatactattaattcagtgaagttttgccttgttcagtcactatatacttcatttcaggatatcccagctgtcagagaatcaaacttaagactatgtgcacttttccttaactgattccccccaaagcagatcattttctttctttttctgcactcagattcttgaaacatatccgtgggcaaatggaatagattttcatttgaattacattagagggtctctgaatggctgatttcttaattgcctttccttggcatgaggctatgtgcaggttctgttcagtttttgttcttcctgcaggcctgcctggttgtaatgtgcgtgtgtgtgtgtgtgtgtgtgtgtgtgtgtgtttcctttttttttctaatcttggcctctgttccagccaagaccacccattaagccacagtgtagagcactttggtgacatgaataaaatattcactgaagagtgattttacttgggagggctcataagtggaatttaactctagctcccttttctcaaaagaagagattacagcaatgatcgatgttgttgattctcacctttcaccaggttttttcaatccaaagtgttttggcaattctgtgtgtgtgagtatataaaaaaaatcttctgagttctccacgtgacattcagcttatacaggctgactttttcatttgtctgacacatggtacatttaagaatagttggctggctgacatactcatttttatgtgttataccaattaccatgagcgaaaataattacaaacttgcttaacttgggttaaacctaaataactgccccaaatttttggtttatctctttagctcttaccacaacttttaccacttggacatatttctaaaatgggatcacttgagcatttgaagttacaactgatgacagaaaaagagaaagtcttagcagtcaactcttgcttccttcattacttgccaggacatccctgaaagctgatcttcaaatggtctctgaggcctcctaaaactttagcgttcaacatcaacctcaaaatatgctccaagacccagcctgggccatgtgggcactgaagtcagctccactgataggggaagttgctttaccttttaccttgtttcagggaccaatttaatcaagtccaagaattccctttttacccttggttttgagcacgaattaactgtaaagtcaggtggactccactttcttatgacctagtgtgactccactgaacacaagaaccaagttctctctatgattgctttgtgctaataaatgctgtttgatgcataggtccagagtacttcatggatgcctcatccgccatacgttatgcaaccaacagtaagtgttctcagtcacctgaggctaatatttctattatccaagtacaagcttttggaatgcatagaagctttggggtaaagcttttgttataatatgtaactcgttcaggcagccatattctccagataaaaagctgttcctgaaattctacaaaagcatgtacaatagatagctagagatcaacatagacatagaatcagataaagagagagggtgaaaaagcaagagagtgagagagagagagagagtgcctggaaactttattagaagaaatagcaatcaaccattcaagctgagtctaccatttcttatgcatgaggaatttctgctttatgcaggaactcagaactccggacaattaaatttattctacaaggaaactctttgtttcccttctctttctgatatgcttttctttctttggccacagtctgatatgccttagggacaatttggagtatcatagacaagttttgacttgaagcaatatatttcaaatatgaaggtagttgtctgctaatagatgaatttatatagatagatggcaaggtgtgtaaatattttcatgttaattaactatagcagttttctttttctatagtggaaattttctctctgcaaaatattcaaattctcttttttacttgctagatttcccattttatggcacaatattacatcaattccaagtgaaaagtatgacgtattacattagaatctagactgaaggctaatgattgcatttatctttgcctaagtcttccagggtttctagctctatagaagtgcgagatagagatttcaatagcaacacactcatgagggtgtgaggcaggggaaagagccctagactggaagttgtgtgacaaggtctctggtgactcttctgggtatgctctctgtgcatttgtttccttttctgacactatatacttaatagtgcttttgtgaggatcaaatgagagatcacatgtaaaagacaatgtaaaaaagtatacatgctatgcattattattatcattgtcctcattattattgaatgtgttcattatacaaggaagaagcagtgctaaattttaacccctttagaagataaatgtaagtaagttagtatacattaaacaccagggagctaaatacgcagacatccatttcctgaactcagaaaattagagaatctggctttcatatctgagcagggtccattttatttttttaaataaggaacttttcatgttgctccaaacattttgatagttttttatttaaagaataaaatatatgtagtttaccacagcagaactttgtaccatattttgcaaatccctttatttactattatttacacaccttgagggctttctgagttcatctagtctatgttctataaatcataccactatgcaacaaatccaggctacacttttctgtccaagtcataaggtaaaattcagtttgtgctgccaaagcaatacatagcatagcaaagactgagccaacggaggaaaaggaaagaagtcctgccaagttctcaaaaggagactttctggaaggaaacaaccaccttctaaaaaatgtgttcatccgtaaaacactaatactaacttagtcctcatactgagttttaacaccatctctttgtggccaaaaggagtgcacatctggcaaaatctgaatattttaccagatgtcaaactatgtaagattcttcagtacttccagatctattaggggcagggaagatggttgtatgggactttatttcagctgtcactcaggacttttacaaagcttttcacacacctccttttccaccccagtacagcttcagcctcgtgttcgcatgtattatttctgtgtgtgtattattagtgtgtgtgtacatgtgtgtgtgtactttaatttgtccttttagattttccttgctgtggctactactcagagctgatatcgtatcacctcccatgactaaattatgcatcgtgcttgagcttaggccactaggtttaaatgtaatgtttatggctggggtggattcctggaaaaatagaagtggctgggccacacaccactttgctatcttttagatggagaaaagggcaaaacagtatcatggaaacacagagtttgtaccatcaatcatttccctgtaataatcttgttggctgtccatattacataagtaactttacccaactggctttaattttatcatcaaagtgaggttaagtcaccctatgatactaaaatataaaaatattcaagccatcttagacaacaaatcaaaaaacctgaatctgagaagaattaatgaggaacttgatgattaacaacatggattcttggttgagctcattaggacaggaaacccattttagcaagggggtattgagctatttacataaactttctgagccacagtttctcatctgtaacatggacataataatacccaaataattatgttttgttcattaaatgaaataaggcattaaagctcttaaaataatttctggaaaagagcactcaataaattattattatttaattatattagtagacttctcattatgctttaaattatcccagttttatcaaatgagtgttgttataagcagaaagttgaaagtaagcaactttgttgagaatcatctatttctaccacattcatagtgctaattaccttactttgctaatgagtttggtggagaaactctgtggctataaacaagacaaattgcttacattggtacttatttcacttactttctaaacattcaacacctaaaacttaaaaaaaaatgcccattgagaatctccttttttcagtaactggagactaccttacaaataaattcaaggtgtcaaaatctatgtctcaaatatattgcccataattccaatttgcttgcaacttttcttctctgtcacattttctctttcctcactttatgataatttcatgcatgaggtttcattgtacaggaatatacctcccctatcaccaagcgtgtacactgattcctgagttggagccagatgtattgcctaggctagaagcccttcgggttctctctcaggcttgacttaaagggctctaatgtctcaatctggtttgtatctgaaaacagtgcttccgtaaagttctaaagtagagcgcaatgaccttgatctctttgctaaggaggatgaatgggtaaactggaggggcaacaactggtaagagagaaatgaaatggcacagagaactaaagggaacagtaaaggcatgaaagaagaatagaaaacataagcatataatttctaaagtttgccatttaagtttgtttctttgtacatttaattttctaagtaatgtgcttgtagatttagaaaaaaaatactctgggaagaaaggatagatgtctctttgcatggattataattctgatgttttggaaagaaaagagatttctgttactggaccctgggaacttattggatctcctggaaagctgtcaaaccccacgtagagaatcaagagcatttctgtttgccttttgttattgttcacctgaatagactctgagaagacagcactgttagactaaattaggaattcccttttttctgagaagtaaaaatgctgactttgtcaatgtagttggttatttgcttctgcttctcagcacagacgtctatactgcatgctgaaatctcaccattgcactaacagaattttaatagttgatggattgcaccaaatacctactctacagagcagtatgttacattgcaatgtcatatgaatacacagttgaaattgctgtgttccaatacattggatattttgttacatctgttattactgacaaggagaaaagatgataattttcaagaggaagcagagttccactttcttaaactttatttaagctcatttgaagcataaatcttctgttcttgatatgggtagtgttatatcatctcaaggagaaaggtcagctttcattttgacttaattacaaattggttatctaattacagtattctaagaaatgcaagatgcccttattgaatcaatacatgatttgttgccatggcaacaaatggcaaaaaagttgcaagcaaataaaaaattataatcgttatgattaatgaaccctgagttttcagctaaagagaaaatataaacttcttctttacaaccaggctgtttaagaagccccagaatacttaatttggtcattctttgcccttaaacatgtaaggcctaaggcctagttttagagttgtgtccttcaattttgtaggtgtgtgttttgagaaggcattatcaccaaatttgccctaattactgtagaaaatagtcctggctttgctaccgttaaatataacttcaaaattttacggtaatttttcaaatataatctcagcaactttagtaaaataactttaaacaatgaaatgcaaggcttataattcaaaagaagtgtatagagtataaaagattttccacctaggatcccttcattcatcatttctattctccggaaatacacattgtaaacaaaatcagatatttctatccagtcaattttatatgcatatgaaattatatatttgcatgtgtgtaaatgtgtatttttaatatagaaacaatattactctacaaatgttgtattatgatttgctttatttttcctcaataataaaatgttctggatgtcaataaatatgagccatatatagatctatatcaattttgctaacagctccattgtcactactgtataaatgcaccaaaaggtgtactttcttgaaaactcaagacagtaatattacaccctagtgagaaaacgtctgtcagataagttgctgacacaaaagatatttacattttaaaatttgatatacattattttcaaattgccttttagatagcagtttttctttctccataacctcaattaaaagcaggtaatctcaagttttaaatattttgttaatgtggtaaatgtctcactcatattttattttcatttctgaatcctatgagttgagttgattttcacgtgtttattgactaattttgttttctttatctctgaacttcaagttggtttgctttgcttagttttcttttgaggtactgatcttttcttatttataaaagatcttattacagttagtaagtttatagtgtcatagataatttaaatattatctcagttgactttaaattttaattgtatatttgtcatgcagatttttggtatttatgtattcaaatgtatcagtctttcttttagaacaagggtcagcaaactttttccgtaaaaagccaaacagtaaatattttctgttttgtgagctatatggtctgtgtcacacctactcaattctatggtttattgtgaaagcatccatagacaatacataatgaatgggtgtgccttgagttccaataaatctatatttacagaaataggtatggccacatttgactcacagcctatattttgacaaccccagctttagagcatctgtattccatgcaaaataccttaatcactatagatttaaaatgccatatgttttcttactatgcttatagtaaattttgtttaaaaatgttgttacctttgaagtttattttatagcatgagatgagattaagattcaaaatttcatttttttgattttttttcccccaaacatggaaccaattgccataacaaattttaccaaagaaaccctctatatttcgtcctctggcataaattttatgccaatatttatcacataataaaatctttttatctttgtatctgttttccaaatgctcttctgtcctgcttctctatttcctttgagcattgctctattttgactactataactgacaataccttaatcagaggtgtccaatattttggcttccctgggccacattggaagaaaaattgtcttaggccacacataacatacactaaaactaatgatagctgatgagctaaaataaataaataagtcttataatattttaagaaagatcgtgaatttgtgtggggtcacattcaaagccgttgtgggctgcatgcagccagtgggccacatgttggggaaacttgccttataaactgataggaaatgtccacaatatttttttcattgtttctcaaaaatttttctagctattttacattttcagatgaactttaatgcattttatgaagttaaaaatgtactaaaatttcaaattatatattgacttatgggaaatttaagaatatgacatatttacaacattgaatttttctatacaagaaaaagaacttttcgtctacccaagaattcttttatgtattttggatcacttaatagagtatcaggtttccgccatatgtattctatacattgcttaatgttttcctggcatcttagtatttttgttattatatgttttagttttttgctgtggctataacaaagtagcacagactgtgtaatttataaagaaaataagtctatatagctcacaattctggaggatggaaagtccaagagcttgatacaggcagctggtgagggccatcttgttatgtcataacatggcagaagacatcacctggcaagaaggcaaaaacaagagagccagagagagcttccttttctaacaaagctattcccacaaatctaattccatggcaacattaatccattcatgaggacacagctgacattaatccattcatgaggacacaacacttatttctaatgtgtaagttttgtaacacatgaaataaatattcttcggcattgcaattataaaaattttattatattttctcattgatcactttggtgtataaaaatgtatatactaattttattcatttaattttaaaaatctattaattgttcaaaagtattgctgaaatttagaatatatacataagttaaaatatgcatataaaatacccatttcctcttacccaaagattagtacagttaatatctaatgttacatgtttccagatgtttttctgtatttatatcaatatctaccaacttatctacatctacaaacatgcatgcatacaatatacccattatatatatcacatgtatgtgtatataccatttaccaaaatgatatcagtcaaatgacatcacacaatatgtgctattttcagtgaatattttccatttttcccagttgagaaattttttatcatctctcatcaaattttcccaattgagcaaaaatgttatttacactggtttacccaatccaggaagcaatcagtgaccacatattatatttggttattgggtcatttaaggctcttttaatctggcagtcttttttcccttcctgttcatggttagctgtcctgccatgtatcccactcttgcaaaatgtttggttgattcttcatgatgctgtttagccttttcttctatctcatatatgaaacaatttttgtaaccagctatctttctgaattccctcattgttttcaatcgaatatttaattcattctcagcttttccaggtcatcaaaaataatataattttccacctgattttaaatctttatatttcataattcattttctggccaaatggctttggaatgtatcctttgacttatttcttatcataatggatatgccactatgaattattttttaatttaggtgtagatgttgaacttaatcaaagtttttttgaaactattgatattattttccttttgccaattttattgtattaatatatttgtaattaattgtatcataatttttaatattttcctaaggtagaatcattctgccatcaactccatttggttatgatatatccctgttaaaaatatacttccggattatacttgtgaatagtttattatcttggcatcagtttttattaataaaattagtaagctatttttgtcaggtttgaatattcaattaacaaaggctttataaagttaatttggaataattcctttttctctaattgcagaaacaattttaaatagcattaaaaaaatctctttttggagattataaaatcttcatacccaagactatcttagttttggggaagagatgcatttattttaccaaatccagtttaaaaaataatctattactccagtcagacatgttctcaggaggctaaaactttataatctatttaagaatttgttaaggttggcccggtgtggtgactcaagcctgtaaccccagcacttggagaggccaaggcaggcagattgcttgaactcgggagtttgagaccagcctggggcaacatggcaaaaccttgtccctacaaaaaatacaaaaaaattagccaggcatggtggtgcatgcctatagtcccagctacttgggaagctgaggtgggaggattgtttgaggatagaagctcaaggctacagtaagccaagatcacaccactgtactccagcctgagcaacaaaacaagaccttgtctcaaaaaaaaaaacaaacaaacagaatttgttaataccatgtatgatcatgatcatgaagaactctgactgttgcatagttgatagtcatgttgctgaatgatcaaatcaattggattgtgaaatgccacggtcttaacaaaattagcattatcttttgctccatgactagttgttgataattagatcataggccatatagttcttaagttaaatgtagtacaaagtaaaaataatcagttgccaactgcctaataaggaatttttaggtatgagcaagttgtaaatcaataatttgtaatttttaagaatgtatagagtttttaatgcccttgattgtcataaaacttgaggaatattttcctcacatgctcgcttgattcagtctttctttcccttagcccttagctataccaatcattgactcctcgtcttataacattgagaaacttgggttcaatgaaaaaaatcaacaaataataaaaacaaatattcttgagcatcaaatatgtgcatgatatttttctagatattattggaaatggaggagagaaaataagaaataatttgtcctcaagacttgaaatataattgtagaaaaacattatatgctcaggataatttaattgaaaaggtacagttgaaaatttgtcaaaattttagtaattatataacctaaaaaataaagaagcctctgtgaacagttaaggacagagaagaacaatgacataaagatgaccttaaaggatgggtgatgtttgtggggctaaaatgaaaaaagagaacattttaagtgaaaataatacacaaaaagtatgggaggagagtctcaagttatttcaaaggggactacggggggagcaaatagcctgccttaagtgaaatgtttatattagagaacgagggaaatatttggttggaaagttaaattgctacgtattgaagtacaactttcacgcagtcaaatctggcagactttcctacacattttttattagcttgacaatcccagtactattgttcagaatttaagtttactttgaaaaatgtaaaacagaaagagtaagttatgtcactgatgtgtgcgtaaaagtaataatatgcagtggagtaatgtatgaatcaattataaatagaaaaaaataaattctgctacattatgaaatgccattgtgcaaagtctttgtatataaagtcattttatattcctaaataattttggaggtaatgtttatcttccaagtagagttcctgaaggcttcctgctgtctgagatccctgcctcctaagcacaggagtgtctaggggcagtggtgagtctagaatcttttgaaatacaaaaaatatgctttaatacattttttaaattctcagataatggtggttggaagctgccaagtgctaggcaccaacacatctccagagtacatagggatgcatctattaatagatggccactgtttctatacccagtaacgtaaaaattgtcccaactgaagtattctagctctgttactgtgggagtatgcggggcatgtgtgtggtatgtgtgcatgtggcctacctttctgcatgtggttttctgttattttactaacaacctttaaaatgaaagactagctcaagacataatgtatcactttttagaacagcaggcacagcattctggacatgacacaattgacagctgctaagaagaaaaatttcaatcatacatgatctccagtgtgtccttggatagtatttagaatttcttcattacttcatcattagtaaagcagagtatcacagctttgccagttccttcataaagatgtagatgatgttacttccttaatagctatttaacatattaaatataattcaaatagaaataatgttaaatatccaatctattaaattcttatttcctaaagaaagaaaatatgcagctaaaataaagtccttgtcagactttctagaaaacagcaagttaccagggcgacaatcatatagaggtagggtagatcatttactttataaatgttaccagggtaacagaaactactcgtggaaatcactgaaggatttaggatgagagtacagatagaccatggaactatttgttctttcatagcacattggaacaaaatgtccaaacatatttaaaacttttaacacttatgtgaagtatttgggtattcattaaatagatgatcagaaacgggttcacatattgagagtattctcaaatgtgaagagtacatctcaaatgtaaatcaaaagatattatttttgatttcttactgctcagtatgtcattgggatactttattttactctgaattttgactttgctagattagttctagagaacctagttatttctacctaggtgctatgtctgcaatttaggatcatggttaatggtgttgattagcatgaggcttgagttttataggtcaaccaattagggtgtaggagggagggaagtggttaatggagagaaagggaaaaactatacatatacatatatatgtatatgtatatgtatataattttcatgtgtgtgtttgtgtatggcgtgtacggattaatcaggtttgcttaaagaattatggagtttagagttagatttttcaaaatgataacacaaatacaagtaaaatgcctttaaacttttctactgcctaagaagaagcttaccaaagataggaattaaacgtacatttttctccctgttttagaacaattggtttccctcccaataagactctgtcagaaaacaaataattctaatatgttcatctatggttaacagttaaggtatgtgcaaagtctataagcagtaaagaggaggaagttactcactgtggagggagtagaggaataagaacaaggcttcacagaggaggtaactcctgaacttggttttgaaaactaaaaggagttttttagaccaacaagtgttgggtgtcaggcaggaagggtgctctgagcaaagtgatcagtagattgtaggcagggttttggtcctattcaccatgtgctgcagctggtgaacatctaagagaaagcaaggtatttttacaggctaccaggtgcctctaacactggggcatatgcatgacatttgtgtgcccttcaacagttctgccacagaaggtatcacttaatcatgattagggctgttgtcctatattccattaaacatggcatcttctcctagagttccgtttgcatttctaggcaaagcctcctcaccaatatccgatgtgccctttcacaagttctccactcagagttgagtgtaatatgcagagaatgttattgatattacttgggtatcataaagtaatcattatagcctctgcacaaggctaattagtcctaattatctgaataccccaggtgaaagtgagatttctactcccctcagaaccccaagaatgcgtagtgtctcatcatttgactgtcaacaaatgcttcgttgctaagttattcaaacaataaagtaagatgatagagattctaagaaaaaataccagaacttatatgtctacatgagtttcttttttctatgtgatgaaattactttgggaggccttttccattgatgccatcttagactaggacattttaaaaatttattctttgggaataattttcagagataatttattaatcatacaagtaaaacaagttcatcaggttatattcacatgatagaaaaatggagaaacacatacataatagctagatagatagatagatagataaatagatgatagaatgggtggatagatgatgaatgaatggatggagggaaggatggatgcagggatgcggatggatgaatggatggatgggtggtcagacagacagaatataggtaatagatatcctgggacatgacactagttcttctttcccaactacagtataattttattatttgagagtttattccatatagttcgcaatatttctcccgttctattttgttctaaataaatatttgataataagttacactttatagactatttctgcattggcaaatattaagacacaagcttccaggtgccgttagacaaggatactgacaaaggtttctgagaaaattaaagacgtgcatcttctctgaaatcaaacccaacttattagggaaaatgatgctaatattaaatttgtctttgtaagtttgatcattaaatattgtcattgtcagtaaggaggtgtgttaaaaacaatttaggaaaatttctcttatgttcataatgtagtattctaattccttttcagttgcagatttgtttatatcagctgaaacaactgtgttattcagcgtagtgtcttaattggcagttacatctgtagagagaaacattttcttgtggacatttcttttattaactctcaataaaagccaagcacatgttaactttcaattttctgaagaaatgtatagggcaactacattaatattcttcaggtatgtaagtttcttataacctatcttgatataagaatgactcagtaaatccaattggctgacatgtggcttatttggtgtttatttagtctgagccaggatgttattaaatttataccatctgatttatagtttcacctaggtacaggctattttacctctcatggaaaagatggcaagattgttcagtttgtgccagaattttccttaataaatgtcttcaaagctctcacaggagcccaagcatgtacacagttgggatctagtagttctgtgctgttgagtgcttgagaggcaaatttcatctaaaatattgagggcaggcataagacctcttggctatcatcactaggtggctcataaagtactcatgattttaacagtactagactctgatgcacttgccaagatgaatcaggtgtaaaatgtactccgtggcagcaaacggaactgatagaatagaactatttgatgtggaccatgagaatttaaaagtatctgcataaattgatgatttggcatcagataaagctgatatcaaaccattctatcttacaataattactcaatatgttcagcagactctgaaatctgcacttgagaaatgacagaaaaactatatcatcagcagagaaaacatcttcttgctgacctaggaaggcatacaaatagttcagttggcgtcacactgtttatgcataatattttacaaattagggtggtacttgttcccttttatatcacttaacataagtataatttcattgcacataactgaggagaaatagtagaaacaagctgagaaaactgaaagcaaattccaagaaagaggattagtcctcatctatgttaaaaagaacattgtgctcttggctttattttcttatttagcatagagaaaatcaagctaattatcaacttgggttctgaataataaccttaaaacttctattgagaagagaaaccttttatcaaagagttattcttaaacggttcttaatcaatacacattagaaccatttctgcataacaatgttgtatattaaaaatcaattcttactttccgataaaggcttttatcttgtcttgtatctctaagtattttcaatcaatactgaaaaaatcattatgcttccaagtttgtgttacatgatacatgtctaaatactcagattctgatatcacactccaaaataatctaactttctgagatgcatatatgaaatttatttcaaggaagtgtttatattatacatggcatgaactgatgaatgattgatggatactacatacacattactgtccatatatgctgaaagctgacctccattatagatattatttaaccaaaagactgacatatacatataatacaaatgtgtgtttatatgaggttattcagagttacatttaaagactgaacactgttgagatttgtggtattaattagtaaggaagagaatatggtggatgcatgggtcaaaactgactcaggaaatttcagcctaggtggctaggtagaaagtggggtccttaaactgaattaggatgtgtaagagaaggcataagttgaggatcagggatatatagttccttttgggcatgttgacttttcaaggccagataaagattttcaatatgtacctccaaatacaggtttgccacccaagaagggtagtaataaacttatgagtcatttattcctgctggagagaatagatgagatttctagcaattcgctcacttttcatagtaattaccatgcttgatctatgcaatagctagtgttgtgcatacgctgaggttaccttaaatttactagtcttatatgtactaaattaaatgcttgcatatgccccttacaagcaagattgtttagcaacccaattatgctttttcttatacctatactgttatggctaattatgtattgtattacatatgtctttttgaattaatcaaatgtatatgcacttgatgtttcctcttagggaactgaccacagtgataagttaggaaaatagagatacttcaaattagaagaaatcttaggagcccccaatgaagtctagcagttgatgtaaaggtttcagaaattgtcctgtgtatccatgaaaagctgtttcatttccattttgcaaacatttcaggaaacttttttttattaaattgtatttcttccatagccactagcccagctagtggaagaacaacaaaattggaaaagcacagcaacaagcctctgcctagtaaaaaccaagaaagcaataaacctttgccaagcctataagaaaaatttaaaagtccaccgtttatttatcttgttgtttagatatatctgtctcattgttaagtcattgtgaatgcagggatttataaaccctacactattatcactggagggttcccactgcttttagaatagagtgttcctaaaaaaaaaaaatccatttcttttactttattgacaagaatagattatttcaggctttgctggataatcccatctttggcctttggggctttaaaccgtgtttttctctaacgttctggttgatgctggtaatgagaaccagttttactgatcatagaagtatgagctcagagtgactcactaattccaatgtgtttccaatggccaacttgaaaaagctacatagggggatgtgagagctaaattactgaagaccatcatgttttcctgtggggtttttccatgccctgaatatgttatacatgctttttgttggtgttttcttctctgttctatttgacattttaaagagcagaagtttaaagtaagtttcttaagaatccgtaacagtatgcccgtatctccagacaaatgtttacaaattggattgtggctcaaagatttaactttccttcatgtctttttctaaatacaaagttcaaaccgaaattgtcaagagtgaggattcattgacagacaatcagcaggaggtccttttagtggaatattacctgtgatacaaaaggattaaacatttcaaatataaacctttaatctgtgctatctaattactgacatctgaaccagtatcaaggaatttgtcactttttcacttttgtaattctaacaaagaaaagaagcaagaaacgtaattctgcatctggaaaaaacttctaatgcaaaagcatgtagctttagtcttttctcttgagatggactaggatatgttccctgtatttctgatttgtaaagattcagcaaggcagctctgttactgcaatcacccttgcttatgaagttatgtagacagtcccatgtaaatcagaatggtccaaccatttgatcctgtccatttctattacacatggtcaggcatatgatgagaaatgttctggctaacacaatttcatcttataactgtcctagaaaatgaaataaattgttacagcattggtttcctagcagagccaaaattatgcaaggaggaaagcccttctacttttcctcatatccctgtactctctctgataaatctttctctctttccccctctccatttacttttggtgctatacagattcaatttattagacaattactaaattacctcatattattgcttaaagtgtatcttctcttctttaatttgttaagtttaataatctccagtgaatatccattaaagagcatatgctttttcccccattttgaattgttaaaagtcattagaactaggattttgagccaatctgaaatcagctagatattccttgtattgctttttttagaaaacttacttattgactgttcaggggaaggacatatttgtcctaaagcaggctgttaattatcatgaaaacttacctattggctgttcaggggaagcacatatttgtcctaaagcaggctcttaattatcacatcagtctagccaatattgtgatggaatactgaaagtaaaggagaaccaaaaatatgtgggttgtatttccagaaaaatatatgttataagagaatacgaaacatgtggattgtatttccagaaaaaaatgtatgtgtatttgaaaattaaagattccttaggggaagaaaaacttgttttaaattttattaatctcaaggtatttaaaaatcctctgaaagaattttaaaggctgcaaattataattatcatgtaattaattaattcctgaaatgtttttagcagaatcaagaacatttctgttgcctggaccttggaagaatgacagcaatgaaaaagttcatattatttgccagtgtttttcccttaacactgaaaatgttaaattgctctatagttagtgacttattggaaaaacgaaaccagagtcattcattcctctattcattcaacatacattttttgggtgtctgctatgtgccaggcactgccattctatattcagttagaatacaaaaccaaaccaaaaaaagatcctctcttcatggaatgtatcttccagcaggggaaaaataatttaaaaactaaaaatgctatggcaaatgatgttaaatatttggagccagattttggtaaaaatagcaagcaggtgtaatttgtcttttagaaccccagccattattttcaacatcttttcttcccacttggcgatgtccttccttcaagacgcttagatgttccaaaaggtcattctttctctcttttgctttttcatttaaacaacatttaaagagaacccactatgtaccagatatgtgctgcaccatattcagagatttaatgcagtataaattatgtatagtccctgtctttatgaaacttccagtgtattggggaagagagaaatcaaatcagtattttaaggaataagaaattaaactggccatacattctattaaagaaagattcatgggactctaatctcatgcatgtgtgtgtgtgtgcatgcatttggtgggattctcttagagagggtcatgggaggcagaaaacaaccgtcaactcccactaaactaatagtggatgcttctcccaaaacctctcctgaaaaatttgatctggttattagcatcttggggtaaatgaagttatcagtagacttaagtgtgtgcaatatttttcctattactttgtaacaaaacgtttgtgaaccttctagaaaattccaggcatcagcaagaagttcattggtcttttaggtttggagtcttctatgctttggaataatgtcctccttattcagattacagagaagtccttcactctgcattttcatgaggcaattatataatattgtatatactatcacaaaagattaacctgaatataacaggataatgtatttatggatgaaggaagtgaagctcagagaggttaattgtcatcactaatatcacacaagttggtggcagagctgggacaggtatgtttcaattcagttaacaccaactctatttcattatatctggcttgatttttttcattaaattttgatatgtcaggttatataatttaacctagagtaaatcaagttggcagattaataaaaaattattattggattcttctgtatatgaaagacaaaatattagtatgttatctatgtcctttaatgccaatcacattagcatatgaagtaagatattttttaatattttagcaatcctatcattatatcttaagtggaaaggagttttatgatttagctaaaagctttgattttgacagacttgttcatccaaatactatcataatttaattctttgtgtcctaaggttagttaaaacctttgatctgacaggcacatgcatccaaatgtaccgtaatttaattctttttgtctcaaagttatgttatgttgggtgatatgtctgaggtaaatatgccttatttttaatgttcataatcactgaataagacccaccttaatgttataaatattgtagcgctatttcaggttatcagattaatgatactgtttgcactttataaaaagtagattagataactatgagaaaattctatgtaagtatctaaaactatatgctaacattcttttcaatttctacacgtaagatagtttattgttgcagcatataattaattttgagcattatacaacatttttatttaattttttaagatgagactttttttcaaaaccctacatattaagtctaaaagatcaaagaactctgaatcaaacccaaattgaatagtttcttctaaagtaataatattttgtcattttccttatattagatattatctacttgtaaaactaaaaagttataaaaacaagcaaaaagctttatcttttttctttttatatatgcttgaattatttttaaaatgagaaaacaatttttaataaaggtggaacatttcctactcttttaaagagtttttcctgattaaattttaaaactacttaggaaattttgcttataatcctgcatttatgtaatggcattgagaataatttgccaaacacagaccttataatactacagaaacaaatccagagagctttactgaccagctactgactcactaaatgaaagaaaaagaccattcccattgaaaaataatatcaatattgaattatccatccatggcatgggggaatacagcatctcttccaggaagtcagagatggacaggtaaaatgaaggccagaaaaagaatttctcataaaagaaagtagagaaattaagctttcctggaggagaaatgcagctgttcgagctgtggaatttcaatgcatgcagacctcacatctatctcatatataggtgtgtatacactcgcttcatgtgaactttgtgaagtcaatcattgctccatttgctaatcccagtttcaatttttgtcagctgtccctctatattttcagtgtaaatccctgtctctttgtaattataaccaaaacatacatgtgtttaatcacctctctatcttggacaatttttgttttaatacttgggatgccttcatggtgtaggcctagggaatcctgccttgaactacattcaaggggcaggaattctagctgcggattccatttccctgtaaaattatgcagccctggctgcataatgctgtcactgcctgaagcagctgctcctgctgctttcagcattgtacattgtcaacttttctgtcacttcattcacaaactttgctcccacattgttcacataatcatctctttgcttcttcctacacccagattttaaggaaaataattatgaaataatttggtagatataatatgattttagagtagtaactccagaactctttagaaaagccagttgttcccttattgatctctctactttttttttaacgtacttaggaaaaaattgtcgcatgactatttaccgcaggtctgactcaagggaaaggtcatgcatggcagtaataagaagcaagatcctcacagacatgctgaaaattagccacatggggttataatcaaaccagatcaagaaaggtgactgagaccaaataaaatgaaatgtgaattgtcattcacttttgctggtaagttttgaaatttgaaattgaccagcaaatttcctactcctcttgtgtctataaactgaaaaactgggaagttcatttattctttgactactagtaattttgtagtatgagtaaattggaaagtatgattactgttcttcacaatgtaaaggtttaaaagaatgccaaactaagcactgcattttattgttgttttccaaagccacaggtaaataaaaagttttctgtttttctgaaatttttgcatactactactttcatccaaaaaacaatgtcctaaatagatgatttaaccatgtgagttcacactatagctgtgtcactaggatggggtgaaatcatcatttcatatttggatatatccttggaatataattttttttaactttgacaactaatttcctgattcgttaaagtccctaatgaatatacataaaatagttaacttaaatacctcagataggcaggtcatggtggctgatgcctgtaatcccagcactttggaaggtggaggcaggcagatctcgaggtcaggagatcgagaccatcctggctaacatggcgaaaccccgtctctactaaaaatacaaaaaattagccaggtgtggtggcacgtggtctcaaaaaaaaaaaaaaaaaaacctcagatatgattataaaccagtgaagctttaatatttttaattaagtttgaattgtgtacatttgggggtgccgtgtaaaaaatacattttaaaaggaaggtcttataccgaggccattggatattaatatttgttgggtctagcctatgaagaaatcatggaattataatttgactttttgttttggtttgctgttgttgttttgagatggagtttcactcttgttgctcaggctggagtgcagtggcgtgatctcagctcactgtaacctctccctcccaggttcaagtgattctcctgcctcagcctcccaagtagctgggattacaggcgcccgccaccacgcctggctaattttttgtttttttaatagagacagggtttctccatgttgaccaggctggtcaggaactcctgacctcaagtgatctgcctgcctcagcctcccaaactgctgggattacagacatcgagccgcagcacctggtttagttttttttaaccctttataaaatacccactatagtcagaatagccactcagaatatgtgggttagctgaatttgctatcccattgccatacaaattctaaaagctatcaactgacagactgtttggcaggggggtgggggggctgggggtgcagcaaaaatagtcaggaggaatgacacaataaaatattaccaatcaattaaccagtgagttgacaactggccttgatcagagctaaggagaaagagggctctccctataatgagctgtgattaacaacaggaattaccgaaatgtaattatagccaactcttcagagatgagccatccatgccttgagacttcagggtctcagtaaagatagaggtatttttgttcttgattactaagataacaattgagccatgtttttagatgcaatccggtgtgtctacaagccttcatcatattttagagttatttccttcctacagtatgtttttcagcttgatactcagtgatctcaggcttattcctggggacccagagcctcctgctgaagcaaaacatccaggcttgctcaacatagacagtcccttaacttacagtgggagatgcaagtcttgtggctcaactgtgactctaggagttgagtggtagtagcatcacccagtgaaaatttcagactaaaaaaaagacagaaaatgacatggcatctccaataatgtttacttttgtggaaaattgtaatctccttgattactttatattgcatttttgaaacttactctattatagcttgttaaagttatttaactgtaatttatctctcagttatttcacagcaagatataacagaggccgggcacggtggctcacgcctgtaatcccagcactttgggaggccgaggcgggtggatcatgaggtcaggagatcgagaccatcctggctaacaaggtgaaaccctgtctctactaaaaatacaaaaaattagccgggcgcggtggcgggcgcctgtagtcccagctactcgggaggctgaggcaggagaatggcgtgaacccgggaagcggagctttcagtgagccgagattgcgccactgcagtccgcagtccggcctgggcgacagagcgagactccgtctcaaaaaaaaaaaaaaaaaaagaaaaaagatagaaactcagcattcgtgaatggatgaattaatgaatattctttattctaaacactgtacagtaccaaaatatcttttaaaaagttatgaaggctctaacattgcagacggtttggcatatatactataatttgagtaccccctcagtatttcaagttgacacaattcttactactaaaagtattgctttatcaatttcaagccagctaagatagacttctttaaaaacagatcaatttttgtttctaaaaatatatcctaatatcagggtattattctaccacagagaattcacattgattgtctatccatttaaaacaatatagttatagtcttttcacagtatttcaaagacttggataagctggcggtgtaaacatttcctcgtgggaactttataaaatgaaaagaaaataaatgattgatgcatactcaaactaattgaagtggtactgagtcaaccagatgttttcacctgaatcatgcccacagatgctattgcttcattatcccttaatctagggattacctccattggctaactcgatgacatgtgagggtttcaaataagattgcctctcccttgtaacatacatcataaagagagcttgtttagagacagcctacctccgccctgaacatgttttcaaggaagtgatcagggctgtttgtttttcttgctgttggatgtggtcttcagtgaagtcacaggaatggaatgagagtggccacagttgacaatggagctatttccacagctggctgcaaagagtgggcagtccatcacagataaactagcacatggggatagatgatataaaacatctgtcacaatagggataagcaaaaacaacgtgcctttgaagattgtgttttaatgatgaggtggggggttctgtctctataataggaatgaaagatgtgttgttggtgggcagatggcttcaggcttgctcttgcatgaaataaagcaaaagtatgtgttaaaaatctctgacagttgtcaagtcacctgattttgctgaccgttcatttccttgcctatcccatgtgtaatctatgagaaaagaaagggagtgctaggaaaaaataatggcagaaaaaaaaaactggttctgaataattttcttttggataactttaatacatcagtataattttaactggaggctgagaggtcagaaaacgtgtttttgcaataagtttctttaatatatttgcatccccatgtttttttttatagaagttttgtaaggtaatataaaaatgctatgtcaccaaggccacataatgataaatatttcaaatgtgaataccaattagtagacataaagtcctatttgttcctgttaaaggagcagtgaggaaaaataaagacatcttaataaactatttttgatgtaattataatagtttggtttcccaccccatctgcctttgaaaataaattaaaaacaataaaattcacatacagttttatttcatatagttgctatagaaaaagaaatctttgcaacagacaaactgattgcaaataaatgccgaatattcttgcacaatacaattctatatataccctgttacatgaccaaagggtaccactgtcactgctgtcccccaaaccattccactctgctctggtaaggaaatggttgccattgctgcacactgaaattttgctacttttgccacaaccccaccggaaaaatggatgtcacattccttgctcatttattattttaatctgtctttcaactctaattcccttgcaggtgcttttgattagcagaagtcacaaatctatatctagcagcaaaagggtgtaggaaatgtttttagaagggttttcttttcttttttcttttttcttttttttcaattctacattgaagaggtaggattcacactgggggaaactaatgacatctgaagagagtattaaaaaataaatttctacatccatgaatggcagaggtacaccacaagaagcaactggactggtcaaaataagagatcttaaagaaagagcagtgccaggcatggtggctcacgcctgtaatcccagcactttgggaggccaggggggcggatcacctgaggtcgggagttcaagaccatcctgatcaacatggaaaaactccgtctctactaaaaatgcaaaattagccaggtgtggtggtgcatgcctataatcccagctactcaagaggctgaggcaggagaatcgcttgaacctgggaggcggagattgcagtgagccaagatcacatcattgcattccagcctgggcaacaagagcgaaactccatctcaggaaaaaaagaaaaaaaaaaaaagagagagagagagaacagatttaaaggaatttgtgatgttctgacaagacttgactcctgactgagttttatggctgatgagggagaaggaaacgatcaagatgacttaggagtttctttgttattctgagaatcgagcagagaagaaagaatactctgagaatgaaagaggaagacagcattcagagcgggacatagtagttttgaggtacatgggattcggtcagtagttggaaatttggatcatgaattcagaagaaacaccaaggcaagaaagacttttttaaaactttaatttttaaactaattatagcacttttgattaatcaagtcttaacaagcgggaatattttggaattttacttctaacaccttatttttatggtatgtatattgagctaaccaaaatatttcgctgctgtctcttactattctatgcggcatataccatctcttctaatgcttggctgtcatagctatttctaactcactggttaagcagatgacgttatttggaaagaatggaggtttcagtgtgaaggttgccatgaaaatatgtcataggaaaagaaagggaatttttttgttaaaggagattttatgggtaaaggcagaaatcgtatggagatgattgaggaactatactaaatatcactggctgtcatttataacaaggagttatattaatattactaatattattccaagctatctggctctcaagcaagaacaaacaaaggacttaacaaaatgattgagagtcaaaccaagaatctttttagaagcaatgtaatagaaaattcactcagagccctggcagaccaaatgcagagctaagctttccaaagtttatcgtgaatataactcacctggggcaggctctaatttagtggggctggggttcacctgagattctgtactaagctccctgatgatagtatccagtcccaggccatacgttgagaaacaaggtagtagagtttaagaacattctattaaactaaaaaaaatgttaaaattaatcatatagtattactgcttaggagaaatggcaataaaatctaagcggaataaaacatgtaactaagtttcttgcacaaatcctgaaacaaataggacactgaaggataacaagataaagctgtcttttatctcatctggacagttttaaatatattaattgaaatcttgaaggcctcagaatgtaacttgtttggatgctaatatataagttttaaccttagaatatgtctgttacaccaggacatattttatctcagcattagaccacagaacatgtcatcaatagggtatatactgagtttgaagcatgttagcaataataatactaatagaaagtgtgctttaaaaggagtaaattagttctttaatagggtcgtgacttcacacctgtatccttagatctagttaagtttccagccctaaccaggcaaattcctaaaaatatcttaaaggagaaaaatattctctgagggaccacaaaataaagtgctttttgcagcaaattgcaggacaaggaatagctactttcttagtaatagccaaaaattgaggtgccttgtgacatatttaggcaacttgcactataaacaatggccataagtaagataacaggcagctatttctcttgatcgcccctgtggtttgagcaatgattttccaggcccatttgccaataggatcttacaagaccttgaaaaggatttgcaagcaggtctttcagtctatttgtcagtaaggagaagtttttaatgagaagttttatgacagctcacagtcctgagtcctagttaaacccagataaacattttaccagacaaaagatgaggtccataaatattcagacgtcttctgggaaccctgtttgccttatcatttggaagaaggctggcctgagtactgcatccgatgtgtgcttgaaacttctgtaagttgaaaatgtgtttggaggtatacaaagtgattgctgtacaaatgaataaagcatttcttatcacatgacaaggtttgacaagaatctcaggcagatatatggctactaaaacagttcatggcatagcaaagtcctaatttaaaaaaccttaacctacatttgtggcagtacacattggctgtaatatgtacagaacatcttgcagcatttaactgagcataaataattcttccatagaatggaaatcatgtcgtgaactccaatgttaaacttccttgggtggggtgtggctctcagaagccctgggattttcatactaaataatgagaaggtcaagctggcagtggtcagactgagatactgtcaaagaaaagcagaggaagtgtatgaatggatcttttacgtccatctttttggccagagaatgcttctggtatttccattgaatcttcttgtccagtttgagcaaggagctgctgttattgtttcacataccattaaagtcatcagagacctgctggtgagcaagtgccattcactcactcagtccattagcaccactaactaagcatctgttttatgacagacactgtgctgggctcagaaccattaaaaaagaaatatataaggtattgctaatgataccagtgaacttaggattcagggaagaaataaagtttgatcatgatcaaagtgtgtgcaaaatgttatgggagaagagaggagcaagtgaccggtagcctgggtcagtcataggagttattccccagaatttagtatttgataagaattttagaagacacatataaactgctgtagaagcctagcgttgcaggccaagacagcaagggtaagaggtaagacggacaagagaatgatgaggaatacagtgtggtggaaagagaggcttcatgtgcatgggctggggatcaggctagaaaggtaaattgaaagctgtgtgatcctcgtagattatgtgtgctatgctaacaaggccatcccagacctacctgtagaagcctctttttgacagagataatgctgaaacagagtagaaagcacatgctcttgggcagccctacaactcattcactctaactggtttctgaataagacaagcaggaatagaaaaatgtcttgtcctgtcactgaactgtcctatctactcttacactcctccaacacatttaatgtagaatagccattgacttaacagtaccagtgtcttaaaaaggacatttccactatgaaaaactaacgcagctctaggttgcactttgggaaaggaggtcatttaacactgtttcccttataaccccacttagaacaaaaaataaggagaaactggtctgctcctcttcaaattttatatatatatatatatatatatatatatatacacacacacacacacacacacacatatatatgtatatatgcatacatatacatattgtttttaaggtagaaaaaattaggaactaatctcaatatttcaaatataattttttattatgaaatatatttggtgggtagagatcaatggttttctttctatcttaaaaaagtatagaaggagctgaaatatatttgattaatcaattcatttttaagtgtcatagctttatagtcttttgtctttgattttttttgtcttgtgctgtttttgattcctttaaataaattttggagtgtgcaatacatctgtataggaaagctatataccatgggggccctgcaaagcaaagactaaggactatggttatgccactaattttttcacacaaatagtctcattttttcacattatctacaccacaacacatgtatttttatgtaaactacagcagtttacatgtgtcctctaaaattcttatcaaataccacattctggggaataactcctatgaatgaaccagactactggtcacttgctcctctcttctcccataacatatttgaaccaggctactggtcacttgctcctctcttctcccataacatatttgaaccaggctactggtcacttgctcctctcttctcccataacatatttgtgagtggtagacacccccagctgaaagctactcattagttatgcgattggaatcagaagctgatgaacacaagttcaccctttgtcattgaagctctaaggtccttctgaagtggcctgggatctttctctaaacaattaatatttccattgactcagcagttatgatctccttaagtagaaaaataagaggaaaaaatatagtaacccatctgtgtaagaaatttataatcttaagatcaattctgtaatcaagtgtacaagtttaatgacaaaataattaagtgtcctattgcatattcagtcaacaaaatccctttgaccgtagagtcctcaaaatctcaaattttcaactctccctcaataatgcaatatatttaaaagccactttgctctattaggattctaaagaagctactgaaaacaccaaaagctactgataaacttgtttctgtagttttaggcacaaacgtctaaaggattaaaataaagcattattgagaatcctaattatctatgtacctgctttggtaagaaatacttcaatatgacatatttactttatattctcattcaaaatgacactattatattaataggtacttaaccaataattgaaaccattattcacagttgaataggcgtagtacataattaggattcttttaaagggatttccatggctaaaactaatttggctttagtgtctattaatattataactttaaaaaaaaatacttccagttactagttactgaatcaaaaatcaacttgaaattaaaagtgtgattaagagtacaaggaaaaaaatgctatgtttataattaatagatattctgttattgggaaatctatgtacatgtacatatctcttctacctttatcatatagcagtggaaaatgtcttacttctaaacattatacccctagcccatagctatatatctccatatagtagtccaaatatcatgccaattagtctaatcctgtccaagcataggaaagagaaacccagctctagtttgccccatttccaaaataaatagcaaaataagttagcactcaaaaataatgataaagccattggaagtcatgtaatagtcctgttttctttcattgcacaattatggaatttgggaaattggtgtatattataaccataatcttgccatagatctaaaatgtgctattagttgtcgggaacagactgtagatgaatactttgtgtcacttttctttctttcttttttttttttttttttttgagatggagtctcgctctgtctcccaggctggagtgcagtggcatgatcttggctcactgcaagctccgcctcccgggttcacgccattctcctgcctcagcctccgaagtagctgggactacaggcgcctaccaccacgcctggctaattttttctattttttagtagagacggggtttcaccgtgttagccaggatggtctcgatctcctgacctcgtgatccgcccgcctcggcctcccaaagtgctgggattacaggcgtgagccactgcgcccggcctactttgtgtcatttttctagttactgcctttcaaattcttcctcactttgtataaatggagcttatggatatatgtatatatggaccagggtttctgaaccctagcactaatcctgggtttgctggataattatttgtcgtggggaactgttctctgtgttgcaggatgtatagcaacatcaataaccactaccccctaggtgctaatagcacacctcggcagttatgataaccaaaaatgttaccagacattgcaaaatcactcctggttgagaacaaatgaaatatgtacatatacaaatactttttattctaatatatatatatatatttatatgtctcatatagcattagtcaaacttttttcatcaagcaaatcttggatttcatctttaaggggatggtggttgaagatgtcattaatgcgcatgtgtgagttgaactatggttttaaaactgaactgccccttgggagaacaagttttctcaagaattttgtaatgatccattttaacgagcaatctcaaaataacatttctaactaactactttttgattagaagttttattctttcatcattctttcggtgaactcttataaagcatatattatatacctcacactataaacagcactatagacactagacagtggtgaacaaaacaacataatttcaaccctttcagaataaacaatcaaaatgagaaatattagtaaatatttacagtttgtcattgaactgaaaaatgagtggtactgatatataaaattaatttacaaaaactgttttgagtacttactgcatgcaattcctatttatagagattacaaaagttgtataaacataatgtcttccctcttgaaagatgtaacgtggaaagaaacaagtagacaataataaaggggaaggaggtattaagtgctaaagtgaagttctaggggcagtgtggcttctggcttaccatgtaattcatcatttcccatacctccagcatttgtcaaatccttccaaaatgcttacaaagttaaaggctaccacctttgccacatcttttgaatttcaaacataattttttaaagttggactgcactactacgttggttggaaatttatcaaggtagataaggattaatgattgtttctaagaattagagacatttcttactccttttgtttcttctccccacaaaagcctttcttaaaccctgaaccctcataaaacaaaacaaaacaaaacaaaacaaaacagttgacatcaacaaatgaaagaaattagacatccctacatatactacaagacaaggaatgttgcatgctaatactgcagaacactgcatttggacagctattcctcaagctaccttcatgccatttatattatgagatctctgttgctattaggtatttgttctaggaatattaaaaactggcaaaaatcagacatgaataaaagaataatgaaatagtgacttaaaaccacctttttaaaattcatatatagttttgtgtgaataactataggcaatcgtataatacaaatcacagacattttgacttgaggcatttagataagacagcagaaaaaaagggatgctgtttttttaattttcacttatccaaataattttatttttgtttttccatttctatgagttcaaatgcaaggctactaagattccaaatatgaaggattcccaatgtgttataatagaagccaaactgatcaaattgaagcatgtcaggtcatcacacttattcagtgattatatggtgtgattattcagataatatttctaggtcagcccatcaaaaatgcaggcttagcccctttgaatgtttttaacaagatataatgtgattatcacataaaagaccatggcctgtaaaaagactggattcaaacaaataaatgagaaacagcgtacataaaataaagccacttgtttgcctgtaagaactgtaacactggctttatacgatagcagtttttagacagagcatacttcttaaactttagagtatatcagaatcacctggagagcttgttaaaatacagatttcaaggcctaatcccagagagtctaatttttgtctactgctgctactgatccacaaaccatagttggggtggcactgacctagaatactatcacaggaatattaatgcagctagttcttcttattgtggttcatcttctgggattaatataggtgctaaaacagctatgtgtgctctagatggtagagaagccacacatgcttttccctgatttgccaatggttttgtatttcagttgggaaattaaaatattgaactttcaaagacttcaaatttctttcaaacattggcagaaggttaacaacacagatgcttttctggccttaggtcagatatatttacgccacacatgatgatctttggaaactttacccaaattactgttgaaaattgtttatttcagaactagggcaaccagatccaccctttgtctcttgagtgggagcagctttgttttgcaaaggcagtggctaaaaaggaccagacctttccatcagctgtttggtcattgtattttttagtggaattatagcattgtacaatatttttctttgcagcccaaacattgagcaaagccagacatccagagatgctaaaatgaaaaatctgtttcttcttgctttgccacttgccaggtgaactctgtcagacaccacatcctatacatctcaagtaaacaaaattatgcttaatgtgttggcaacatctgtcacaaacactcttcagcctatggcttaaatatattaagttggagtggatttgacagtgtatttaataagtcaaagttacggttgtggatactggctttgccatgctaaccataaggcttttcttttcttcttttgtatttatttatttatgtcatatacaatacaaaagagattctgtagttttaaataagcaaagtggctggcaaactccccctttgctgtaggtaaccaacactaaacctctctaagttgtctgtcccagacaaagtatcattaagaaaattcatttctcccaggagttcctattagttacttccagtttactccctgactgtacatttcttccattcccttaagattaaaaaatttgtattcttaataatttgtaggattgttttcactgaatgtttttattgaatgcaaacaagactctagattcttacatatccttccccaagaatccttattttattttttatttatgtgcaataactgatctgcttagaaagaactgttcatttatgtgcagtaactggtctccttacattattttccactctgtgcctagtgttgctatttacaattccaattaatgataaatcccttcttacttttccctttgattgtcaggtttccggtttatacacagaagcaacactcactctatgacatctgtaatcaaatgagtccccaaatactgctttcaatgaaaagattctgaaagagaccagacaattcttccaaaattaattccaagtgcaggcattcgatccttctcatcatgcatgaattttgattgttctgtcacatgctcacctacctcatctgcatattgcctttaaaaaaaacacacccctggggaatgagacaacctccagggtattgagaagaaagtatccttaccaaacgcagtttggtttttatctctgatttacatgaatgatcctttttgtggctagagcaagctgtttagaattgaggggtttctgggattgtgacagtttagctgcatgttggaatgtctaagggcaaatattctaaaaagataacctgtcttgagttcaagaagagaatcgaagtcttgcagctgctaagcattagaatgttgtcaaagtgccactttttggttgaaaaaaaaaaatgcttcaggacttccatcttaactctgaggttattctataatttatccctaggtgatttaagaagaacccttgttcttcttaaagtgtttacttctggtctggcacaacaaatacctgaaatgaaggccagtaagtattttttaaaaaaggaaaacaataaagatggttttgttaaaaagattcaggcagcagaaagaaaagtgatgtgtctctgaattataattaagtaaaagcttatcttatgtttctcatttaagaggcatcctgatgaatgacaatgcacagaagcatcgagaaattcaaacaacacaaatgcacaattgtgtatatttacaagctacagacctttaaaataacagacatgttttctgattgattcctactgaaaagcctaaatgtctttgtgaacaaagctggccctgtatatcaagcatttccaaatatttggctcaatttctattatctctgaaaattaatggggaggagcccacagagaaggcagagtgatagcctgatctttttcacagatatagtcaggaagttgaatttcgataataccaggaagaattgcttagtttgagcaaaagcattttaggaaacgcgcagtgggtaattagtttgggtgccgagatctggccatctacatgcatctgtccagtgagaaaaataatgtttagggaaataatttattcagatacataatcatttgatcataactgagtatttaaatgggttgttataaaatatgtttctacttttatcacaatctttaaataaacattgaaattatatactctcaaagattccatccaattcaagctttttaagtttgttttttaaaaatatttttccttctccaagttaattactgcaaggaaagtagcagggtagagaaagagaaatggaaggataaaatgacttagctccattcttcactcaccatatgacactttgcatatggatggaagttttttaaaatgtctgtaatttcttttatccccaacaatgataataaatcaaaagacatattctagacatccacttttcttaacatctgatttaaaagttgacacttttgtttttaaaaaaaaattgtggatggacataaaaatttgaccagctctaacagagtttggtattctgtcttgtgtctaaaatatagatagatagaaaacaggtcaaaaggttaggaggaaaacaaatgggaaatagtaatttcgatttttagattatcaatgatagattttaatatgtccttcaaagagatccagttcagaaacccatgtgggccagcattatccctcttagtggtagattgtattggggtgactaagaattatgtatgtattaataagtaatagataaatgacataaaccaagtcttatcaaataacaagaaaattagagaatttccactaatgttcatatgtttcagtcagagaagtttatatttagaacagtgggcaagaggatatagatgattttcaatacattctacctcaaaaaatgaaaatgtaagtgacatattttagacacatcacaggtaaattacctcagaagaaaggaagatgttaatgccatctattcagacaagcacaaaatgacatgaatggacataaaaattatatacagttgaatttagcctttttagtaaaaaagtaaaaacatttgatgttcacacatttacaatttacagtgtttatttgtaagaagtctccttccttgtaggatatattttcaaatggacattgtatatgcttgtagggtgctgtgattacaccaaccatggaccatcccatgtcaatgcagccagccaacatgatgggcccactgacacagcagatgaatcacctttcgttgggcacaacaggaacggtgagttgaagagattgttttgtttccttgaacttttttgatcagatgtgacattctccatttttactggcattatcagtgaaactgtgtctgtaccatattcgttgactaacacatctttcaggtttcagtatgaataagctgcattctgcatgtatgttcagttccagggcacatgtactcacagtggcaaggctaaagttctattgtgtcattcagttacttcttgttttttatggtacaatgtaccagatgtaatgtctgtttttggaaaggtgtcctttttgtatgcacctgcaaatctagaccctttgacttaatatactcaatcctggttttctcttcccagctgcttaccagctcagctactatattattagcaggttatacacaactgaggggccagatctatgactgatactattaaatcaataaagagtaattgaggtataatcgagttcttttaatccttctttctgatatgttgatatggatgatgttgaaaagaaggaagggaacctaatgtgcttgattttttcttataggttgtgatatttttgactagtcatctttctcctcagagaacaaaagtgtgctgaaaaatgcctattgcagcctggattttgtatcaatgaggcattttaaatcataagaaaaactttgtttgatttttttaaaagataattccccaaatgttcaaggaggcaaaagcctaatacaatctagaatactgaaacttcattagttgccattacagagaacaatgaaaccatgaaacctaaccactcatgtgacaccttcagtaacagttttattttcgtaaatgttagtgcagataatcttgtcatttaacaaaacatagaaataaaaatatgttttcttttgactgaggcagcttaaatattgtagaaagagcactggactaggagtcagaaatcctagatataaaacttgcgtaagccctgtagtttctgtcaatttttgggaaaataatatctctagtctgaattttttctctatatagttgaagtattaaacttgatcatatatgggtccctttgaatattcaattctgtatttttaagcctatatgtcttacagttaccacctctgtgattcttcaattatgctgactcattctccaaatatctatgtacaatatgcacactagttgtgtatcaggaattttaccctatagcaatggcttgcttgccaaataaatcttgttgactcatgggcttttaagaatataagaagttactggcatgtccactgagaactcactaatctgtcctaaataggaagaaagtcaatataatttaatggaaagagccacattctttcaataaagaaattttagttttagtaacataaacaaagtgcctatcactaagatctcagttgcagaacctgtaaaaagcagtcgatggtaacttacctgtctgaatgcttgggctggatcaaatgatctcttaggtttctcacctacacttttagaaatcgtgtctaagatatatttaactatatgctgtggtacagctaattttcatcatggagatagagcttgaagacaatattttattgcttttatcaaagaattatttgtaattattttgtgcgttactaataagcaggtcctaggaatagtatcagaaggcctgcagtttcttatttttattaatatattgtagatttccctccatatcagccttcgtgtccttcagtgatcataaattctgaataagtgatgtaatgtaattttaccgtattgaataacaatctggaatctgattaaagagacaattataatgcaaaacatagaaactctttaaaatttttactcatttggttcaaaagtaaagccaactgacttgctaaaatttaagtttgcaaactagtagaaatataagagctagttaactaagcatatgactgaatcctttagggaattaaaaaaataagctaaaagacacagaacagactcagaattaaaatagttattgattcaataacatatattatgattttgtatttgagcattccaacaagaacacatttgtaagggaccatgacttttaggcagctggtgatagccaaatgattcagtaataatatataacattctctttcttagagagtaaaagttttaagcatatgatttattattaataccaaatttccactagcttttttcttttcaccctttacatttgttctaaataatgcttagatacattataagatttgcattacctgatgttatggaaaagtgtaaaatttagtaaggtttagaagaggtagagagaaaacagaattactttgttgattcgtttaacaaaatataattaagtgtggttggtgtccagaatattgttatattgttttcttagactgtcactctaattcttcgatatgccttcatagattcattttatctgaattttgattggcatttggagtgactattatccagttgaggttgattttggaaaatcagatttttctaccttattgcatctttccaacattttcattgatggggaaggaatcctggcatcatggaaagatcagttggctttgtttttaaacttgagttcaaaacctgactttgttcccttattagctctgcatgtttaggcaggttacttaacctctcagaactttctcattttacaaagtgggaaaaataatgcttacatcccagagatgttgtgagtgttaatgaaatgacaatatgcagcatatcttatacagtgtgatacccagtatgtgcttctcaaatgagctgctcatacccttcacctccagtggcttctaactggtgggagtctagtttaggtagccagaagtgatgtaacacacagtaaaatccatggtataaatcacttacctgcactatttcacttgatataaataatttctttaacgtctccatttctttggctgctaacattctcttttaaggtagcaaattcaaaagcctgtagagtccagccaagtcatattaatgaatgaagtggatcaagttcaaacaaaaacccttggaaatatataatcaatttttaaatatttgcctatatcataaacatactcatactatataaacatatatgacattggagattatattttagagaagatgtattttccatgcaataataatactatctctgcctgagttttgggcaaatagaagtgagaggtggtgcctttggcagcctgaaatatggatgccttgtctgaagaggacagccactattccattggtagtacagctgttgtgatggctattgccacatggacatacagacccagggtggtctcactttccaacttttaaagataagctgaattcttgaattttgatttgaaatttctccatatttaaatattgggtccagtttgtcccaagaactcccagtttgtgactcctgcccaaggtttttctggttctcctcagacctctctggccattccttcttctcttcctgcacagattggtaagccagagcttcatttttaacatacttatgccacatgattttcgtaagcaatctcattcagtctcatggttttaaaccctggcttccacgttgactcctaaatctcagtccccaatactaacctcatctaataatttgagactcatttatccaactacttgctacatatctccatggaaatctccctcagacatctcaaagtcaccatgacccaaactaatctcatgagctttccagaactttcttctaactgaaacctgttcctcttgtgtgtttctgctccctgtttccctgcaagctaatgacatgaccattttccctgtagtcaaaccatacatctaagacccaatcaagaccctttccttctccctcaccaccatacacaattacttttcaagtcccactgattttctctcatagacattggtcaaatacattctttcttctacatttctggagtctctgccctgggactcatttgataaactgtaatagtttcctaaccgttcttcctgctttcaatttcaatttgctccaatccattctctaccctgttgtcacaggtagtcaatctaaaactatctgacgtctctctcctaactgaaacatttcagaggatttcagacatctgagcccacagaaattctgcaaaacaaggtgtgaacagtgacaagtcaagattaagattaagataggattctaaactctagaaacagatgggttccaagggcagagcagagagctatccagtgaataatctagagtaggaagtgatcagggctgacggaagttgtagctatattggaatttgccatttttagaagggggatcttgaacactggcttagtcccactcttccttttaaagtccctggctaaaggaattgtattgggccaaaacctctttttccttttcatgaaagaagatatattcatctcccatgacctcaaattttgaaatgaatgccatgtagtttaattaacctttctctacaatttgccacctcaaatgtttattgttcaattctctattttaagctagacagaatctgcaggcctcaaaaaaaaaaaaagtgcatcttatgcaagcagtgtaactgttttatttcagggctctgctgaccctgaaggattttcctagcttttctacttttgtttatttttttgtcacagcattcccttgatggaaccaaagccccattatccataacttcttatcactttattgtaagctttagcagaaaccactggagattttactgtgttatgagaacctccaaattgcatgacaatcttgttttacaagtttcttatctccttttcatttgttcagttgctggtcaccagtggcttacaatgtcaccagaatctgttggaagaaataaaaagtttttgttctgcaggttttgtatctgcagtttggtttgtgttctccaagccactgatgatttgtgatatcatcgagttccacagtgtaaccatagtcactcacaaaaataaccttgtaattgtactccatttgtccccacagttctctagcatttttcagtcacaccactccttcactgctctgaaattttgatagtatcaggtgaaaatcctcaattattcagtttgtttagacattgttcttttttctgttattaggtatgaatataaatattaagacagagttttaaaaagctaacaggatgttaaatggactctgattcaggaagcagtatcataaatggtaatgagtacatctaaaatagttttttaggaaaaaatattaattaaaacactcaaatacaaaacagaaaatatatctaaaaaggtaatagtttaaaaaaattggtttagtcttactgtaaaatgaaagacctttgaagggagtcttataaacaataaatgaactggcattaagtgtaagtctagtagtacgagtgtatatttgtaaatattacacttttgttgtttaaaaaaatgaattctgaattcaaataaattaccgacatagtaaaaaagcctcaatagataaaatgccaaagaacatgaacagatagttgataaaagagtaaatagaatgccaaggaacatgtacaaaaattgtaatgaaagaaacagaaacagtaattaaatatacatgtacatatatcccatcaaataaagctatcaaaatgcagtacaaattgctaatgaaggtgtaggaaaataagcattctctagcactgattgcttgatgataggaatctaaatttgtataagtaccagttggatagcaaggtagtcagtcgagatacttcaaaacatttatactgactgaccaagaagttatagttttgagaagctggtctatggaaatattctaaaataacagaaaaataattatacctcaaaaatatttgacacggtgttctttataatgtctaacaaagaagaataattaaatatgccataatccatccataaaccagaatgtaatgcagcatgaaatcgtaagagaaataattgggaaaaagtttatttataatgtcaaatttgaaaaaatggaagtaaggcaggctgtagtggttcatgcctgttatcacagcactttgggaagctgaggcaggaggattgcttgaggtcaggagttggagaccagcctagataacataacaagaccccatcacaataaaaaaaattgaaaattagctaggcattacattattgtgtgccctgtagtccaactactgaggaggcagaagcaggaagatcaactaagcccaggagtttgaggttacagtgagctatgattgtgccactgcacttcagcctgaatgatggagtgaaaccctgtcgaaagagaaagagagagaaagagaaagaaaaaaggaaggaaagatgtaaatttgcatgtgtggagttcagtatcaactctaaagaagtattataaggctaaagagaaatataaaacaagtgtggctatttccaggtgatgggattaggagtaatgtctattttaatcattatgcttttctacattatccagctattcagcaataaacattattggcttttattatttattttaaaatgtcataagtatattcttggaaaatgtctagtagcatggtccaataattaacttttttttttttttttggtttggagtggaaatgtgtgattgcaatttttcaaaaggtactaggagttactactattatttaaaaaattggaaaaacttttaaaatgattctaattattctagatttggggattataatcaactcagtagttcaggtatctgttgcaagaaacaaaataactcatgtgtctggtttatttgcatttgaatcttttgatcatgtttgcttttgttgctcaaagtgccttgcaatgttcaagttctaatctgtcttctcacatgccatttactcaggagagagtgattaaaattgaccttttgtggcaaggagatgaaagtgagaaatacgtgatagtccaaaagttgtcacatgggtggaaaaagaaaatttgggatttttgcttttaataaaggtcatataaatggaataagagtcacacaagaggacctatttaaccatgtgttggcagttgatttgaatctaaacaatatcaagtttcttttagagtttacccctccaaggggagtggggacaaaattagaattttccatttttagaaggggaccctaggcctatgccatattccaatctcctttttaagatccctggctaaagaaattgcagtgagccaaaagctcttttttcatctttaaaaaatcagatatattttgtgccatgtaacccctaattttgaaatgattgccatgtagtttaattaagctttatctagaatttgacaccttcaatgctaggagacttgggataaagataaccgtcacgttcaatagattctgttctgtgtatctctgctcccacagttacaacacataaagctttttggccttgaggtgaaagcaccttccgctctgcctcactgacaaccactgggatcagagctggagctgagtaataaataatgaaattttgccttcaaaatgtgttagcctccatagaatatgagaatgtacaaattttttatttttctcttttaaattttagttctttcttttgttctccaggactttgtttcgtatcatgctctgggccccctctaaatgggctgccttgtagaactcttttgtcagccagagagggcaaaaattttatattgattccctaagggaggtaccaaacaggctgtggaagatgacagtgtttcaggaaaaactgtactgtcccagcaagtctaatgggacctaataacatgtacagtattgtggtaatagggaccatggtatcaaatgcaaatgaggaatcctaatgcctttactgctctaaggcagggtgggtcaggcaaccatatgacacacagcggactcttccacgtgttagggctgattctattttattttcttttgtacttcattgcattctttctcatgctcttttcattcaaagattcaatcccaagacaggattatgatactccaccagctgttgtgtcaggtaggaaaattctaattcttttaagactggattggaggggagagatggaggttgcctggttttttcccaaactctttaaagcagtgattctcaacagaggtgggtgcaggaaatttgaattccagtttgcaagggggcatgtgtagttcagaaacataaacttaatattataattcagttatatatctggaaaataaatgtgttgcattttaaatagaaagtaaaaactcaaaaccattttatctgtcaaggatacacagaagatagagtctgtgttctgtgtatcagtgattctcagtgttagacacagtcatcaaattcctgaaaagtgggaaaataattttatgtatagcaaaagacggcacagattaataaaaaatagtttgagaagcactgctttagagaccagaattcttctaaattggaaaatcatcccatttgcttgctcagcaccctgcatagggtctgacacatagtaggtactcaatataattgtttgttgaatgaatctaaacttcaaatttgttcccaaaacgattcttttggatattgaaagaaaagctgccattattctatttatacaaaaaagtggcagaggttgatttgaaaatatgttagtgtcttgagggttttaactagcaatatttcagttgtttcataaaatttagtagtgcagtttgtaataggatatgtctatgtaaagaggtggatttttattttgaactgcacagatcttcttgtgctttcattttgattttgaattttgatttattgcaaagagaaaaatgggcacaattttttatttcagttaattttttaattaaataaaatactggcaatctgaagaggaggaattctttgattctttgacatgtcagacagcaaggtcataaaatacaaagagaaacatgcattagaaagacagaagaagaaacaaaggtcagaaatagactcaaagaccccatggagcagttgaatctgtcaacctgctggtggttttcaagcaggggaaatcttgcttttggccacccgtttgcttgacccagcatctgaagggtaattcttttttaatttcttatagccttgtttagttatgttcctggctgaatactcatctttaaagttcaattaataatgtcccattgaggaagaatacgttagcatttggccgcaaagtcatttcggtcctctttaaggtctctgcaataaattgccactactgaaaatatcacttagtttttcccaaagtgtatttcctgtcatatcttaacatgccaatttcatttaggatttagggcccctgggaagagactatatttcatacatggtacttttgtttaacaagatacatctactcttggtaatttaccaatattcataaaaataaaagacacaaactagaacttaccttcaactgggtttcctgattttactttcaagaacataatgaagaaagcaagcaaatcattaaaagtacttatcagatatcagtcataggtcaggctctacgtaagtcaattgaggcagaagatctggctgacaatctaggctcaggagttctcacctgattgcatacacagggccactgaaagttctagagcagataaattacttgataaaagcaatgctttaagaaactgaatctgaaagttttgtgtggtcttgagcaagaagacataaaaatcacatggaacagttaaaaagattagatatgacatattgtatttataataaaaagtagtcctaggttcccagcagtggagtatgaaggaagggacccaatatagagttaatatgaaaaataacattttgggagatttcacagttattttccccttgtaagatttaattggtagtttgacataagtttcacagacttctttggtctacgtctaaatagaaatagacttgcctttccaaaatgcttgttaattggctggtaggacaacttcaatgacttttgagaaattgaatctgcttttctcaatccttggccacatcaggaaagtgaaacaggcaatagcattgtaatatctccttcccaaatcttccaatatgtcaatattggacaaaacaaataactctttgccagtgtagaatccaactaaattgttttaattgattgtagtcgagatatctgcttgacaatttacagatacataacttaatttcattcaatcaatatttcaacatttattgaacaacttctgagtggtagacactacacaaaagtactggggatacaaagatgagcagaaaatagacccctgattaaaatattatggtataatattagaccattataacattaatagcaacatttatttgtgttgtcgtgatgtgaaatgcataaagtatagagaatcaagaatctagaaagaatatttgaaatcctcaggaagacaaatactgtttggttttctgtgtaatattaagtgacatcatcttctgagagtgagtgagagaaggcacatagtaaggatttaagaagaacagagatttggaaaactatggcatgagaaggcctatgaacaatccatagaattttgaggggtagtagtgggggttcatttgaagctatggactatgtatttgtgtgattaatctgtgagaatgtttgattttctgcggtcatgattagtagccaagaaggcagacaggcaaattaatgcagggttagtatttactaggtgaagtgaggaaaaggatagtgtgcaattatgatattggcaagaaagtagttgagtggcaaactgtgggtttaaggaagaataaagaaggaagaaaaaagaaggcagtggtggatgagagatagaaaacaaaatatacagattagcagtttcaatgagatgtactaactacaatgtattttactaactacaatgtagttagcaaaatacttggatttaagattttggataatgaactatttcttggcaaagtttgaatcatgggagcaggtggccacagtggacttgaggtgaaagtgacagaagttaagggagttcattaatgtgaacataaaaagtgactaatgaagtgggggtatcttgcatattttagttttgttttcttcgttctttgccattaataaattatacatggctcaagaatattttacttaggaagagtctgagttacatatttaagcttcaacaatgaatatgtcttaaaaataataataatctgggaagaaagagttaaagcagaaatggtgatgttcaaaagaaagaaggaagcttgggaaacaaaagcatctctgatttatttccctggagtcacctcttgttgcctacatctctgctaggccttacctagctcatttcaaggagggaagacagaaggctgaaactgccctctacattttcacaccaaagcaggaatctattctccttttagtatttcttttccataacaactataactcctttaaaaatcctcctctcttaagcaaatgttaatgaaaaaatatgtaaaggcatagtaaaatgccattttctatacatggttgggttttatgaaacacctatgaaaaccgaagataatttgtagtcaaatttttatttcagttgttttgagcttaatttccttgaatgacatcagcatgaaatcaagcagaagactactatcactagagaactaaagtagaatcaaaatctgtcctctttttctaaaaagctttgagttcagaatttgaacctaggtttgaaaaaaatttttttttaaaaaagaaaagaaaaacggggcctgaaaaatacactgaaaagaacctgtagaacttgtggagcatattttcattctttgctctaaccttttatgcaccagctgaaacaggctgaaataataagtgttatcagtacaacttcatgatgagatttcacagaaaaagtttgcataaatcacaatatactggtccaataagaaatttttaaatgtctgatttctaaccatggagttgtgctctacgaataaagttcttcattggagtacatgatgcaattaagacaaaattcactgttataaacagcatgcactttctcacattgtttttgtttcagcaatctaagtttgcattggaaagcctcattaatttggaatttgtgatgtccaagcaaagatttaattgaagcctatttcttatgctgcatcttaggtgagaattgctgtgtgaaactatcctctatcatccagaggagggaaaggcagagtattttagctgcttcaaagaacaaggagaacaagaccatctttcaagctctaagcaacatttgttttcatagataccatgagctaattacaaataatttccatcttttaattaaaaattaagttcattagtacctccaattagcaacaattagccattaaattgtttttattgtaaaagacctgacacattgttatgtgttcccacaagccacacgtgaaaatcagtttcattttttggctcaaataccgtgcatttatgttgactacaaaactatctttctttacatgagttaattgattttttctttgtaataagttcttagagactttgctttacttatttcttcatttattcaactaatatttacagagtacctacagtgctacaaaaaactaagggtaggtccatttcttgcccccaaagaacaaagattctaacagagtaaaaggttataaagaaatgtcatgtaacatagtatatgacagacatcacaggagtggtctgcagagcaggactctgtacatgatatgtgcgcaagtatttgacaaaaataggcatgtgaatgctgagttattgtgttcctgctggtgcatttattttgttcgctaaattataaaaattgaatcattaagaattttcctatgggaccataattgttatttatgtattaaaataggcaactagattggactagtatataaatatcactgttatttagcccaggttgttttttggtttttgttttgttttgttttcagaggatgggataggtgggtgtaaaattctatgcctcatcttctaatccagcaagcatttcctgtaaagttccagatagtaaatattttaggctttgcaagccatacagtctgtgtcataactattcaactctgccactgtagcatgaaagcagacacaagccacgtgcaaataagtgagcatggctatatttcattaaagctttatatgcaaaaataggcagcaagcagaatttggtctgtgtgctatagtttgcctacccctgctctctctaatcaatttatttttataggtattccaaactaaatactgtcactgatattctttataatacatctgaagtgaccttcccttaaaattcgcatttttgagcttttttatttcataaaagacagaaatatcagaaaatctgagatggtagacattgagatggaggttgagaaaaacatgtattagtgttttagtgtgtacagaataattgattataatagtgatatattaaaaccctttaagaatatttttattttttatatatttttttaatattttcattatatattggtcttttaggacttatagcagcaacaggggatcatcaaaaccaggaaaatcaaacatatattctgtttattatcctcttggcagcctttagaatcctatacttttagaaatttagagaaaagatgagaaatatatcatcccaaaagatttgtagtaaaatatatttgacatctttgtcacaccacctgcagcggtttctgttactgttgtgattgttgattagtgtccactgatattactcttgacctgccagtattttagctattctatttccccctgggtaactgcttccctgagtactgtgtgctgctttgccatccgattataagggaaagctttcctggtcttgtctaaaagccgaacactacacagggtaagcctgggatggctggagatatgactaccctctgtggcaaggacagagaaaaacgacgcttagtgatgcagcacacacatcaaatcaaaaggcagcctctcaaaatgctttctgcagtagaatttttcagtgagtggcagcaactgacttaaagcatcccgcagcagcagcacacagcatcacttagtgcctcagtcatctacaaaagggcagagcctacataatacgcagcagagcactttcaagacaacaatggactttaaagtaagctaattgcgtgtgcaggaatcagcacatctggtactgaaatcacttggttccgtttttaaatcaacagcacaaagtgggcacttgaggcgcctgtcagagaatatagtcaggaattgactatgtatgattcagcccttgccagaggcatgcgagagacatctgattctggagagatactgcctaataaacatgttaacagttctctagaccctatgttaaattagttaatcagaatgcaaaatgcccgaaccataaaattggacatccctattgaaatgttttctctcagttaaaattttaacattttaacctcttctttgagaagcaatatattacacgaacatttaaacaatgttaccagccttttgagatgccacagcaaaccaaattgtctgttattttacccaatgtcttttatataaagaagcaaatgattaatagatccttgagttcagtgtctcagcaagtatctctctccagatgaatgaatatacttatttttaactaacaatgtaaaatacccagcttaatctattttcccttagccttggttatcaggatagttggaattagatggagtacattgcaaatgttcctggtagcatgttctctctattgctcttaactgtttgttgatttgctggtatttttaattgtgcttcttaatgcagtgcttaattttgtaaatcttccacaaattcaacttggaagtacaaagcttctaattcctttagtaaaaaataaatgaagaaatactattgggctaatgggaagtttgtgtgctaaacatcttaggagaaggacaaaatgaaagacgattttgattgtgtgttgatcttatctaaaaatttaccaccagacactgtttgttttcattctcacacatgcagttttaaacaggaaaaagtatggtagaaaaaatcaaaatgatttttagaattcacaggatgtatgtgatttctgagtcatattatttaataattatttaacaattagagttacttaaattttctgaagcttagcttttctctccttaagagtagagagtatataatctattcattaccctttatatatacacaacaataaaaggattaattgaaaggatatgtccaaagtacctagtaagggcgtgactcatgatcgatattaaataattgaagcttcctttctgcttcctttctttggattcaggaaagtgtgttaggactttttgaagtatcattaatcttatatttgctatgttagattaacttatccaaagaaaggagtctttttaaatagtttccaaactcaatatctaaaaataaaagaaatagtaagagagttaattatattatctttcttattggccaaactattatgatattactaggtgaattaatataaatataaatatttaataacatgaaaaagaatgttcataatgcacagtgaaaagatgacaaaagtgaacaatcattatgattttgaggcctaaaacatacacatgaaaaaatctagaaaagaatgcataaaattattatcatatgtgttttcaatttctatttctaaacttcttgaaatgttgctttgctacacttataacttattaaaactttaataacagtctttgaaatggcaacagttttaaggagacatttatgtaccagaaaaacatgactgtgtgaaaatgaaaataaagatgatgataatgagtgtggtgattatatgcatgatagcagtagcaggggtaacctctaacattttccccacctctactcatcacatctcaacgttatggcatttagagcaagattaaaagagacattatatctctatatagaattggcagaatttttgagtgattctataacctaaattcattaaattttatgtaaatccattttccacctaccagaagatcaatatttccataaccaatagttaatgccacttttcgtattgaaatcacatttcaaatgatatattatgtttcttgcatgcagcagttggaacaacctaaaatcttcccagtttatattatgtgagacatcaaggctcttgtggtttacagaactgatatgacatatttgaaaggggacggtatataatacacttttaattacatattatgtctaacttctgcaacttagactactactatatacacattttttttacttttctgcttaaaatgaaatctgctgttgatttgtttccctgagctgtaattacaaaatacttatacttacccaatcaagctgatataacttctaagtgcttttgccacccaagatattgtttattcttccttcctttctaccactaagttttatttattttgatcatgtggaatatatcagtatattattttttatcagggaactttatgtgcctgctctgagtctagcagtttgcccaagagactcagatacgggaatgcacaggactccagatccaggaaatatgaattttattcataattgagcagttacattagcaaataaaatatgaagatttggtaaaaattattgagattcttgagatacttgttctggagggttgaagcctactagccaaagaaaaccaaggatcaactatagtcaaacatagttaagttcattagcttgctgaaacaagggaaaatatataccagttgaactgtggagcatctcagaaaaggaagtctggaagggcttattacagaattagagcttgtgcaatatgactttgggaagggtgtgaagaagtgaccatttattccacattgagtgatacctggaaatgaggggcaattgaatgattgtgtgtcttaagtgttatttagtagttgggaagaagaaagaagggctcgagctgtcattggcaaagatgcagccgtcattaatgttagacagaaaaaggagatgtttgattgtttaggtttgcagaatgtacctgtctctcttttgtccaccacagtccttgagtggccttgtctgaaaattgttgataatcttcgaaaattgtttagttgggaatgctatgaccttgcaaatagcttccagctaattaaaggttatttgaaagatttccataaattctttccttatctcaagggcaattataatattgcctaacaaaaatatagcagaatattaaatgtccttggtgaaatataaatgcaaacatgagagagggtaaatagtgttttattcatcacatagtatgtattcatcacatacatactatgttctaggcactgttcttagtgctctacgtgaattgatttgtaacatttgattgtcacaatcattccgcagggagtttctttgtcctctgcaaattcgttctttataagctcagctggacccacactcatatttatgctccttcagctgttttaacctttttcacctttttaagttccaaacacgagtcttgccatttatgctaaaaaatgactctttctttatgagaagatcagtaccacattttatccgatcttcaaatgtttgtttcttcatttttcccttcttcctatcttcctcttttgtcaagccatagtcctctttttgtcaatgttaacccctccttgtatgttcttgatttcatctgcctcaatttgtttttatggtcttatagcattgattgccctctatcccagatgcaccttattcaatatatatttattcaatgatgatttttcctatgcttaatgaaatgtgtagatccttcttgcctcaagattctcatggtgctggtcttatgacaccttgcttttcttcatttttttctcagtggcatcatgtgcttcctcacttttaactgttatatagatgacctccaaatctatattgctaaatcctatcatctattttgcttttcatgccaaagtttccaactacttcctagatatcccctatccactcttacctggcccatttatagttcaaacttcttgttcacaatttcaaatgtctcataatcttgcttctcaatccagtttcttctgcagacttccctagggttcaagcaaacctctataagcattctttatctaagccaagatgttttaagtgtagctacaagtttaagattgttagagtctttgacagtagcttagagtatagctcttctctttggggtgagaaccatatgatttaatattatactaagcttagagtaggacaggaaatcttttaccaattggtgagttatttttctttcagccaatggtgcttaaaacctcagaggtgttttggtgcactctatgccacatgcaatcttcctttttcatgtagatcctatttctacaatgtattttgaatctgctatacccattccattctattacccaggtccaggctgggttcttattacattctagttttattatttgagtgttgttttggtgtcaacacctagcacttctctttcctattcatccttcacacacattcttgaataaattttgagattaacatttaaaaaattttatcttcaagaatatgttaatagaacaattaggagttaccttagtagataattatccctaccatctgatcactgccagaaagtaggatacagatcagatttctgaatctaaagtcatcttttctaacagcagccctctaactcataaccagtatataccagaaatgttacactacttaaagctgtagttagcttatggagattgttctacaaggaggcaggtataacaactatgtcataccacagaaccacagtatggtgatagctgctcactggcctctgcttgagaggagacctaaaatttctctgacagaaatattgcccttcctgcagctaacatcgaagtgaaggggtatgtgtcttgaaaggagtcagcgggttctcattcttcttcgcttcttccatttgagtctatcatccaatgccgatttcagctgatagtttaaacatatggtcctgtgtgtaaccagcagcaaagaaagctacattccaagtactttttaagaaacataacaatttcaaagtcactgccactcatacctttcagaaccttgactaagagaaatgatatttttggagaaatatttggatcttatgcagtatatccattttccttggatattctaagttagatccttggattaagctaaaaaaaagctgttttacctggatgactgcattccactggacccgtgaaacagctcttcatgaagtatgccttggcacagtaccatttgtttatgtgtgaaggacactataataaatagaccttggaaacttgctttgctatattaaggctgttgttcattagaccacacagtgtctgctcctttcagactcacaggagaaacatctgtcttccttccatattgggaatcattcttcaatgcacctagcttattttcttacctaatggacacagtgacttgtataaatcattgctaactaactctggtaacattttaatagcatttatttaattagcctgtttgctcacttcatcttactctctttcccttcacctgatttttctcacttatttgacactgcaatattttatacaaccttgaaagctgccttaaatagttttgggaagcaaggtggactataattaaataaattctggaaatggaaatgactagtgtattatttttatctgtcaagagccacaactcaaatactacaagaattgagaagaacttatcaaccttgtgttcaaggcctgccacagtataatcttcaagctactttcccaactagttttctttctgtctgcttcacgactcttctttcactagtcacagttctttgtaagatgtgtttaatggtgagtgcttgctttctttgctcatgctcactttccacctggaatttcttccctgccacacctgccatctctgtggatcaaatcttgtgagtttttctgattttcacactttattttgaaaactctcaaagttttctgttaccacctgatgaattccaccttctatgagatatttgcacattcctcgctatcttctctccaacctacctttagattataagttcctggaggtttggagatcaagggctctgccattccttttatcccttgtggtattaaagctcaaatttttgatctaaataagtctttaagtaagaactctccctcaattatatacttcaatgttggcttttactcttaataaatgtggagagaaaaagtgggggaggtaatactaggctagtcagatgcctgaattttctctcacagttctaaaatttaaaagtatctcttccagaaagttactctaggtaactgccatcctttggcaggactagcacaatatccatctaactggtcggactgattcaagccttctttccattcaattcattttctctacagccccagagccacgtttctgaaacaaacaggacatgtttgaaatccttttgcagctttcaggacataatcctcagtccttagcctgtgcaacaaggcccttcatgatcctgatgcctcctttttcacattcatctgttactacttctgttctcccgccataatgaactgctttcagtttctgggatgggccaagcctgcagggtctttgcataagtgggagtagataaacatgagcaaatcctcatctagaatgtgtttcctttactcttcaacctgctaatgctggcttgtttcacagcaattgtctcaaatgttttcttcttcttggaaggttgccttatccttttgtcttgtcttagagttttctctccccttaggtgtctgggaatacctttattgtaacatttagcacactgaatcaccatttccagtttaattatcatttctcccctctagagtaaaggctataaactcttagagcagagactattcatatttaccttatttctccataatccagcaacatctggcccatggtaggtgtttattaaatattcattgattgaataaatgatacctatatgtaaaaatgctgattcgttagacacacattctacataatcctaactttctcctcaaaagattaaaatagcaagaggaaaacagactcagaattcccaagaagtctggaaatgtgaatgaacaactaagtgcagagagctttctgaaggggataggaaagactcatgacaagaaaatggagttgggaggatgtcaaaggatttggagacagtagaataattggaaaatgatgcttatatgaaataatttaagatattggtggaaatgtacaatgtgtctattagaaatatgaatgcccttcagcaatgttgcttatctgaaaggtttcattttcttattttccctagatagccatcatattcatttatcttactaacatcctcataattgattccccagtgtcaccttgtaaaagtacttttatactcttttcatcgccaagatacctcacacgtacaccattgcaaacatacactggtcccaatgacatcgcatctttgctttatttttatttttttaaatagattcttcaatagcctatgttatgccttttacagattctctggacacacatcaggtgcctcaccatcattgttaatggcaatcagagcaagtaatgtcttttagttctttttcattaatgaaatggaatagcaccatattcagtctgttagtgatacactattacatcgagagcttactgaagaaatgcagccagcctgtgtacatagggctggttttccttagatgtgattttcagccatgaacaaacaaggcaccctttcatctagcagaaaagtttgctgtcttcccctctttctttctcatttgttttgtcctatttttttcctgacagtctgcaagaaatataatgttttctaaatgacattgaaaattcttgcagattaggtattcaaagggataaaatatcaattaatcttttgaaagcctttcttttttgttgttcctgtctttggatttcagtttcttgaattccttactctcaaagaaatgtttttcctcttgatttttctcattataaaactggatataaatgtaaagtaagcagtcattctaggtattttttaaattcctttagcattcatgcagaaaaaaaaactctgctgttattttaatccctttaggaaagtatgtttgattgatgccctcgaacttggctagttgaggcaaaatctgagagtttttttttaatcctctaaactcaattgaattatattgccttagcttatactttataaggtgcccgttagctttaaaactcacactaccggcatttgtgcttgtcaaccaagccatttagactttaagttcatttgaagaattaaattaatgtgatgctaaagcgtctatttgtgtataggtcccagttcctaaaataacttttcttagcagtctcaccaagagtgaaatgctgttagtgggctaaaggaaagtatatcaacttcacaggccttattctagaatcagtaatttgtgtgttaaaaaatgagtattaaagtaggcagtacagctgatgcattcttgttaaataaagcatgaaagttcagcttttgtgttcatttctgcagtgagttccctttactacccctttttcaccatagttcattcctgaatggccagacataatgagaagatacaagaattcgactgctcaatagaagtacctcatcccatcttaatgctgagcaggcagcatatggtgaaagaatgaatacaagttttgaacaagatgagcatttaaatcccagctcttgcatggactgtatgtatgggttctctgaagctgtcttaccatctgtaaagaagataatgacaatactcacagagatatactatgagagttagatgagatattggcatagtcataatagatactcaatctttcccacatcacaggattccaagcttttgacttagcatgttcaattttttaaagcaatagttctcaaactgtgatcccagtctagcagcacagcatctcctgagagcttgttagacatacagattctcaggccttgacccagatctactgaacccaaaagggttgggcagggggtgagggtggaggtggaaccatcttatttttaaaaagcctccaggtgactctggtgcatgattctgatggtgagtttgagaaccacttaagccaatcagcaaatcacaaacattggctgtgtgtgaatggggaaaggataaaatgattaaaacagtgggaggtatataagttcattttcatgatgctgcgaagaattactcaagactgagtaatgtgtaaaggaaagaggtttaattgacttacagttctgcagggctcgggaggcctcaggaaacttacaatcgtggtggaaggggaagcaaacacatccttattcacatggcagcagcaaggagaagtgccaagcaaagtgggaaaagccccttataaaaccatcagatctcctgagaactcactatcacaagaacagcatagaggaactgccccatgattcaattgtctcccaccagatccttcctgcaacatgggattatgggaactacaattcaagatgagatttgggtggggacatacccaaaccatattatttcaccccggcccctcccaaatctcatgtccttacctttcaaaacacaatcatgcctttccaacagtcctccaaagtcttagctcattccagcgttaacccaaaagtccaaatccaaagtctcatcagagacaagggaaattccttccacctatgagcctgtaaaatcaaaggcaagttagttacttcctagatacaatgtgagtacaggaattggataaatatacttattccaaatgggagaaattagccaaaccaaagggactacagaccccatgaaagttcaaaatccagtggggcagtcaaatctcaaagctccaaaatgatctcctttgactccatgtctcacatccagggatgtggtacaagaggtgggctcccatggccttgggcagctttgcccctgtggctttgcagggaacagctcccctcccaattgctttcacaggctggaattgagtgcctgtggcttttccaggtacacagtgcaagctgttggtggatctaccattctgggatctggaagacagtgtccctcttttcacagctccagtaggcagtgccccaggggggactctgtgtgggaactcgcaccccacatttcccttccacactgccctagcagaagttctccatgagagttctctgtccctgcagcaaacttctgcttggacatccagatttttccatacatcctctgaaatctaggcagagattctcaaacctcaattcttgacttgtgtgcacctgcaggctcaacaccacgtggaagctgccaaggcttggggcttgcactctctgaagccatagcccaagccgtaccttggcccctttctagccatggctggagcagctaacacagaagtcactaagtcctaggctgcacacagtgaagggaccctgggcctggttcaggagactatttttcctccttagcctctggtcctgtgatgagaggggctgctatgtagacctctgacatgccctggagacatttttcccattgtcttggtgattaacagttggctcctcattacttatgcaattttctgcagccagcttgaatttctccctgaaaatgggtttttctttcctatagcattgtcaagatgcaaattttccaaacttttatgctgtgtcacctcttgaatattttgtggcctagaaatttcttccaccagataccgtaaatcatctctcttaagttcaaagttccacagatctctagggcgggggcaaaatgcctccagtctctttgctaaagcatggcaagagtcacctttgttctagttcccaagaaatttcttatctccgtctgagaccacctcagcctggacttcattgtccatatcactatcagcattttggtaaaaaccatccaacaagtctctaggaagtttcaaagtttcccacatcttcctgtcttcttctgaaccctccaaactgttccaacctctacgtgttacccagttccagagttgcttccacattttcaggtatctttacagcagcaccccactacacagtaccaatttactatactagtctgttctcatgctgctatgaagaacttcatgagactgggtaatttataaaggaaaaaggtttaattcactcacagttctgcaggactggggaggcctcgggaaacttacaacaatcatggtggaaggtgaaggaaatatatccttcttcacatggtggaaggaagaagtgccaagcaaagaaggaaataaccccttataaaaccattagatctcatgagaactcactcactatcctgagaacagcatggaggtagctgcccccatgattcaattacttcccaccaggtccttcccacaacatgtggggattatgggaactacaattcaagatgagatttgggtggggacacagcaaaatctaatcaggagggagttaaactgacagtagacattttagtcttgtgtagaatgttaatttttctttatcagtcaaactccttccttccagaattatacatatatatgtataatatatattaatatatataatatatatattatatatttttatatatattttgtatgtataatatattatatatgtgtatatataatatattattatatattgtatatataataagatatatatacatatctttcttttatgatttccttccttttgcatgactttttttgaagactgacataatttcacttaggttggaaatgagtgtattggtccccttggagaaaaataaataaatccctatttgagtttatccagtacaataaaaactatcaggataaaatgatataagtaggaagtcctagaaaaaatgaaatccaatgatcagtaccttcgcatagtatgtgtatccgctatggaatagttggttataacttttagaattctagaggtctaaaaccagcatgatagctcattcctcatctcttggtctgaagaggagggaggcacaattgtttataaacataacggcactgaggtggggtgtatgggtatgaaatcctagtgtttctacatggttactttatataggttttactgagttaaagctctgtttttaatatgggtcaagactcatatatatatatatataataccataccaacaagccctgcatccctagcatgatcctttgaacctctagtaattagggcagtaactaaattggccctttttattttccactggtgtcaataccagctaagaggattacatcttgcttggatattaagactcttttcataactgaaagcatctaatcctgattattcactgtttgtatttataaaatatataaaactagaaataaatctctcaactgaggcccaaatgtcacagtcaaattaaccttccttgactactgattcactttgactcacagctaatgaggacagctccttttttttttcttctatttttctctcagtgcctgtagaataaatcctacatagaactggaaatagattttattgtgcatatatttacttatctcctgtgcccttcacattgcttccagttctgtatcccctgtgcccttcacaattgcttccagttactttggagatttttttttttttctgttttactttcctgttcagaatgcaagataaaatcccatggaaaaatgatcaaaatgcaaagtactcaacacaaaattataacttaaatttgatttaccttttggtcatatagatttccttagggaacatatttaaacatcatttcccaaacattccctagagtaagagatctgaaattttgtagcctagtaaaatcaccatgtgagcattaaatgcccgaatgcccaggttacagtccaggccaattaaatcagcatatccgtgggtggatccaagcatcagtagtttattaaatcttcccaggtgattacaatgtaaagccaagtttgaaagtttgaaaggatcctaaaggattcctctcagtcttatgagatattagtgttgtacttaaacaaaaaacgtataagatttaccacctttgggaaatgtagcagactgtttttgtcttcttacaaacacttaagagaatcacaatgaacattttcacattggctaagctcggtgtctcatgcctgtaatcccagcactgtgggaggccaaggcaggtggatcacttgaagtcaggagtttgagaccagcctgggtaacatggtgaacccccatctccactaaaaatacaaaaattaattgggtgtggtggcgcgtgcttataatcccagctacttggaggctgaggtgggagaatcatctgaaccctggaggcagatgttgcagtgagccaagatcccaccaccgtactccaggctaggtgacagaaccaggctgccccctccaaaaaaaaaaaaaaaaaagtgtattaaaggctgagtacataaaggaagaaaatggatgtaaagaatgaaggaggacaagagaaaaagtaactcacacctccaagaaaaactgaaaacctatttagcttggcttatttcatcatatttcaaatttgtttgctcagatttcattgtatgtagaacacctgtaaaaattttattggaacacatcttccatagaatataattcagaaaatatggattaaaaggaatccaccacgaagtgtgtttctgaaatgcttattaaaaacccagttatatcagatcttcctatactttgttgtcatttttgatatttaaaatagtgtgtgaagtataacataagacttcagaaattatgtgaagtatctaatagaaatagggtatttggatcacaagcaccatgtgaaatttagttttaaaaagtcagtctccaaaaattaacagaagaattaaatgaatggtatgtagaggactccaacgtttattaacactggaaagggaaatccaatcaggtaagaaagtagagtggtatgatagcagaaatacagtgccaggatacattagatctagtggcatgtgcaggataagcttaaacaaactggttagtctgggactatccaatatcccatttctattatactcattcaccattttatattctcttctcccgggcttttctaaaaactttctttttctgaactttatacctctggaggctatctaatcagttgttgtctacagtttcttctttccttcatgaaaactaactggtaacctttcctcgggagtctcccaactccttcttgggggccaattgtatggtaaaatactaatttctgaatgcattaacatttctttttaattttcttaattttattttatttttccataagttattggagtacaggtggtatttggttacatgagtaagttctttagtggtgatttgtgaaattttggtgcacccatcaccctagcagtatacactgcaccatatttgtagtcttttattcctcactcccctcccactcttccccctttgtccccaaagtcaattatatcattcttatgcctttttgtcctcatagcttagctcccacacatcagtgagaacataacatgtttgattttccattcctgagtacctcacttagaataatagtctccaatctcatccaggtcactgcaaatgctgttaattcattcatttttatggttgagtagtattctatcatatatacataccacagtttttttatccgctttgttgattgatgggcatttgggttggttccatgattttgcagttgtgaattgtgctgctataaacaagcatatgcaagtatattttttgaataataataattatttttttcctctgggtagataaccagtagtgggattgctggatcaaatggtagttctacttttagttcttcaaggaatatccacactgttttccatagcagctttactagtttacattcccaccagcagtttagaagtgttccctgattactgcacccataccaacagctactggttttttttattttttgattatggccattcttgcaagagtaaggtggtatcgcattgtggttttgatttgcatttccctgatcattagtgattttgagcattttttcacatgtttgttggccatttgtatatcttcttttgagaattgtctattcacgtccttggcccactttttgatgggattgtttggttttttcttactgatttgtctgagttaactgtagattctggatatcggtcctttgtcagatgtatagattgtgaagattttctcccgttctgtgggttttctgtttactctgctgactgttcctttttctgtacaaaagcatcttagtttaattaagcccaaaaaactttatctttgtttttattgcatttgcttttgggttgttggtcatgaaatccttgcctaagccaatgtctcgaagggtttttccaatattcttccagaatttttataatttcaggtcttaggtttaagtgcttaatgcatcttgagttgatttttgtataaggtgagagatgaggatccagtttcattctcctacatgtggctaccaattatcccagcaccatttgttgaaaagggtgtcctttttccacttttatgtttttgtttgctttgtcaaagatcagttggctgtaagtatttgggtttattttttgagttctctattctgttccattggtctatgtgcctatttttatatcagtaccatgctgttttgatgactacggccttatagtttaaaatcaggtggtgcgatacctccagatttgttatttttgctttggctatatgggctctttcttggttccatatgaattttagaattgttttttctaactctgtgaaaatgatggtggtattctgatggggattttgtggaatttgaatactgcttttggcagtatggtcattttcacaatattgattctacccatccatgagcatgggatgtgtttccatttgtgtcgtctatgattactttcagaaatattttgtagttttgcttgtagaggtctttcaactcctttgttaggtatattcctaagtattttttttcagctaggggttgagttctcgatttgattctccacttggtcactgttggtgtatagaagagctactgatttttgtacattaaccttgtatccagaaactgctgaattctttgatcagttctaggagttttctggaggagtccttagggttttcaaggtaaataatcatattctcagcaaacggacagtttgacttcttctttactgatttggatgccctttatttatttctcttgtctgattgctctggctaggacttccagtactatgttaaagaggagtggtgacagtgggcatccttgtcttgttccagttctcagagggaatgctttcagcttttccccattcagtgttatgttggctctgggtttgtcatatatggcttttattacattaaggtatgtcccttgtatgccaattttgctgagggttttaatcataaagggatgctggattttgtcaaatgctttttctgcatctattcagatgaccacgatttttgtttttagttctgtttatgtggtgtatcacacttattgacttgtgtatgttaaaccatccctgcatctctggtaggaaacccacttgatcatggtggattatcttctcattttgttgttggatttggttagctattattttgctaaggattttagcatctatgttcatcaaggatatcagtctgtagttgtctttttggcttgtgtcctttcctggttttggtattagcgggtgatgctgtcttcatggaatgaattagggaggttccttctttctctatcttgtggaatagtgtcaaaaggattggtaccaattcttctttgaatgtctagtagaaatcttctatgaatccgtctggtcctggatttgtttttgtttttatttttgtttttgagacagtctctggcctcactgcaacctctgcctcccgagttcaagtgcttctcctgcctcagcctcctgagtagcttggaatacaggtgtgtgtcaccatgtccggctaattttttgtatttttagtagagacgggatttcaccatgttagccaggatggtcttgatctcctgacctcgtgatttgcctgcctcagcctcccaaagtgctgggattacaggcgtgagccactgtgcccggcctggactttttgttgttgttggtaattttttaattactgtttcaatcttgctgcttgttatcggtctgttcagggcatctaattcttcctgatttaagctaggagggttgtatttttccagaaatttatccgtcttttctaggttttctagtttatgtgtgtaaatgtgttcacagtagccttgaattatcttttgtatttcagtggtgtcagttgtaatactgtttcatttcttagtgaggttatttggattttctctcttcttttcttggttaatcttactaatgtcctgttaattttatttatcttttcaaagaaccagatttttgtttcatttatcttgtgtatttttgtgttttgttttaatttcatttagttctgctctgatcttggttattttctttcttctgctaggtttgggtttagtttgttcttgtttctctagttctgtaaagtgtgaccatagaatgtcagtttgtgctatttcagactctttgatgtaggcatttagggcttgatctttcctcttagcaccaccttagctgtatcccagaggttttgatatcccagagggcaggactcactcccacggctgcccacccggcctgcccccgtaacagtctgtttccaggtggagggcgagacaggcttgaaaacttgcccgaggctttctgcctcccagctgcaaaggaaaagggctttagatcttcccctgcctgtgaagtccgctagccagattcatgccctcccctgagttctggccgggggtttctctccccattcaaattgttacaaatttcagatagagaattccttctcccagtggagttttagctcctgcccctctggccaccctcctgctggatccctgtggtgccaggcaggaatgggctgcttgaggacccggtgagctcccagggcctttctgctgcttcctctatccctgtatttcactcagctcggctctcttaacttgactcagctccaggtaaagtcggaaacttctcccacaaacagaccttcagcttctccagtgggggtgtgtgctcaggagaggagggtgtcccgttcccacttcctcagttggggcactcacagtatttagggtgcttcctgggtcctgcaggagcagtccgcttccttcagagggtctgtggatcctctcaggattgctggtttgttcttgcagtcgatctagagctaaaattcacagtgcaagcctccgcatgctgctctgtccggagctgcaatctagttctgccttccgtccaccatgatacctgaatgcgttaacatttgaccctagtgatggaatttcacacgctgtgatggatatttaattgtaagacagacgcagagtgatggtggtcattctccatatagctgtcctaagagatctcaaaaacttctgcttaattagagtctcttaatcatgaaaagttttgagttatcatagacagtggtgaaaataattaaagtaattaggcaaattggatttggataaacattttaaatggatagtcaaatatcaatgttggagaaggttctattggcaactgagtctgattgacaggaaaaaggaagattaaatgcctaatagacaaggctctaagattatccctggtctgataacgattttggataattctaccagagttgacaatgttgtgtatttctttttaactgatttcgtctcttgcttaatttacccttctaaattcatatgatctccccaaccacaaagaacagttaaacacccagcacaaaatggtttaattttaaaagaaattgattgattcatgtatataaaaagccaatagcaagagctgcctcaaatgatatcactacatgtttttttctttatattcatttgcatttgtcttcacattccatattctcacatctgacaaatctatgtcctctctatcatggtaacagagtcgctgacccataagcttacactacaccatgctagggaagagaataggtcatttccaggtgtctctgtatggaaaagagaatgttttcctttccagtagcttaagtaaacatcaagtttcattggctctgttagggctattttcatttatttctgaacaaatgatcaggatacactaactgtagagccaatcacattgtaactacatggtagtgaaatgggggtcataggattttcaaaagaaatgtggattatcatcaagaataggaaatgaatgctgagttgtaagaaaaaaatgcaaatagaagttcacccttgtcatcattcttcatatccttctgtctatagtgtacaacttttgattgatttttacttttgaccttaagtcattgatccctcttttaaaaatctgtcttgttttataaatatccttgagacaagacttaagagtatttttaggaaattcaaacctacatatttttattttctataagtgtgtatgaaattcattaaagaggatgttcgtttatatccaccactttaaaacttacagcagtttaaatataattggttttcagtaaaaattgtatataatgtaggaaacatgacttcattgggcaaaactctagaaaaatatgtagttaacatttttgggaaaaactgtccgtagtagcctgtgagttagtgaaggagtgtccccaggccctaaacagaaactaatgttttctaggatatagcattcaaggaccaagaaactaggtgagaccagatcaagaaaattaggagataaaaatgaagagtaatatgatatctgtattgctttttctttttgtttgattttggctgccttcttctttgctaccacccaataatgagcacttctggtttgcttatctatttatttcattagttttattttttttcgaagctaattcttacacgcctctcttaatgttcagaccctttatatcttattttttccagtgaatgggagatattaagatttgtccttttgagttgattatatccaatttattttctttgtttgagaatgtaactgagatatcactgggtctctcaatattttgaaaccagatgattgtctaaaatcctcaatcccataccctttagaagtccaaagctttatgcaacatgtatttgagttttcaagggcattaataatcacttttatttgctccctttattctaggttgattttgatgtaaaatttaatcttttttcaattttctcataaaaatcccactcagagtcacattaatgaagatttgggatgtgttcaggaatcgaaacatattgttcgttccaataacttcaacttgaatataaagctacatctctgtggtttaaatgccttttaatagcttcaccaaagtggaatttcaggcccataccactcatgggctcctctctcctccgtcttcccgccagcttcttcaggttttctctcttcccatctttcttagaaacacaagatgctcccattccccgctttataactgcctcctctcttggactcacttctccagctcctccagtgtcttctctcttcccatctttcttagaaagacaagattatcccattccccgctttataactgcctcctctcttggactcacttgtccaccctggcccactactcatctcttctcacctcctcaaaactacattatttcattaccaatgatttcagccttggcctcacttcagaatgccttttaacagagtactccacagccccatgttgtcaagagcttcctatgatggaagatcttacttatacatttggtatcctgcttctttttgtcctaatacacttgtttgtttgtttgtttgtttttcattttaagttgtttcataagtggctccagtttcttctcaaatatgttaggtataggggaatttttttactggttcagaattccttttctcttaattttaatatttttcctttaattctcacccttaattattcaatttaaaaaaagaagcctgcttttttaacggactttattctcctttaattttttatgttctccttgaaaaccttaagctttttacccagagtgcttaattattcattcactcactcattcattcattcactcaacaaatatatattaactaccaaccataacgaattaggcatggtctttctagtttacctggtttgactgctaagagctttagcagaggtacagagaaaaagctgttagatgtcataagaggtagttaccatttcccaatgggggactgaagcaaggcaacatacaggaatttagcatttggactcagattgagagacaggttttggatttgtgttgtaggtggattaaaaaaaaagtttgaacacagtggaaacaaaaaaggccagaaggaggaggttagcaagaaaatgctcttaactgtgagcaagtggattttggaatagccaaacataattgagatgatgtaggtcacaatgattttaagaattgaatgggagtggaataaaatttaccccacaattacatactttgcttcttcattgcttgacggttatcatcaaactaactattcttcaattcctttggcaaggagtggaatctggactctggcaccagagggtcgatttccttccagttctcctttctattttttttttgcttttgtttctttactttgaactcctcacagtcttggaaaaaagagggcttgcagagactttttcattttgtttttatattgcccaaattgtactcacatggatagagtagtaccatttaattgtttccctctaaatatgcacagttcccagaggtattttaatcagatagctttatgccctgttgtttgcagtttccaactttttgttttctattactttctgtttatttagaatgttgctgcctcttcttttcttctctccattttctccctgtcttcatttgctcaccacccatcttggatcaacctctaatatgaatattcaaaatagttgagtaagtcaagttctgtctctgaaaatctcttgactaaaaaaacagattaaaaaataatatcactgacccttttagaggctgagctctgtttcagaaaacattaaggaatgccttcaacattttctcttgtttagttgcatcatttacttgagtccactgggatgattggcattcacgatgtgtgggctggagaccatcaaaaggaaatgttttgtgtggaaatggaatttactctgtgtgtggcagtttgaataagttccctttctctttggctaaagcatctttaccaagcccaatctaatgcattagtcacagaacttaaatagaaaacaacaaagcttccaggcacattgaggatttcttcgttcctttgtctttttgatgaagtccctcagttctttcatttccaaaataaagaagcaagcctagtcgacagacaaaattaaatgaacctaaagaggctaaggacattagttgtttatgtgttcatattagtttctggaagaactaactagataatagatcagtcaggccagttaaactaatttcttgattatttcaaatttaaagactgataataaatgttggtttgaccttaacagactctcttatttaaggaggtcaccactttacaggcacttttaaattctttattatttacaaaccagactaatatggcaaaaagaaaacagaatgttaaggaacactgaagagggtatgagcagacaagaaattcaaatgtgaaatagaaacactaagaagaaagtagtaacaatacgaaagatccaatttgcaggaatttgattatctacttggttcctgggtactatggtgaatgtaatattggcaatgataaataatacctaaaattaaatagctttatatatgtaagattaacaaggagaaatgagttctccaggatacccaatgtattagtaactcaaccagttttttctgggttttatcatgtcctattacccagtctatgctttattgccatagtatatggcttctcaacataatacttggcatataatagggatttaaacgtttctgactgaatgttcctagtaagtgaattaggtgtgtgtatcctttattggaatttaacaaaacaacactttggcctctcaatttcctgagctcctcacttctggtgacctttctctattctatcctagaatttatctttagcaattactgtgctcactctaaatctcaattttaagcactcagtttcacacatatcacattctgatgaccacctccttctttccacacacttctttcatgaccctatggcaacagttctttgacactgctaagcctgcttttctgtttattgttgccccctctttcagtacttttccctcttcattttctcacatccatctctaacttagattccatagtaaaagatagtaatcactgtctttcctgtgcttcacctaccctggctaactcttcttccatcatcttcttccagtaaaacttggatctcacttgtattccattctcagactgctccattcttttgaacagctggatatggctagagtaaaatgccactatgttgacggtctttaccttgattttgtaaccataagacttaaatgttacctcaacacttcctagaaatcttattacataaccctggtccattcactctcctgctcttcaagacaaccattttataccttctttctcactgccaagcccaccacctttcattttcacctcacatcttgcttcatatatagaaatgatgaaaagagaacgttggtaccttacaaatctcccaatcttttcacatctgaatctattaattgtatccttttgaatgaataaattgcccctgttcttatctaaagtcattattttttgttttctgtcagttttttaaaagctcttttattgaagtataacacatgtacagaaaaaatacacaattcacaaatttacagctcaataaattttacaaagtgtaaacattcatggatccatcatccacatcaacatataaaagggtcttatcacagaaacctcccttatattcctgccccttttataatccccacaaaagtataaaaaaatcctaatttccattgccataaatttgtcttatttttaagctttaagaaaaatggaataatacagtgtaaaaccttttatgtctgccttctttaattcaacattgtatctgtgagacccatccatatttatagagcactttgtttctcattgttttatattttatatataaaatacgtttatatatttatatttttatatataaaatacgtttatatatttatatttttatatataaaatacgtttctatatttatatattttatatataaaatacgtttctatatttatatattttatatataaaatacgtttctatatttatatattttatatataaaatacgtttctatatttattttatatataaaatacgtttctatatttatatattttatatataaaatatgtttctatatatattttatatataaaatacatttctatatttatatattttatatataaaatacgtttatatatttatatattttatatatgctttatattttatatactttactgtagatgaaatttaggtgacttccagcttagaatcattataaataattttactttaaatatgttatacttatcttttggtgtatatttgtaagaatttctgttgatacatacataggagtgtgattgcttggtcatgagttctgcaaatgttctgcttaattgacaatgccaaacaattttacaatttaaactcccactagcagtatataggagttcctattgtccacatccttaccaacacttggtattgtgagcctttttcatttttgccagtctggttggagtagggtgttatatcataatatttttaacttgcatttttctaatgaccagtgagtgagatcaatcatgttttaatatgcatattatcgtttacatcaactatatatataaatttttcattgtcttgttttttaataaaatttttagagatcattgaatattcacatgcagttctaagaaatcatatagtgagatcccttgtagtctctctattctgttccattagtctatttttctattcttgcaatatgacactaagcacactatcttaattactgtgacttttcagtaactattgatatctagtagtatacatgcttcaactttgattttttgcctgcagaaatttcttccacattctaagtcctttgtatttccatataaattttagaatgggcttgtttatttctactaagaaatctgcttgaatttcaatggggattgcaatttgtaaggaaaatttacactttaagaggactgagtcttctaattgaggaatgtggcatatctctgaatatatttaggtcttatttaatttctttcatcaagattttctaatttgtaatatagaagttttcattgccttctctcatatttctagttattttggtttttgatgatatatatatatgtagtatttaattttcattttaattttctcttgttgacttatagagatacaattttgtatgccactagcaaatgaccctcactcccgaatacaataattctctgtatttcttttttaatagtttaatgcacagttatctgtgggttatgtttagtgatattctgggagactgaatggaataatatacctgtcaagcccactaactggccttcttccttctttaagtactttcactcccagtagaagtatatcctgctctgtattcacctcctggatgatcatttcatcatttataactgtctactttgttatttctatattagtaccttaagcaaatagcctcctttatatactaaaactaatataaagcattatgaatgcatacactgttactagtctggatagagatctagttcattatccattatacattccactgacagaagtagaaagaatataggaagaactgaacagtaggggtccaggtaggagtccatcctttccatgccctagtagggacactcgacgctcaaggaaaatatctcaagatctcctcctctctgtgcatggtctctcatcccttgagtgacatgatgacatataaaacattcttagaatttcacttgaggcagatattactaattaattaatcaaagcaagcatgtgaaatggtatcaatttgccaaaccaggttcagacattgtgcctcaattcagaaataatagaattatgcaaatctaaaaatgtgaccctcaaaagtgtggaatacctctgcttgaggtaataccgctcctctccttcagctactcactcaactctgacaaatcgtaactcagtttactccctatatccccaagctttctttgttaaaagaaattttgaactacttgcttttgaaagtaactcacatggcatgctcttagcatcatctagcacaagctttgttttcttctgttcaacttcctttcagaggtgcatttttacaacttccctctattgttctcattgactttccgggtttgatgcgacctgaaaaactctcctttctgaaattcgttaaccagcttcatcagttttatagcaaggactggaagcaccaatttaaaatttaaatggtacaatgataacttcaaattagtttgatcaattattttaggaaattccaaaaactgaaatttcaaatattgaaatgcaggaacttccttgcccctccctggctctataaataattaaaataaaaagtttcctcacaggaaatatataaaatatgtttgttttgttttgctttagtggaggaaaagagtgtaaatctagaactaataatttggggttttctttgtttgtttccacagaaataatcaatgattccacactaatagaaaccatttgtcccaactgaaataggcaaaaacacggttctgttccaattttacaatttttttttgtttcttcacacaacaccgtggtgatgcagtgtctagactttttggaacaaggcatggagtctggaatttattctgtgggtttgaaaatggttattcagtgctcctacacattcacatgtgaaaatctaatgatttcataataggtaaaaaccatcaagctgtttaccaaatacatatatattcattaatgctataagttcaagctgctacttatagcattggtgaatatacaaggaaatattgtatggattaatatatgtcatctcattgtgccgtggtccccattaacccctatatctgaaatatgcaaaataaaaaacttgtgttcatgaaataattattgcagatattttctagcttttgtgaggctctagtaaaaaaaaaaaagcttaagaatatacatctattcttgtggtttcaataagtaatctgtgagaatttatcaagttaaaagggcagaattgatatcacaggtcgttctcttagtcctctgccatttattagctggataaaatgaaagcagtctctgaggcacccagatttaaccagtgtttgtgcaggctgtattattaagtctgactgtagttcatctgtgctctgaagaaaatcaaactatgtgcttgcagagaaagttcagagttatttgtcaccaattacctaaagctgggagttgagcttacacatagctatggccaattcctgtaaatacttgttcctaatttcacaagactgtcacttcctgaggatttaccttagaaagtgtatgtctaccacagaagaactgtaatacaaaaatgtttacccagagataatagtcttaagggacataaaactccatagcattgattagtttaaaataacctgttcttaattttcaaacaagtatttcaagttctgttaggttttctgtgacaaaaaaaaagcaagcagaaagattttttttcattaaaagatacacacacatacaacacattgaactgagctaatctcaattatactattaaatctctactggttattttaagaaaagaaacataaaagtaagttaccaagtatttaaggtagctcgcctggaagaaaattaggttgtctgaatataaagtgaaggttaaaaaaaatggaaaaaacaaaaaaaaactaaaattatcaatcaatggcatgtttctatatttcttacttaaattattaaaggccattaaaacaagttaatacctatattacataaaaatgatcagaaggaagatcttaagaccttatttacttcaaaaataatgaagtagactgaaaagtgtgctgaatactaggtcagaagaactgggggctgggcgtgggggctcacacctgtaatctcagcattttgggaggcagaggccagaggatacttgaggccagaagttcaagaccagtctgggcaagaccctgtctctacaaaaataaaagtaaaaaagcatatctaggcatggtggtgcatgcatgtagtcccagctacttgggagggtgaggcgggaggatcacttgagcccaggagtttgaggttacagtgagctatgattgtaccactgtactccagcctgggccacatgagcaagactgcctctaaaacaaaaagaaacgagaaggaaagaaacaacaacaacaacaacaacaacaatgacaaaactggagtttatcctcgttatataagaacctatatttctccatctgtaaaataggtaaagcattttgcttgactcagtgttgctctgaagagaagttgattgtgaattgcatgacaggcagttcagttttggtcatgttgacaactttattgaatgtcatgaaagaagtaaagatactctgattcagttttactaaaacaaaatgcagatggagttttaaataagtgtcatttgaagaagtttagctaagattcacctaaaatgctactttattattaagttctgggatacatgtgcaggtttgttacataggtatacacgtgccatggtggtttgctgcatccatcaacccgtcatctacattaggtatttctcctaatgctatcccttccctagccccccaccacctgacaggctgcagtgtgtgatgttcccctccctgggctcatgtgttctcattgttcaactcccacttatgagtgagaatatgcagtgtttggttttctgttcctgtgttagtttgctgagaatgatggtttccagctttatccatgtccctgcaaaggacatgaactcattctttttatggctgcatagtattccatggtgtatatgtgccacattttctttatccagtctatcattgaagggcgtttgggttggttccaagtctttgctattgtgaacagtgctgcaataaacatatgtgtgcatgtgtctttacagtagaaagatttataatcctttaggtatatacccagtaatgggattgctgggtcaaattgtatttctggttctagatccctgaggaattgccacactgtcttccgcaatggtagaactaatttacacttccatcaacagtgtaaagtgttcctatttctccacatcctctctagcatctgttgtttcatgagttgttaatgatccccagtctaactggtgtgagatggtatgtcactgtggttttgatttgcatttctctaatgatcagtgatgatgagcttttttttcatatgtttgttggccacacaaatgtcttcttttgagaagtgtctgttcatatccttcacccactttttgataaggttgtctttctcttgtaaatgtgtgtaagttacttgtagattctggatattagccctttgtcagatggatagactgcaaaaatttgctcgcattctgtaggtcgcgtgttcactctgatgatagtttcttttgctgtgcagaaactctttagtttaattagattccatttgtcaattttggcttttgttgccattgcttttggtgttttagtcttgaagtctttgcctatgcctatgtcctggatgatactgcctaggttttcttctaaggtttttaaggttttatgtcttacatttaagtctttaatccatcttgagttaatttttgtataaggtgtaaggagggggtccagtttcagttttctgcctatggctagccagttttcctaacaccacttattaaatagggaatcctttccccattgcttgtttttgtcaggtttgtcgaagatagatggttgtagatgtatggcatatttctgaggcctctgttcttttcccttggtctatgtatctgttttggtaccagtactgtgctgttttggttactgtagccttatagtatagtttgaagtcaggtattgtgatgcctccagctttgttctttttgcttaggattgtcttggctatgcaggctctttttttgttctatatgaaatttaaagtagttttttctaattctgtgaagaaagtcagtggtagcttaatgggaatagcattgaatctataaattactttgggcaatatggctattttcatgatattgattcttcctatccatgagcatggaatgtttttttccatttgtttttgtcctctcttatttccttgagcagtggttcatagttctccttgaaatgatccttcacatcccttgtcagttgtattcctaggtattttattctctttgtagcaattgtgaataggagttcactcatgatttggctctctgtctattattggtgtatagaaatgcttgtgattttttcacattgattttgtatcctgagactgtgctgaagttgctcaacagcttaaggagattttgggctgagacggtggggttttctaaatatacaatcatgtcatctgcaaacagagacaattggacttcctctcttcctatttgaatgccatttatttctttctcttgcctgattgacctggccagaacttccaatactatgttgaataggagtggtgagagagggcatccttgtcttgtgcttgttttcaaagggagtgcttccagcttttgcccattcagtatgacattgagtgtaggtttgtcataaatagctcttattattttgatacgttccatcaatatctagtttattgagggtttttagcatgaagggctattgaattttgttgaaggccttttctgcatctatcgagataatcatgtggtttttgtcattggtcctgtttatgtgatggactacatttattgatttctatatgttgaagcagccttgcatcccagggatgtagctgatttgatcataatgataagctttttgatgtgctgctggattcagtttgccagtattttattgaggatttttgcattgatgttcatcagggatattggcctgaaattttctttgtgtgtgtctctgccaggttttggtatcggggtgatgccggcctcataaaatgagttagggaggattccctctttttctattgtttggaatagtttcagaaggaatggtaccagctcctctttgtacctctggtagaattcggccatgaatccatctgctcctgggctttttttgttggtaggctatcaattactgcctcagtttcagaacttgttattggtctattcagggattcgacttcttcctggtttagtcttgggagggtgtatgtgtccagtagtttatccatttcttctagattttctagtttatttgcatagaggtgtttatagtattatctgattgtagtttgtgtttctgtgagatcagtggtgatatcccctttattattttttatggtgtctatatgattcttctctgttttcttattagtctggctaatagtctattttgttaatcttttcaaaaaaccagctcctggattcattgattttttgaagggtttttaatgtctctatctccttcagttctgctctcatcttatttatttcttgtcttctgctagctttttaatttgtttgctcttgcttctctagttctttcaattgtgacgttagggtgtcgattttagatctttcctgctttctccagtgggcatttagtgctatcaatttccctctaaacactgctttagctgtgtcccagagattctggtacgttgtgtctgttctcattggttcaaagaagttacttatttctgccttcatttcattatttacccagtagtcattcaggagaaggttgttcattttccacgtagttgtgcagttttgagtgagtttcttcatcctgagttctaatttgattgcactgtggtctgagagactgtttgttttgatttccattcttttgcatttgctgaggagtgttccaattatgtggtcaattttagagtaagtgagatgtggtgctgagaagaatgtatattctgttgatttggtgtggagagttctgtagatgtctattaggtctacttggtccagagctgagttcaagtcctgaatatccttgttaattttctgtctcattgatctgtctaatattgacagtggagtattaaagtgtcccgctattatggtgtgggagtctaagtctctttgtaggtctctaagaacttgctttagtaatctgggtgctcatgtattgggtgcatatatatttaggataattagctcttcttgttgtattgatccctttaccactatgtaatgcccttctttgtctttttttatctttgttgttttaaagtctgttttatcagagactaggattgcaacccccgcccccttttttttttttgctttctatttgcttggtaaacattcctccattcctttattttgagcctatgtgtgtctttgcatgtgagatgggtctcctgaatacagcacaccaatgggtcttactctttatccaatttgccagtctgtgtcttttaattggggcatttagctcatttacatttaaggttaatatggttatgtgtgaatttgatcctgtcattatgatgctagctggttattttgcccattagttgatgcagttttttcatagtgtccatggtctttacaatttgatatatttttgcagtggctggtgccagtttttcctttccatatttagtatttccttcaggagctcttgtaaggcaggctcggtggtgatgaaatctctcagcatttgcttgtctgtaaaggattttatttctcctttgcttatgaagcttagtttggctggatatgaaattctgggtagaaaattcttttaagaacgttgaatatttgccaccattctcttctggcttgtagggtttcttcagagagatccactgttagtctgatgggcttccctttgtggataacatgacctttctttctggctgcccttaacattttttctttcatttcaaccttggtgaatctgatgaatatgtgtcttggggttgctcttcttgaggagtatattgtggtgttctctgtatttcctgaatttgaatgttggcctgtcttgctaggttggggaagttctcctggataatatcctgaagagcgttttccaacttggttccattctccctgtcactttccagtacaccagtcaaacgtaggtttggtcttttcacatactcccatatttcttggaggctttgttcattctttttcattcttttttctctaatcttgtcttcatgctttatttcattaagttgatcttcaatctctcatatcctttcttccacttgatcaatttggctaatgatacttgtctatgcttcatgaagttctcatgctgtgtttttcagctccatcaggtcatatatgttcttttttaaacgggttattctagtcagcaattcctctagccttttttcaagtttcttagcttcctttcattgggttagaacatgctcctttagctcagaggagtttgctattactcaccttctgaagcccacttctgtcaattcatcaaactcattctctgtccagttttgttctctcactggcgagaagttgtgatcctttcaaggagaagaggcattctggtttttggaattttcagcctttttgcactggttttttctcatcttcatggatttatctacctttagtctttgatgctggtgaccttcagatgggttttttgtatggatgtcctttttgttgatgttgacgctattcctttctgttagttttccttctaacagtcaagcccctctgctgcaggtctgctggagtttgctggaggtccactccagaccctctttgcctgggtatgaccagcagaggctgcagaacagcaaatattgctgcctgttccttcctctggaagcttcgtcccagaggggcacccaccagatgcctgtatgaggtgtctgccagtcaggaggcatgagggtcaggggcccacttgaggaggcagtctgtcagggacccacttgagggacccacttgaggaggcaaagctcaagcgctgtgctggaagatctgctgctctcttcagagccagcaggcaggaacatttgtctgctgaagctgcgcccacagccactcatacccacaggtgctctgtcccagggagatgggtgttttatctacaacccctaactggggctgctgcctttctttcagagatgccctgcccagagatgaggaatctagaaaggcagtctgactatagtggctttgccacccagtttgaacatctcagcagctttgtttacactgtgaggggaaaacagcctgctcaagcctcagtaagggcagacacccctccccacaccaagcgccagcatcccaagtggacttcagactgctgtgctggcagcaagaatttcatgccagtggatcttagcttgctgggctccgtagaggtggcaccctggcttcagccccttttccaagggagtgaatggtttgtctcactggcattccaggtgccactggggtatgaaaaaaaaaagctgcatctagcagcccaaatagctgcccggttttgtgcttgaaacccagggccctagtggtgtaggcacccaagagaatctcctgttttgccagttgtgaagactgtgagaaaaggcatagtatctgggccagaatgcatgttcctttccgcacagtccctcacggcttcccttggctaggagagggagttatccaaccccttgtgcttcccaggtgaggcgataccctacgctgcttcggctcaccctccttgggctgcacccactatctaaccaatcccaatgagatgagccaggtacctcagttggaaatgcagaagtcacccgccttctgcattgatcttgctgggagatgcagaccagagctgttcctattcatccgtcttgccaactacccccaatgcttattaaccatactacctaggaactccagtttggcaaggaaagtctaaataatggaatagatactcatgtgaactagtgaacattgctgtatatggccacaagtcatgtttctaatgacctctaattcacagaatttcttcttagagatgtagagagtggagtggggatggaccagagtagtattctacagagggtgccagtgacatcctcttatgcaaaggatacacatactaacttactgggcaagttgcaaagtttagaattactaactttagaataggaaatactcaaataggtaaggatttgtccttttactagtatatagtaaaccttggaaacccatgaccaaagggcagaacatgagccacaaatctatcaattctgaacttaattaaattcatggttgataaaaatatattctcacttgctataaatctgctagatttttgagattcaattaaagaaacattttccagaatatatttcttagagtagtagttttaagcaaaactaattaatgataccaaaatcaaaacaaaagttttagaaatactagtttatcacctttaataggcttcttctgtaaaacacgatttctcagtttaatcatatgtcaatatcaagaagaggatatatcaggcagcattgctgaaatacattggaacacagaaagctttactctcagtatagctagtgttccaaggaatatattgtaaaaagggctaaattaaaggatatttagaacctatatagcagaggcaaattacctatctgaaatgtccagggaactgttatctacaacatactctatagagtaatcttgttgaaaaggcagatgctggctgggcacagtagctcacacctgtaatcctagcactctgggaggctgaggcaggtggatcacttgaggccaagagttcaagaccagcttggccaatatggcaaaaccctgtctctactaaaaatacaaaaattaaccaggtgtggtggcacacacctgtactctcagctactggggaagctgaggcatgagaatcgcttgaaccctggaggcagagcttgcagtgagccaagatcacgcccctgcactccattctgggcaacagaatgaaacccagtttgaaaagaggaggaaaacaacaacaacaaagaaaaagaaaagatggactagtgttcagatgctttccttgattcagaatcagcatgcctcttaaatactgaatatactaagatacacaaaacagtaatttagctttttcatattgatacatgaacttagtatttgatctcagcaaatttagtaaaataatcaggagcttttgatttgccacaaaaaatcattcctctaaactttatgaattgagaaaacttgtctttatttgatgattccagttttgatgttttgtgttattggtgaagttcagaaactcagaaacatagttgattccatagaaaattcaattcttgaagagtagaactttgaaggtgcaggatgaatatgtgtgttatgaatatgggtcatactttatgcttatgtaactgaacatgtagttttactggggctccctttcttcattgcaaaaatacaacttatcctcaatacataatttattgactactacaacttagcaaaaaatgatttggcttcattattcatcccgataagaaaaatctggtgaattaaaggtattggaaaggaaattttaacactgatatgagaatgaaatgggagaagggaacaatagagacttcaatattatctgtaatactccatttttttatatttaaaaaagtgatgcaaaaatgaaaaaatgacatttgccaataatgccaatgtatcacataactattacattactttgctgcttttttaaattcaaaaaataaatattactaaccatttatatgatcattcattcaacaagtacttgttgagagcctactatgtgataggtgctagcaataaaagagagtaaaaaagagacatcatccccaactctcctggagtttgtgtttagatgtgaaatgtgaaatgtttgagatcttatttagaatagaatgtgtaaaaggacaaagtgaggaaatgggggtgaattaactcatattgataattaagaggtagggctactgtgggtacttaatcagcaagcaaaggcctttcaatacagagaggagctgccttatttttagtgaaaattgagctgggaaaaaatacacactggctatgggccccatagctaaagcagtctcctgtggtatttaataattttctcactggttgcagctcaaagttcacatgcatttttctttgattctctctagtatatgactgctgctgctcctatgcaagggacctacattcctcagtacacgcctgtgcctccgacagctgtttctattgaagtaagtctacccctgtctaataaagaggttagaagaaataaatctcagtcacatatactgtagtcccccataaccataggaatcctcacttgcaatttttgtgctactctaaaatatgacattgtaaattcagtgtatgaaagtataaacatttacttgaatgtggctgtgttttgctttgcacatgaaatgagctcatctgctatggaggcacgacgggagtctctttcatatttagagaaaattccagaggccaaatcacaactccatcaaattttaatcacaaatacttcttataaaaggaaaaaagtttgcaactatgtgaatgaactaattctctaatgccttgttcctcaaagagtggttcctagaccagcatcattggtatcccttgagagcttgttagaaatgcagacttgctgggcatgatggcatgcacctgtaatccttgctacttgagatgctgagacaggaggatctcttgagaccagaagttcgagaccagcctgggtcaaacagtcaaacagtgagaccctgtcagaaggaagatcagaaggaagaaaaggaaaaaaaaagaaatgtagacttttaggtactatccagacctactgcatctgaatttgcattttaagatgatcactcagtgatccaaatgcacattaaaatttgagagacactggactaatgcactggttctcaaattttctgcacatttgaattattttgagagctttaaaaatattgattcctgagtcctatccccagagattatgatttatttgtctggagtatagactgaacatcatatttttaaaagatcttagatgattctaatacgtaccaaagactagaaaccattgctctaggccatgaacctgcacaggtttacagcttcttacagacaagaaagaagttgtacaactcttattgctgtagatatcatgaatgatgatgtcagcttgtccttaatggaagctttgctgctttcattctctctttccattgggataaatctatgccctctacacatcattttactggacagggccataaactacatagaaatggagagggcatagagctatgcagatggtggtaaaacacttaggtacctatattcttctttctggttctagccattactgttttattgcccttctttcccctctcctgatgcacaggtgcattatggtcaccgtgcattccttctcagcagctgggaatcccctgcagctgatgtctttgctactccatttgttggcaagcaactactgtgttggtaccactccacataaaaattcaccaagactcccaatctctgagattgagggaaacctttacggactaaattggatcttctaaaatgtttcctggttttggtgtgtgacaaatgtttgttcataccaaggtttaggaaatccagatgtttaacagggcactgatggaaatcaaggagttccaatgtttaaatctttcatgtgttctagacctataggtctcaaagaatgtgtcatcttaaacagttttaattgtcttttcagaattgcaagaatatatgattaaatttcatgttctttggtatatttagctttcaaaaagcacctatgcgataagaaaattaaaaatctggacattctaggcagtttaagtgtaaacttctgccacatattttcatttctctgtgtacaccaaagacaaatacttatctacaaaatttgaccattttgatgattattatgagacatttgacagcgtggcttattggaaacagtctaattatatttagggattaaaagaaatatttcattgataaaaatataaatatactctgatatattgccttgaaccagtgattataaggaaaagcattaattcattctctatgtgaaaacactcattgaacatttatcaatatctataaaggtgggaggtttcaaaaaataaataataccaaatagtaaattaggaaagaaaagattgaatagagagacttttcaaattctaaagaagaaatttagggaatttcagcgacagaattaaccaagaacttctgaaatttgacatcactgcaggtatccaggactacaaataaaaccaggaaaatttatcaggataggtgctcttcttaggcctactaacaaccaaataaaatcacctatgcctctctggattccaaaaatatattcctgattgtgaccaattccggaaatccactcttgccagcatctgtgagaaacaaaaaaaaaaaaaaaaaaaaaaatagggtgaaggaaaagcaaaccaaaattaaggacaagttttgttgttgttttcttaaaacttcttgatgactttcagttcatataccagaaaacaaaacaaatcaaatcaaattactggagagaaaaatctacttaatagcatcctttaaaagatttccaaactttgatgtatatttttattaaggtcactttccattgttatcccaaatggtatagacatgatacagtgaaatatgccaggaaaatgtttggacatacaagtttgtataggaatcctgaatgaggataaattggcatttattgtggataaatgtgcaaacctggtttaaaagttccaagtataggcaaaattattttctgaccacttaactactccaacaacttctaatggcaaggcttcttggtgtcacattaggatgaattacttagcccttatctaaatgtgctctctgggtttcctctgagtacttattgtgacttcatgtagctgagggtatctctacttaagccaaatagaagaggggtacttacagcctatctagagagggcccttcactgaagcaagtaaggcttttatgttcttatttgcctccttagggtgttgttgctgatacctctccccagacagtggcaccttcatcccaggacaccagtggtcagcagcaacagatagcagtggacacatccaacgaacatgcacctgcatattcttaccaacagtctaagtaagtctgggctgtgctaagctcttttcctcaagatcagccatcttgacatcactctctcatgttgtatgtgttagcttttgctgaaatataaaccatcccaaacttagcaacaggcatttatttagctcatgattatgtgggtttgaaatttgggctaactttgggtggatggttcttctgatcttgacaggaatcaaacatctaggaacagctgctgattatctatgcatctctgcttctgggtgttgctagctgttggatgtgtgatggaagtgactaggccatatgtttctgatcctccagcaggctaattcacatggaagtctcagaatttcaagaatagtaaagagcaagcccaaatgtacaagcactcttaattctgtttattactaattttctactgtctcattagccaaagcaagtcacttggccaaacagtcaatgtagcagttcactttgaaaaagcttgatatagagagaggcactgcagccattaaaaaaaaaagctaccatatttattattggaaaaattataatattcctacctgaaactgaatagagtctcagtctcctcactcttaaaggaagacagtaacactcccccttgtagggttactttgaatacacagttaaatgtcgatgaaaaagggtattgtaagatatgaagcaatataaaatatggtcttattcaggaataaaatggcaaggattttcagaattactcttgaaaatccttaaatcactcataatgcaaagtacatttggctttgtgttgagtaaacatttggcaaactttggtaaagtttgagggctgtttattgaaaccaaaagaatttagaaaagtaaagtcttcatacaagtgtcttggcatgcaaactattcaactttgtagatagcaataaaatccctgatgaatagagaatcccccgacaatcctgcctgtctacagagtgctgctccgttatttaaaataatttttcttattaaagaaaaaaaatattctgatatttgttaaaacattaagaaataatttatttattaggttggtacaaaagtaattgcggtttttgccattaaaaaccataggtattaggccgggcgcagtggctcacgcctgtaatcccagcactatgggaggccgaggcgggcggatcacgaggtcaggagatagagaccatcctggctaacacggtgaaaccccgtctctactaaaaatacaaaaaacttagctgggcatggtggcgggtgcctgtagtcccacctactctggggtcggggtggggggctgaggcaggagaatggcgtgaacccgggaggcggagcagcttgcggtgagcagagattgtgccactgcactccagcctgggtgacagagcaagactccgtctcaaaaaaaaagaactataggtattaaaattattgcaataggggaagagagagcatgctcagttcagaacacagcaaagacagctggggatctgtagccaacaagccgagtgagggggtcagtgagtggggaattactgctaacctaaattgacaggatttttgctgaaggcagatcaaggaatgataagatcaaatgtaggggatgagaaaattgatcagatattgagggtggtcatatcaacgataggctattctctttaaactgacttagcaagattcttgctaaaactaggctataaagaactggcaagaatgggggcaaaagtctacgcctactcaagaaggggactcagtagcctgactaaaagttgagcaagaagagaatctgtcactttttaacttcagtatacattaagagatttgtttgttagattcatcaaagcagtaaactctattatgtgtggtttaggtctaaagtcagttttacaaattaaatttgctcagaatatgacttaaacttacaaatgtaaggtattattatgattgccattattaatagcaataatgactttcagaaaagattgttactgagtaaagccatatgttattgtt

SEQ ID NO: 14609 - DNA, 8798 bp, Human
ccactcggaggctccgagaacggaggcagcgcgggggcttcctggggcccgtgcatcggaggaacaaggccaagcggagggaagcagcaggaaccaggacccctgcagatggtggaggcaagaggctttatctgagcctttgggaccctggccacctgcccagctccatctgcatgggagaacctaggggaggggctggttctggtacctgggcccactgaggccttgagctgagcttccagttctggcaggtccccagcacagcagcctgggggctcctctggcacagaaggcctcgccctctgtgctctctgcagccgccactgggattaaggggaccaggtgtgtctgtggcacctgtgccctcctaggcatctcgccagccaccagctgaacaggtttggtgctcctgggtatctgggaggggctggggacgttcctgcctcctggtgtggcttagactgaaagtcctgcacgtccgaactcagggatactcgaggcttcctggacatagactcacgggcccagagtctggccgggctctgagggacgctgcccggccaggtgccccggcaccctccttccgcattccccaccccccacccctccccctgcatcctccccaaccgaccccagacagagctgggacggcctgagggacactgcccaggccggcaccccgctgcccctccccaccttggtcagcgctgagctgggctgcccagaaatctatgagcctgttaaataatccagattattgttcttaatctcaaaacaatgagtggaaggtgccattatttctctttgcaataaaaataaaagttgaaatacgcagtttagggactttccttaccaccccttgcagactttgaatttcccttcccgccccttcctgcccccttgtggctgccagtccaggtccctgggttggagctcccgggtggacacagtagggtcagtgggagggtggggcggggaggggcctccagggagggggtgtcccgagtctcaggggctggggggcaggcggccgtcgggtgcaggtgggggtcacggcagggctcactcaggcatgagtcgggagaagggaggccagctggaagggggcaggggtcctgcgggctggacaggaggaggcagaggctggaggcgggaggggctgcctgggagggacctgtggccttgggccccagcgccatgggcgcttccaggccgcactcacggtccttgcctgccccctggcgtccgtgtggaggaaggcagtgcccgtttcttcagccgtgggtgcccctggctctgcctccccggggatcccccaaaaccctcgggccctcctcttccgggaagtcctccgggccgacccacacagctgtcgctgccctgattccactccctcttccctgcttggcccttacccgagggcgggcctgcccatgaggccgctctcaggacgcctgcccacagcagctcctgacattgggccctgtgctcaggggtggagtctggggctgggtgagggcaccgacgggtggaggggaagctgccggaagcggggagagaggcggcccccacctgtgcccccgcagctctgagggttgggaaggcagcgcctgcagccctcaccttcctgccctcaggctgcgaggcttgttcccagagggccgttggcttccctgagtgcctgagtgtccataagttggacccccaagaagccccaaccgggaggtcctcctccccctctcctgcgctcaggccggccctggcggtgcttgcccagtgggttcccatagtgcgggcgctaagtgctcagatgggccccagtgggcctgaggacttgtggggccggctgggccctcaggaggagccggggtgctctggagcgcctgtgggtgctgggtgtggctgcttcccggcctgtcatgaggaagtgggacggcccgcctgccacgcccagctctgggtgctccagctgggccacagcctggtcctgccgctgcgcccgcccgccatggtgtcccgggaccaggctcacctgggccccaagtatgtgggcctctgggacttcaagtcccggacggacgaggagctgagcttccgcgcgggggacgtcttccacgtggccaggaaggaggagcagtggtggtgggccacgctgctggacgaggcgggtggggccgtggcccagggctatgtgccccacaactacctggccgagagggagacggtggagtcggaaccgtgcgtgtcctaggctgctgggagctttggcacaggccaccctctaggcacaggggagggacagggctctgggctgctcagggaggcccaagaaggtggggaccccggttccatcttcctgcaccccaaagtccaggctgggcatcccgcttgatcctccctgcaggccccatgcgctggcgcccaggagtgcccaggactgtccctgcgggagttggagcacgggggtcagagggcacggcccctgccttgggctcatccttgtcacagctcgggggtggacgctgcattgccgggacccagggaggacagagggtccagggtggacttctggggcccggtggccagtgacaaggtctgtcggagcgttccagggcctttgggggaaacgaagcttgaagcttgcccagtttccaaagtgccggaaccagacacacgacctagttaggggagcgggccggctgccgggcaaacttcctgcctgctgtgccctgcggggaaccagacagcagctggtgtggcctggccctggcttccacagctgcccggagctcaggctgaggagggtcacgctcctgagatcccgcgtttctcatcagtgattgggcacccactgtgtgtgtgcgtgagtcacaggctgtgtagggttagctcccgggggacccaagcaacaagcaggggaggctgtaaagaggccgtcgggcaggggcccatggtggagacccctctattacgtgcagacccacgacctcgttagcagggtcacgcgcagacccacgacctcgttagtgagcaggggtgcaggggtggggtctggccggaggctggtcagctcccaggtgcaaagaccctgagtcctgagaactcgcccaggtgagaagtggggaggaggccaggtgaggagggggtgggaggccaggtgggggggggagcgggaggctaggtggggggggctggaggccaggtgagggggggcgggaggccaggtggggggggcgggagaccaggagaggaggggacgggaggccaggagaggagggggcgggaggccaggagaggagggggcgggaggccaggtgaggagggggcgggaggccaggtgaggggggggcgggaggccaggtgaggggggtgcgggaggccaggtgaggacggggtgggaggccaggtgaggggggggcgggaggccaggtgaggagggggcgggaggccaggtgaggagggggcgggaggccaggtgagggggggggcgggaggccaggtgaggagggggcgggaggccaggtgaggagggggcgggaggccaggtgagggggggggcgggaggccaggtggttggaggggcaggtggggcagtgcttccaggtgtgcggaagtggagggggtggaccccaggggctccatgctgggccgtggtcttctgtgtggggtttgtgttccagtgacctgagggagtcagacacacaaagggcgcaggtcacctggagcttctgcaagctccacctggaagtccacagtccagggctggcccacaccccgcagccgggagttagtgcgcgcgagtggctgtgtgtgcgtgcgtgtgagcgtgtgggcaagtgagcacacatgcgcgtgtgtgttcaggtgtgcgggtgaactgtgcgcatgtgtgggggtttgtgactgtgtgtgtgtgagcgtgcgtcacacatgggtgtgtgcaggcagctctgggcagccatcctgctcagctgccctccccagctccaccctaggctctgacccctagactcgggccactcagggcagggtgtggtagcgcctgcccctgcccccgccgggtcctcaggggcctgtcctggcctttcgggacattcagggcgtctgggtcagcgacagctcctgagagcagctgtggtcagggctgggagcttgaggtggcaggcaagggcggctggggttccaggcgggcaggctggggccagcgtggggtccacgtggggtgggcccaggtccgcgtgttctcagactcctcccctgcaggtggttctttggctgcatctcccgctcggaagctgtgcgtcggctgcaggccgagggcaacgccacgggcgccttcctgatcagggtcagcgagaagccgagtgccgactacgtcctgtcgggtgcggccccggcctccgagcctgtgcttgcctgcgggggctcctggctctaagccctcccagccacgtggtgaacccggctcgctctggctgagacgggggacatgggctcctctccagggagctcccatcccctccgcccacctggcccgctcctccctggggcctgggtcactggctgctagggtagtcgtggggcagggcccctccctgggagggcaggggcttctccagccagccctgcccgaggcactcgtgggaggtcctcagcacccatgggaacctcgcccagcatgagacctgagcctggggtgtgcggggcgcagagaaaccccatccctgcccctgaggatctcagcatggctgggattttaggcagctgccatccaggcggaggccactggctgcctggcacgggggcaggaggggccagagagcttggccagagcgtgcagggcaggagggagccgttctgagggaggggaggcaggggtggtactgaggaagcaccaacagcaactgtggggacccagaaactctgcgcaggtgtggccagcagggctggggacgcagggaggcgtcggagttggggtggccacacagctcacgctctccctcccagtgcgggacacgcaggctgtgcggcactacaagatctggcggcgtgccgggggccggctgcacctgaacgaggcggtgtccttcctcagcctgcccgagcttgtgaactaccacagggcccagagcctgtcccacggcctgcggctggccgcgccctgccggaaggtagccgctccgccctgacttggtcacgcggggtcaggctggggggtcacaggctggcatttcctactgggagaggttggccgggcagcatgggaggggtcctgactcactgacctggggcccactggagggaagcccatggttctgcagagcacaggtgtttgcctgagttgggggtggggccaggagaccatccccgggcctggccactctcggagaggccagcggcactctgcagggtcctggctccggtctgtctgggtgtttcatgctgggctgggggcagcccccaggagagtccacccttgtgtcagacactcagaaacccccaacccaggctgatcgtggccctaaatctgaggctaaatccaggctccctgtgctggcttcagactggcacttcctgaaggatgagcccctgccctgtgtccccgactcttcctccagcacgagcctgagcccctgccccattgggatgactgggagaggccgagggaggagttcacgctctgcaggaagctggggtccggctactttggggaggtcttcgaggggctctggaaagaccgggtccaggtggccattaaggtgatttctcgaggtgagtgggccccgatcagggctctgtgtggccccgtgcctgccctgggccaccctcccaccccgccaacagggacctctggcctcgagccccaagcagcacccacagcgtccatgcgagagtggttccctttcaattgcacctatgtttttacctaaatacatttattataaaagaaaattttaggccgggcacggtggctcacatctgtaatccccacactttgggaagccaaggtgggcggatcacgaggtcaggagtttgagaccagcctggccaacatggggaaaccacgtctctactaaaaatacaaaaattagccgagtgtggaggcatgtgcctgtagtcccagctactcgggaggctgaggcaggagaatcgcttcaacccaggaggcggagattgcagtgagctgagatcgcgccattgcactccagcctgggcgacagagcaagaccccgtcttgggaaaaaaaaaaaagaaagaaagaaagaaaatttaaaatccttgacgtaatggaaagccattaaaatagatcactggaaatgggtaaaacttccctggaacccgtctgggccccagcagaggtctggcctctatgtcagaggtctgggccgggcacaggaagaaatcgggtggccaccacagccccgtgggtacgccaggctggggccctgtggggccggctgcatctgccatttcgtggcctcgggagccaggtgccctgtcgggggcaggaggtctgtgtgtcctgcacagctgctgggtgtgatggctgctgtgtgtgggggcagggccttggcctcttccttggggcctggggggtcaggggctgcatccaccgaggccacccgtccccgcagacaacctcctgcaccagcagatgctgcagtcggagatccaggccatgaagaagctgcggcacaaacacatcctggcgctgtacgccgtggtgtccgtgggggaccccgtgtacatcatcacggagctcatggccaagggcagcctgctggagctgctccgcggtgagtggcatgggccggggctcttgctggaggcagcgggggcacgtgaggaaataaagtgcacacccccccccacgtctacacacacacacacgtagacacacagacacacagacacacacatgcacacacacagacacagacacagacacacagagacacacacgcacagacacacatgcacacacacatgcacacagacatacacatgcacacacagacacacacacaagacacatcacatgacacacacagacatacacatagacacagacacacacacagagacacacaaaacagatcacacggacacacacagacacacacacagatcacacggacacacacagacacacacacacacagacacacactgatccagacacacacacagacacacacagatcacattggctcaaagacttcatcctctctaagttccattatttcctttctcaccaaaaccaaagacaatcgctgccagggaatggagatgcccgtgcgtgaaggcgcagtttggattccgatgttagaatgggagggaacgttgtggtataggaaaaatgccgtgtgtgtctgaggagagctacactgaggcaccacgcacgtttgcgctctgagcgaaaggctccgtacccctcgccctcacacaaagggcttgatcatctcagacagtccccacgcccttcagggtcctccgggagggaatgtggggtaaaacaggcaccaccaggccgcaagccgctgacagccattctcctgttcgagttcccactgcctacatcacgcagtcatgagcctcttcgctggtccttctgcgtccagctcctcccgcgtcatcacaaacttccagaagggaaatcgctgggctagaccactaggaactgctccttggttcttttttttttttttgagacggagtctcactctgtcgcccaggctggagtgcaatggcgcagtctcggctcactgtaacctccacctcctgggttcaaatgattctcctgcctcagccacctgagtagctgagattacaggcacctgtcaccacgcccagctaattatatatatatatatatatatattttttttttttttttttttttgagacggagtctggctctgtcgcccaggctggagtgcagtggcgtgatctcggctcactgcaagctccgcctcccgggttcacgccattctcctgcctcagcctcccgagtagctgggactacaggcgcccgccaccacgcccggctaattttttgtatttttagtagagatggggtttcaccgtgttagccaggatggtctcgatctcctgacctcgtgatccatccgcctcagcctctcaaagtgctgggattacaggcgtgagccaccacgcccagcttgctccttggttcgtgataaacagttgccttccagaagggcggtagctggcctgcagttccaattttcaatcaggccagctgccctttgccccggcccctcctctgagcccgcagagcttggaggcagatgagacatggcccagcctccccaacccttccccacctcagctggctcagctgaccccaggctctgctccactcccctctgcagactctgatgagaaagtcctgcccgtttcggagctgctggacatcgcctggcaggtggctgagggcatgtgttacctggagtcgcagaattacatccaccgggacctggccgccaggaacatcctcgtcggggaaaacaccctctgcaaagttggggacttcgggttagccaggcttatcaaggtagggccctcagagggcgtggctggggtcgtggccggggcgtggccggagggctgggggcttcctgtgtgtggagctggggactcggctgggagcaggatgcggcccctgccctcgggagcccaggctgggcagggaggtgggaagccaccgtgagtccggtggggcccccattctgaatggcacgcacagcagggcccaccacgcagccgctgccttg

SEQ ID NO: 14610 - DNA, 20610 bp, Human
  misc_feature (1)...(20610): n = A,T,C or G
ccaaagtgctgggattacaggtgtgagccaccaagcccggccttggtctacttttaaaaactgcaacatcactttcttcctttcctctaattactcataaatgacatagggcaaagaggcctttgagacagccaataaagatgaattataaaggaatactatggtggctagagatctgaagttgaataattttgagacttctgcagatcagacttgttctatgatacctatgttggatacaatataaaaacatgaattaatttttatttttttccttcttaagtcagctttccttcccttagttactcctctcctctttgtttccactgtggggaaaaaagaagtctataaattccttcttcagacttaaacccttctcagggatagctcctttggctcactacgttatttgagaaaatgcctgctcacagctaaaaatgaagtccgagattccaagatgggtgcttctgatagagaccagtggcctctgtagaagcagcctagacacagctttggttctaatcttgggttatctagaggaatccaaaaaaccttacctgtccgcagaacaagatacagatttctattaagccggccagaatctgacttttgagtaactaattctgtcgacagtttaaacgggtatttttcatgaccagtgattatatgctgacttaagcagccttcctcgttctgcattcagtttggtatgagctacagccctctcccagttccttaatgacttcaggatgttgaatcaaaattatgtttccaaacatcccaaccactttaccataaaaaccttggaaagtgtgttgaacacaactgatttatccaaagagcgtccaagtgttttctatctgaagtgtttccctcccactgttccttcctctctctcatatgcacaaatacacatattctcactctttctcccctgcctagttttgccccacaaaagctgaggcccggaggagtgctgcaaagattgcgctaatgaattctgtgtttaatgaacatccttcccgaagaatcactgatgagttcatcgagaagagtgtctctgaggccctggcatcttttaatgtaagttgtatggagctggaaggaaggagagtgggagatgggagaactggctgcttgggaagtcgtaaattactgtgaaacagagcatgaattcttgttttctttctggtccacctctctgttcttttgatttattctctgtcagtctattgtgtcatgtgctccacctgtcgcagtctctagttctgtatctgtgtttatgtgttttttgttgttttgtctctttcattgtgtctctttggtatctagaaacctttaattgcagatttatggaattgtagagctattccaaaatgaaaattgagcttcaattttgcttttgctaatttgggttaagaccttagtttctgcagttctttttttatgactgttttttattgtcacttgtctcctgcctccattacttcatcttattgataaagaagacttttataacaaaacgtctttttaggaacaaggaggataatttatttactctctttatttacaactgttctttcaaatgatgatgataagaataaccataattagccagacgcggtgtctcacgcctgtaatcccagcactttgggaggccgaggcgggcagatcacgaggttaggagatcgagaccatcctggctaacacggtgaaaccccgtctctacaaaaaataaaaaaaaaatagccgggcatggtggggggcgtctgtagtcccagctgcttgggaggctgaggcaggagaatggcttgaacccgggagacggagtttgtagtgagccgagattgcgccactgtactccagcctgggcgacagagtgagactccatctcaaaaaagaagaataaccataattaatcctaattgagtatttaccttgtggcagggactgttctaggggatttatatgcattttacctcatttgatcatcacaacaatcttatgaggtgtaagtactattattacccctattttacagatgaggagactaaaaacacagaagtggaatgttgcttaacatgatatagctagtaattggtcacgccaagattagaacccaagttgacttaatttaattacatcttagaaattaacaccgccatcttccttcctctccacaaattcattaatagtcagaccaagtatctgttctatttgcatttaattaagatgtaattacaggccaggtgcagtggctcatgcctgtaatcccagcactttgggaggctgaggcaggcggatcatctgaggccaggagtttgaaaccagcctggctaacatggcaaaaccccatctctactaaaaatacaaaagttagctgggcgcagtggtgggcgcctgtaatcccagctactcgggaggccgaggcaggagaattgcttgaacctgggaggcagaggttgcaatgagctgagattgtgccattgtactccagcctgggtaacagagcaagaatccgcctcaaaaaaaaaaaaaaaaagatgtaattacatatactaaattacttcagttatctgctttgtggattagttgttgaatactttattgaaagttggtttccctctgttatttaggacccagctgtttttctcccattattctttgccccagtcaacagcatctgcagggaatgaaaacatttttatattaatccaaaccaaataaaaaaagaaaaagccagctaaaattttttggaaagtacatttgctacttttaggtcacctaatggtattataaaatgaaacagggcgaggcgcgatggctcacgcttgtaatctcagcacattgtggggtggatgccagcagatcacttgaggtcaggagttcgagaccagcctggccaacatggcaaaaccccatttctactaaaaatagaaaaattggccaggcacggtggctcatgcctgtaatcccagcactttcggaggccgaggtgggcagatcacgaggtcaagagatcaagaccatctggctgacatggtgaaactccgtctctactaaaaaaaaaaaaaaaattagccaggtgtggtggtgcgcgcctgtagtcccagctacttgggaggctgaggcaggagaatcacttgaacctggaaggcagaggttgcagtgagccgagatcacgccattgcactccagcctggtgacagagcgagactgtgtctcacaaaaaaaaaaaaaaaaagaaagaaaaggaaaaaaaaaaagaaaaaatacaaaaattagctgggcattgtggcacatgcctgtaatgccagctactcaggaggctgaagaatgagactcgcttgaacctgggagatggaggtgcagtgagctgagatcattccattgcacgccatcctgggcaacaaagtgacaccctgtctcaaaaaaaaaaaaaaatagaaaaggaaaggaaaaaaaaagaaactgtggattatggaaagtaggatgtgcagtatttatctgatcatgggctctaaattcattgttggcgcggtggctcacgcctgtaatcccagcactttaggaggcggagttgggcggattgcctaaggtcaggagttcaagaccagcctggccaacatggtgaaaccctgcctctactaaaaatataaaaattacctgggtgtggtggcgggcgcctgtaattccagctatttgggaggctgaggcaggagactcacttgaaccaggaggcggaggttgcagtgagccgagattgtgctattgcattccagcttgggtgacaagagcaaannnnnnnnnnnnnnnnnnnncggggctgaggcgggcagatcacttgagctcaggagttggagaccagcctgggcagcatggcgaaactccatctctacaaaaaacacaaacagttatctgggtatgggggcatgcatctgtagtcccagctacttgggggtctgagacaggagtatcacttgagtgaggaggtcaaggctgcagtgagccaagattgcactactgcactccagactcagtgacaaagtgagaccctgtctcaaaaaaaaaaaaaaaaaagaaaaagaaaaaagaaagcaattatggttcctggctgggcgctgaggttcatgcctgtaatcccagcactttggaaggctgaggtgagcagatcacctgaggtcaggagttcgagaccagactggccaatgtgttaaaaccccatctctactaaaaaatacaaaaattagccaggcatggtagtgcacacctgtagtcccagctacgtgggaggctgaggtaggaaaatcgcttgaacccaggaggtggaggttgcggtgaactgagatcgcaccactgcactccagcctgggcgacagagtaagacttcatctcaaaaaaaaaaaaaaaaaattatggttccatagtcttcctttgggatctgtgtgggattggttctaggatctctcgaggacacctaaacccaaggatgctcaagtccttcatataaaatagcacagtacagcctgggcaacataaagagacttcatctctacaaaaaaataataaaataattagccgggtatggaggcacttgactgtgatcccagctacttgggaggctgaggcaagaggatcacttgatcctggggagattgaggctgcagtgaccatccactgtactctagccagggtgacagacagaatgagacacagtctcaaaaaaaaaaaaaaaagtacagtatttgcatataacctatgcacatcctcctgaataaatgctttaaatcatctctagagtacttataatacctaatacatgtaaatgctgggccaggcacagtggcttacgcctgtaatcccagcactttgggaggccaagacaggcagatcacctgaggtcaggggttcaggaccagcctggccaacatggtgaaaccccgtctccactaaaaataaaaaaattagccgggcgtgatggcgcatgcctatagtcctagctactctgcaggctgaggcaggagaatcacttgaacccaggaggcggaggttgcagtgagccgagatcgcaccactgcactccatcctgggcgacagagcaacagaatgagactccgtctcaaaaaaaaaaaaaaggaaatttttatttttaatttaaaattttatttaattctcaaaacaatcatttaaggtagctctatgattattcccatcttacagaagaggaaactgaagaacagagaggttaagtgactttaccaaggccacgctatttgtaggagctccagtccatgctcttaacttctatgctgtattggtttttttacatgctaggcttgaatgcaggacagtgtgtcttaattctaaccctgcagggttacataaccaatagaagacacaataggccaatgtccaggagaccacactgctacccagaatttccacacttataccacatttcagaaagtcagtacaaaaatgtaaaatatttcattaataatgtttatactgactacagttgaaaaataatattttgaacatattgggttaaataagatatattattaaaattaattttacttgtttttttttttttctgagacagagtctcactctgttgtccaggctggagtgcagtagcccgatctctgcaatctccgcctcccaggttgaagtgattctcctgcctcagcctcctgagtagctgggatttacaggcacccactaccatgcccggctaatttttgtatttttagtagagacacggtttcaccatgttggccaggctggtctcaaactcctgacctcaagtgatctgcccaccttggcctcccacagtgctgggattacaggcatgagccactgcacctggacttacctctttatttttactttaatgtggcagagaggaaattttgaattaaatatgtggcttgcattatatttctactggacagtgctgcttgagatgataatcctggttgaaaatctatttgtcttttctgttcctctactaccagggcaacagggaggaagctgacaacccaaatacagggattggtgccttccgattcatgctggaatccaacaagggcaaatcaatgttggagttccaggtactttcccatgtacttccctggttctaataacatgggtcagcctgctactgtaatatataatggctcctactaattcctaactcattgatactggaaaagaaagaaggttgttacactatttttcaaaaataaataccttcctggctgggcatggtggctcaggcctgtaatcccagcactttgggaggctgaggcgggtggatcacttgaggccaggagtttgagacatggcaaagccccgtttctactaaaaatacaaaaattagctatgatggcacatgcctgtaatcccagctacttgggaggctgaagcacgagaattgcttgaacccaggaagcagaggttgcagtgagctgagattgcgccactacactccagcctgggtgacagagcaagactctgtctcaaataagtaagtaagtaagtaaataaataaataaataaataaataaataaataaataaatatttttcttccccaaaggcctatcagagttagtgatgagagatgcttctacaaatccattttgtaaaaggtttcccatgtaattctgatgcaacctcccaatataaaaatcactgtcctggtacttcctatcctcttcccccaggagctaatgacagtttttcaactgctacactggaatggcagccttaaggccatgagggaacgacaatgctctcggcaggtaagagattttatgagtgggggcgaatgaggggagcacaatctgtcagtggactcttttgaggtggttactatgttagaaataaggtctattgtgacctatggttgtgaatattgaaagccttacctaagtaccctcttcattcctataatctttcctgtgtaaatattagctgtgattcttttgtctatcttgcttcccgtagcaggaagtgcctttaagaatctccttgaagaacttaggtgctgacctcagttaggtctctaaagctgagttcttagtcccagttgggtcagtgtggtatgatatgaacctttaccttctcaatgatgttcacattcccctcccctactaggaggtgttggctcattattcgcaccgggccctggatgatgatattcgccaccaaatggccttggactgggtgagccgggagcagagtgtgccgggggcactgtctagagagctggcctctactgagcgggagctggatgaagcccgactggcaggcaaggagctgcgcttccacaaggagaagaaagatattcttgtgctggctgctgggcagttgggcaatatgcattcttccaactgctaggcatccacccacataactccccaggctttccacagcctttttttatgtctcctttctaagatttaggatgattttttgtacatactttctcatttttatactttaaaaaatatatatgtgtataaattctacacctagattcctatttgctaagagatcccttttcttactaccagtttttggatgtagttttatttgaaacatcttcagtccactttacaacaaagagcagcttgtctttgcagctttgttagctcttaaacttccagattaactgtgtagccatttcagtagcactaaaagattaactctagtgttcatgtgtccttcttttcaaatatcaggtaacttgaataaggattatgtgccccacccttactctcattcctgcttcctcttggactcaaacagggtatgagtatgaagattttgcctttagttcctgaactgaacctgcttgctatccctttcctccccaccactaccttattccttctctgcctccaaattgccactttgttttgaggcttccttccctaccttattattctgaaggaagtagagatcttgcttctgaaacccctcctaagaaactgcccagggacaagataaattacaaacaattcatgggagtttactacctaagttgcttctagggcatatgtataccatactagtagtctagatttctggatatactctacagtagatgggggttatggttgaaactgattctctttcagtattccctctaaacatctcccctactcccccagcttagttaaaccctgcgtttggaccttcctgcctgcagctattagtagaaagtaaaacatatttccatatttcccttcacctaacattttattttttggaagcgttatcagtcctatttggttagtgagaaccatgttccccttattcccgctaagttgctgctgtttactaccttagattctcatttgttttctctttctttcctctccttccacattaattattagaacataagttgatcaggaaaattaaatgagactttagtattttggcacttcctaattgacaccttgggagactgcaggaagggaaagagaatcaatgatcagttatttgtgtgtgtgtgtggtttttttttttttttggaagacagagtctcacacttttgcccaggctggagtgcagtggcgtgatctcggctcactgcaacctctgcctccagggttcaagcgattctcttgcctcagcttcccgagtagctgggattacaggcacacgccacaacgcctggctaatttttatatttttagtagagacagggtttcaccatgttggccaggctgttcttgaactcctgacataaggtaatccacccgcctcagcctcccaaagtgctgggattacaggcgtgaggcactgagcctggcctatttgtggtttttttttggttttgtttttgtttttgtttttgagacggagtcttgctctgtcgcccaggctagagtgcagtggcgcgatctcggctcactgcaacctccgcctcccagattcacaccattctcctgcctcagcctcccgagtagctgggattacaggtgcccaccaccacgcccagctaattttttgtatttttagtagagacggggtttcaccatgttagccaggacggtctccatctcctgacctcgtgatccacctgcctcggcctcccaaactatttgtgtgtttttctttttttttttttttgagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccacctgcctcggcctcccaaagtgctgggattacaggcatgagccaccgcgcccggcactatttgtgtttttaacaccattctcccccacttctctcctgggtgacataagagagaaataacctgtagtacagcagctaaagtattctcctttcagagaatttttttggaggtctcatatatatttcccccttgtctctgtgatctcttatttatactatattattgtcccatgtactttctaaactgagcttggaacatttagtattcctgcaattggacttcccacttaacaattatacagactttgcttttagaaatagattaggttccaaacagaaagttcaagtgtaacaacaacaataaaaatagattatgaaacaggctataattggctcttttggatttgataggggcaagatgaaaggcaactttcttgcttttgaaatcatgttgggtaagaggtaaggaatccagctacaattttattagtgcttgaaacgggcttccttgaattctccaggccctatcattttttttttcttactaatcagaagagagctggggtagaagccccatgtttgtattccatgaaacacgtcgggttggagtaaaggcaaaaacagctagacacaccaggtgtgtctgtttgacatttataagctggcactcatcaacactcctgtttctcctttctctgggacgtgtggattaaggggtgtgagttgtgggaagaattgccctcgtacctcctggatttattatttttctcaaataccaaccagtaagatcccaaataacttgagaaaaattgtttcctgatctgtccacttctggtgtcaaagattttactcatcttcttagtacattctatgtattttatatgtataattttatacaattaaaaatagatttttgtctagtgagccagactgactctttcttgagacctatatattacaaaagtgaaggggtgggttgcccctccacacctgtgggcgtttctcgttaggtggaacaagagacacagagacaaagtatagagaaagaaaactgggcccagctgaccagcgttcagtatacggaggatccacgccagcctctgagttcccttagtatttattgatcattattgggcgtttcccggagagggggatgtggcaggatcataggataatagtggagagaaggtcagcaggtaaacacgtgaacaaaggtctctgcatcataaacaaggtaaagaattaagtgctgtgctttggatatgtatacacataaacatctcaatgccttaaagagcagtattgctgcccgcatgtcccacctccagccctaaggtggctttcccctatctcagtagatggaatatacaatcaggttttacaccgagacattccattgcccagggacgagcaggagacagatgccttcctcttgtctcaaccgcaaggaggtgttacttcctcttttactaatcctcctcagcacagaccctttacgggtgtcgggctgggggacggtcaggtctttcccttcccacgaggccatatctcaggctatcacatggggagaaaccttggacaatacctggctttcctaggcagagatccctgcggccttcctcagtggtttgtgtctctgggtacttgagattaggaagtggtttgagattagggagtggtgatgactcttaacaagcatgctaccttcaagcatttgtttaacaaagcacaccctgcacagcccttaatccatttaaccctgagttgacacagcacgtgtttcagggagcacagggttgggggtagtgttacagattaacagtatctcaatgcagaagaatttttcttagtacagaacaaaatggagcctcctatgtctacttctttctacacagacacagtaacaatctggtctccctttcttttccccacaagaagctctaaaacatccctgttcttttacatatatactaaagaagaatttttaggccaggtgcggtggctcatgcctgtaatcccagcactttgggaggccgaggcgggtggatcacgaggtcaggagttcgagaccagcctggccaccatggtgaaacccccatctctactaaaaaaaattaaaaattagctgggcatggtggtgggcgcctgtaatcccagctacttgggaggctgaggcaggagaattacctgaacccaggaggtggaggttgcagtgagccgagactgagtgattgcactccagcctggacatcagggtgagactctatctcaaaaaaaaaaaaaattttattagcatttttggggtggtagaaatgattgcataaggcagcctgcctccctttctgcagatatttaacctggagtttgtccttggtcttttctcctcaagctctacctactcccactggcaatctcacccattatggtgacttgaactccactatacacatgactctcaaatctatttcttcctccccaacctgttttaagcttttacatttactttccacatacttgacacggccatctgaatatgacaaaagcactttgaaacatatcgaaaataaaaaacatttctccatactcattcctctttgactctctagattattcgaattattattattcttattattattatttttgagacgaagtcttgctcttgtcccccaggctggagtgaaatggcgcgatctcggctcactgcaacctctgcctcctgggttcaagcgattctcctgcctcagccttctgagtagctgggattataggcgcccgccaccacgcccagctaatttttgtatttttagtaaagatggagtttcaccatgttggccaggctggtctcgaactcctgacctcaggtgatccacctgcctgggcctcccaaagtgctgggattacaggcgtaagccaccatgccccgccgatctattattagaattattatctacactgttacctaagccacacacctcagatccaccctcaactcctctaccataatgtaaatatgttgtttttgagacagagttttgctcttgttgcccaggctggagtacaatggtgcagtatcagctcactgcatccactgcctcttgggttcaggagattctcctgcctcagcctcccaagtagctgggattacaggcacccactaccacacgtggcaaatttttttatttttaatagagatggggttttaccatgttggccaggctggtctcgaactcccgacctcaggtgatccgcccgcctcaacctcccaaagtgctgggattacaggtgtgagccactgcgcctggcctacctcctaatatgttttgtccatatttactgcctgagcttaggtttggtcctttctcatctccagactggatcactacaatagcttcctagctggtcttcacctccattcttaacatcctccatactactgtcatatttctttataaaatacttatgactgtgacactcccttgcttaagccatcactgaactatctttacctttagcagcatttcccaaagtttttttttattttttttgagacagggtctcactctaatgagcaggccagaatgcagtggcgtgattttggctcactgcagcctccacctcccaggctcaaggaatcctcccacctcaacctccagagtagctaggtctataggcacacaccaccacacccaagtaattctttttaaattttttgtagaggtggatcttgctgtgttgcccaggctggtattgaactcctgaactcaaactatccacctgcctcggcctcccaaagtgctgggtttacaagcatgagctaccatgcctggcctaccatttcccagttttatatgtgttcctgagatgattttagatgatagatgggcaaacagtttttaatagttgtgcttttatctgaattcgtagtagaaaaatactgattttcctttcagtgtaaatttatgtttaaagtcagtctatttaaggaaaaataataagcaacaactagtatggaggctattttcaaatattaaaaaccatgaatactcaaatatttgaagtaggtaaatttcttgcctataggataaattccaaaatccttagcacagcagaccctaaactgtatttccagctttattttccagtcacatagcatcgggcagacagaatttcctgccattctaatattcattcattcgataagtatctaccaaatgtctaccatgagccagacattgggctaaacttcagggattttagttgtaaataactatctctgctataaggattacattctaacgggaaaaacagacaataaacaagttagaaagtaaacaaggtaattaaagattctgactggcctaagcaacatggcaagactccgtctctacaaaagattttttaaaaattagccgtgtgcagtggcgtgtgcctgtagtcccagatattccggaggctgaggcaagagaatcacttgggcctgggaggttggctgctgtgagccataattgcaccactgcactcagcctggttgacagagtgagaccttgtcttaaaaaaaaaaaaagaatgaaagaagattctgatttaagttctgtgaaggaaatacacagttaaagacaggagggtagagaagacccctttgggtgacagtactattgagatcttaaaaatgaggtcgaactcggccgggcgcggtggctcacgcctgtaatcccagcactttgggaggccgaggtgggtggatcacaaggtacggagttcaagactagcctggccaatatgctgaaaccccgtctctactaaaaaaattttaaaaagctgggcgtggtggcacgtgcctgtagtcccagctactccggaggctgaggcagaggaatcgcttgaacccagtaagtggaggttacagtgggccgagatcgtgccactgcactccagcctgggtgacagagcgatactccatctcaaaaaaaaaaaaaaaaaaaaaaaaatgaggtcgaacccaatatgtgaaaagctagaggaagagcaccaggaacagaaagctgcggggagcagtggctcatgcctgtaatccaaacactttgggaggccgagaagggcggatgaccggaagtcaggagttagaaaccagcctggccaacatggcgaaaccccgtctccactaaaaatacaaaaattagctaggtgtggtgccgcacgcctgtagtcccagctaatcgggaggctggcgcaggagaagccttgaacccaggagacagaggttgcagtgagccaagatcgcatcactgcactccagcctgagtgacagagtgagactccgtctcaaaaacaaaacaaaccaagttgcaaaagccctgggatgagaaagagcacaccacagttgggcgaaagagcaaggagagcttcatgggtgaaggagaagaacggtggttgaacaggttgaaaacacaggcagagcaggctttgtgagtttgaatttttattctaagtgcagcaaaatgccaaggaaagagccgggtgcatggttacacccctgtcgtcccagatgcttgggaggcgagtttcaggccagcctgggtagtataaccaaacccctctaacaaaaagggtttttaggccgggcgcagtggctcacgcctgtaatcccagcactttgggaggtggaggctggtggatcacttgaggtcaggagttcaagaccagcctggccaacatggtgaaatcccgtctctactaaaaatacaaaaattagccgggtgtgtgtgtgtgtgtgggggggggcgcctgtagtcccaggtactcaggaggcttggagggcgcctgtagtcccaggtactcaggaggcttgaggcaggagaattgcttgaacccgggaggcagaggatgcagtgagccgagactgcaccactgcactcttagcctgggtgatagagcgagactacgtttctaaaacaacaacaacaaggtttttagtaggtatgtaaccaactgatttttaaaatgatcacagtacctactgtggagaatgaattagtgtctcctaatcgctttttaaattttatttttcgttttactcttattcactttttttttttttttttgagacagagtctcgctcttgtcccccagactggagtgcagtggcaagatctcggctcgctgcaacctccgtctcccgggttcaactgattctcctgcctcagcctcctaggtagctgggattacaggtgcactccaccacgcccagctaatcagcttccgtttctcgggttcaagcgattctcctgcctcagcctccctagtagctgggattacaggcagggagttttatatttaaaaaaaaaattgatatctgtctcaccaaccgtattgcaaccaagtctgttagtttcctgaagagaaatttggtgctgcaggttccagaagcagctctttatgccctcactgctgatcaaactattttttaaaaacgctcctatcatacaccacgctgcctaaagacagggtacaggcctgggatttttgaaagaaaagggtttcttcaattaccatttcccagtttgggatgaagagacgtaaagaagccctctaataaggaaattacgccgggcctcactgttaatagtacagtatttatcagcagctgccgcggttaagaggaagccacggccccctgtagtctgtacctcctaagatggatgatttagcttgcgatctgttcaagatggccacagaaacacttccggtatctttccgcactaggcccgccccaatttgcgtgtttttaccgtgcagagggagggatttagagttagcctttgattggtcagcttgactggcgacctttcccctctgcgacagtttcccgaggtacctagtgtctgagcggcacagacgagatctcgatcgaaggcgagatggcggacgtgctagatcttcacgaggctgggggcgaagatttcgccatggatgaggatggggacggtgaggacagtggagacggctggtgggaagcggggaaggtgcgagagaaggctataataggaaaatttactcttttttcctcggtcgtaaggatgggaatcgaggaaccgggtcttgggtggattagagattccgcccccttcaggagaagggagggcgtgaccgggaaggcactaagactggaggcggtgtgggtcggcttgctggtagtgtattgggaaagagacgattgttacaaatgactgtcatagttacttattcttttatcttctggggttccagagagcattcacaaactgaaagaaaaagcgaagaaacggaagggtcgcggctttggctccggtgagtgtggggaaaatggggtagagtggcctagtagggcaggagctacgggttttggagtccccacccacctcataggaacaatgggagaaaggaggagttttcggtgatctcgtgtatgtcccttatagaagaggggtcccgagcgcggatgcgtgaggattatgacagcgtggagcaggatggcgatgaacccggaccacaacgctgtgagtaataatggaacctgtgaggtatccgtgtctgtggtagtagttagaaaccaataaaatagttaaacgcagtaggaatgggttcagagatagcttaaacaatctgagtccgcactcactctattcctgtgagcctgcttaaagtgtctctcatgtactcatacaacttccccccgtcccccaacagctgttgaaggctggattctctttgtaactggagtccatgaggaagccaccgaagaagacatacacgacaaattcgcagaatatggggaaattaaaaacattcatctcaacctcgacaggcgaacaggatatctgaaggtatcctaagtgacactttattgcctcctttctttcataagccttaggtagcattcgtagttctgtgtttgctgtggttggccaagagcaaagttgaaataaaatgacattggaaatctatgttttgtcagacacgccaaagagacagaaacggagatgatgtatatatacagtagagatatatgatgtacattcattgtttaaagtgtgtagatttttctgagtttagatttgaggaaaaagatactcagtgatacttggggaaataggagggttttcatatctgtcttttcactttccccaggggtatactctagttgaatatgaaacatacaaggaagcccaggctgctatggagggactcaatggccaggatttgatgggacagcccatcagcgttgactggtgttttgttcggggtccaccaaaaggcaagaggaggtaaaatgaagagggcaaatactgtctgggtgaagggaatacgaacgaaacagaatgaggacttagtattatgtccctctaatggactcctctccctgcttctttttccctagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttggggattacaggcacatgccaccatgcccagctaaatttttaatatttttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgggccagctcagtggaccgtgtggaacaggaacagctggaagtggagttgaggactattagaactggttcccctcaccacccaacctacccacctatgtcatactgtctcctcccaattcatccttaattccaagtgaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgcgctttataagggatgatatttctaccacctcactcatatttttagctgaaatgattttcctggtatgtctgttattttgtggaaaaagaaatattgtgtaaaatgggtgctgccaaaattccaggccattttgcagggactctgaagtgacctttagtagtaatagtcttatgtgcagtaactataatggtaaagaatgttaaataat

SEQ ID NO: 14611 - DNA, 34261 bp, Human
tatttgaatcacttttgattggacagtaggctaatttctttgatatgtagaaatcttacaaattgactaaaagcaggataaataatcattacaaaaaatgggccaaagaatatgaacaggcaagttacagaggaagaagtataaatgaatattaaacatgaaaagatgctcaggcatctaaagaaattcattttaaaccacctataaaatcctattttctgttagattgaaatagtaatacccagtattaatgaagctgatggagaaaatgagctctccttgttattattgctttggaaacatctatcagaatttaaaatacaaatgccatattccctagaaattgaaagtacacaaaagatatgcaaactgaagaatattcattgctgcattttttatagcagaaaaaaattagaagccacctaaatgttcattaatggagagcttatagacctccgtccagttgtatgagatgaatctgtatatggtaacacagaaagagattcatgatatgttacactttttaaaaagcaagctgttcctttattatgtctgattatgttcgtgtgtgagtagaaaatatcagggaggacatgcacaattctctgtaaaatgacgagttttgaggattgcagttgggaggtgatgggaggacatggatgagggagtatcatgtttccaaattgcttaccttatgttttataataagcatgtatttaaatttatattaaaagaaaaatataatatctactaaatttgtaaattaagaattatattaataaatgaactatagcaaatttttctggtttgttttctatttaggtatggaaatttgaatattaatttatagatggcaaagggagtgcttttttacattacagactgtgcataagtaaatgatttcactcttaagatttgaaacatctttcaaactcataacctgaatgaatgaaaaatgtattatatatattgagcatattaaaatatttttatggtctgggcgcggtggctcacgcctgtaatcccagcactttgggaggccgaggtggctggatcacaaggtcaggagatcgagacgatcctggccaacatggtgaaaccccgtctctactaaaaatacaaaaattagccaggcgtggtggcacatgcctgtaatcccagctacttgggaggctgaggcaggagaatcacttgaaccagggagtcggaggttgcggtgagccgagatcgtgccattgcactccggtctggtgacagagtgagactccatctcaaaaaaaaaagaaaaaaaaagtatttttattactgagagagaaagaaaagatttattagtcatcaaatccacatcatattaaaaatttatgttattagcatattttatttaaaattatgttgggttcaaaccaggcacagtggctcacacctgtaatcccagcactttgggaggccaagatgggaggataacttgaggccaggagcttaagactagctgggccacatagcatgaccctgtctctataaaaattttaaaaattagcctggtgtagtggcatgcacctgtaatcacaaggctgaagtgggaggatcccttggcccaggtgttcgagactaaggcaagctgtgatcactccactgcactctggcctgggtgacagagcgagaccctgtcttttaagttaaaaaaaagttggtccagaaatatgaatttaattaaactggattaaacaaaaatctttatattataccaaaggcattttgaatctatgaaaagagacagtaaaaaaattttctaaaaagcaatagatagcaaggtttttcaatatttatatctcaaaatatttgttttaagtctttttatggaggttatcttgtaataaatatatctgtagtttttcttttaattttataatattttaagtatacatttatgaaaattatagattaaaatacgaattatatgtgtataagtttattttacattatggaatccaattttatcacaggtttcgtcttgatatatatcgatgtttggccagtccagctctaataatgttaacagaggaggatccaattctgagagcatttgaacttagtgctgatttaaaagaactaagtcttgtggaggtggaattcaggtgggaatgaatgcaaattatataatgtattttgttttaaatcttcaacctcagtttcttcattacccaaattataatttgtatatatttacatttgatccaagaacactacaccttgttgccacttacttggcaacagacccctgctctccctcaaaggaacagaccctggtgctacttaagtcattccttccccatctgccctctgccaccctataaacacctttaatctcttccccacttttcaacctaaccaaaggcattgtagagcagtatgaaatacagtaggattatagcctaaagcaggagcaaatttattcatagttgctctctctctcacacatatctcctcattctctgactctataatcatccttgagtaatgatccttcagatctttcaaaagcatatggaatgctttctgtatgtcaaggacattccacacacagacatagtcccttttcactatttgctcagattttctggtaagagaaataatatatgtaatacatgtaaacataaaaataaaatacaactaattaagagggatgaacacccagtctgagttctcttctgaaatgaagattaaatgtaattttggcacttggcataccaaagaagcactcctattattttcctttaggggggtaagttgaaaaaaaaaaagactttgtaatagcagcctatgaaactactaatttaaatattgtttttaaaaaaatccttagaaaactacttttattaatagtagagttgagagaaagcgttgagattttcctttatggaaaagtatccctgttgccctctaaagaaggaggaattgattacgattttttactagcccctgttgcaaggtttctactggggatctataactattcctaccttttctttcctatacggctgctattagagccccatgtcttgtgtgacactctttcagtgacttgacaaaattgggaaagttcaaatttctacttcctggaagggcagtaagaaacttggagttttctttagctttaacagcagtacttaatgtgttcttcatagacctgagttccagaaactgaaaaaagacctgtttatattttcaagtttggaactactgtcttgtaacttggataatttaaattttgtttaaacttgatatgacatgaagtatgtactttactttgatgaacacacaaaacatggttcaaatgtaacttgttgctacttttaactttattagcacatgaggctgttaaattattctgtttaaatatgaaaaacttcctattgtaacctcataatttgagtctgagttatataaaataaaacttactcaactcctttcaaacaggatttgaagaaactgctatgattatataatcataaaataataaagttagatttggaagcgatcatagaaacccatttacttcaatccagtgttttatagacaggggaggagatttataaaggctagatttttactaatagcagcatctaattaggaatagagttaaaactaaaagtaggagcaaagttataactagaatatatgactccttgcttctggttttctatatttccatctaaactatacagccacttatttgtcttcagtaatctattagaaatgaattagattaataagatgtataaatttcacctttgaatctcgtagtccatcaaatgtttatccaaagatggaatatttttgtaataatatatacttctgataaacattccagtctgcagttagattcctaaatcaagaagcagggagtgccgcatttgttaaataaatccaattacttattttcaggagttttgactacatagaatgtataaagaatgatgagagaaattaaggcaaagaagtttttattcttaagttatgatttttatatagccagttcctggaaagccccattatatagaaagactaaccagtgggaaatcttcctgtttccccttcctttcagtttgggaaaaaactgaataaaaacattattttctgaagcccaacctcaagactatgactcataattatttatttctgacttcattcttaagttatgattaagcttagacataaagttaatgtaattgatatttttttttttttttttttggagacccaggctggagggcagtggcaccattttggctcactgcaacctcccctcctgggttcaagcaattctccctgcctcagcctcctgagtagctgggattacaggcacctgccaccatgcctgactaatttttgtattttttagtagagacagggttttgccatgttggccaggctggtcttgaactcctgacctcaggtgatcacccgccttggcctcccaaagtgctggcattacaggcctgagccaccgcacccagccgtaattgatattttttaaaagaattatatactaaaacttcttcatttctcacaaattagtttaggcctgcctttaataagcagttcaaacccaagattcaaggaatagggattctgaaagagaggtttttgttaggcgcattttaatatctttctttctaatttgaatttcactcaaatgagcactttaaatatgaatcaaaatgctattttaatattagaagtaacataaacatattgtagatgactattgaaaaagctctagttaaaaattttatgataatgattggatagcattaagatattatgtctattgttaaggtgagtaatataaaaggaagttttagccaagcttacagagaataagggaaaatgagttaagcgaagaactggttgacaaatattattagaatttttaggaataacatcagtatatataaatgaacactgtgctcatctaagattattagtatgaacacagggaacataattgtgttatggttttccccaaagctgtggaaaattcgtgcatcactagtttcctttgattatccacagaaaatgacttcagattttgtgtaacactgtcagaattaaaatgttgctgagtaaaaacgtttttagtgaatatagcttaattagaagatggaaacgacgtttctgataatagaatgctgcattttataggaatgattatgaggaactagcccggcaatgtaaaatgtttgctaaggatttacttgcacaagcccggaattctcgtgaattggaagttattctaaaccatacgtctagtgacgagcctcttgacaaacggggattattagaagaaagaatgaatttaagtcgtctaaaacttgctatcaaatataaccagaaagaggtatgaggctttctgtaatatatttaaattattttctctacagtagtctagtggctcagggcaaaggctttggagtaactcatctgggttaagatcctagttctgcttcctaaaaattgtgtgtcttgggatagttattgaatctgtttgagcttttgttttaataattaattaagaatatatactaaaagggtttagcacagtaagtattagcattaagcaagtatgcaataaatggtagtttttattatttttagtaatattgattataattataacatggatgttgatttaatgtttttgctaaatagttgctacacaggtaagatcctttgtagtaggtacaaactttatagtgaagtttccatcttgtgttttgtctgtcacaggttggttttcattgatctggttataaatagccccttctatagtaatagtgatttctatttaaaaataaagtatcagatactatatttcctgattcctcttatttataattcattgtgaaactcaaaagtggagaggtacatgatatgataactaagttgaatctgacttttctggcatcatccctttctattaagagatatgcccatttctactccccatgcatacatatacatatgatccaggaacttgaatcaggaaaatatgcattttaaatttcatttttgagataattaactaaacagtgatattcatatgtagataataataatatctaattgatagtatgggatgttgataaatggtatttattaggtattacttctaagactattttcattgttaacatagatgtttaaataaaacttgcttatcaaatttatattattacaaaaatagggcctgaaatatataatgatagaaggccagatacaggacctttggtgctaagggcagaattttttcttaccttggttaaaaatttgagcctcacaaagttattaggaaattgatggaggaattgatggaggatgtttattggttaatatatttgcttctgtgttccacaacctaaaagggacatgaagtcctagaaaatgatagaataaggggattacatggtataaaatcaattaaagtgatttaaaaaaagaacctcaaagaaaggcgtaaagaactaaaattatcctgtttaggaaaaaaaatcttaagaggtaattttctaatgatagctatatccctgaaggactcacagagtggagtccaaatggaaccaaatgtaccattctaaagaagatgaaagaaaagacaagaagtagtagtaatatttgttagttgaaaggaagatattttgcgattttaaagatgaatgaaaatgtaaagtagtttttaaaactagatttctaaatacgatcagtggggaagatattttctcaaatagttggtaagctttgtttaggttatcaatcttgaatagcaaactactctgaaacttagtggcataaaacacttcatagttattttataataatttcataatcattttattatgctcttggattcttaggtcaggaattaggaaagggcatggcaatcatgatttttctctgcttctccgtgtctgggaactcatctggagataaatgacagggctataatcagctgggggcttctccactcacatgtctggtgtctgagcagcagctgaggcctcaggaacagggtgctcagatgggtgagtccacagaaggtggggctcctgagaactcacaacaggaaccaaggagaggcatggccatcacaatgggcagactttgaggatgtggtctgagaagcctctgcgggctggctggggtacatacatgtgacctctgtgtgcagcctgggcttcctcacagcatggtggcttcagagtggctttttacatggtagttcatggctccaagagcaggtgttccagtgagcaaggtggaagatgcgtagccttttaggacctaccttcagaagtcacatagcatcacctctgttagaatctactagttaaatcaatcacaagcctgttgaattgaagagtaggaaattttgacttcctccttccccacctcttgatgatgggaagaaagcgtgtccatctttcactgcagacttagaacatttctagttaaactttttattccaaatacatagttaacattactgcaaattaaattgtcattgtatagagggatagcaaggacagtaatcagtcctgagattgctttgatatttggaggaaaggtgacactactaaatttgagatttactaaacctggtcattggtgagaggaaaagctgtttctctcccaggcatttcaccttgagggacaaattaagatttcccaagaacattggaatctgagcagaagagtaaagaatgaagtattgccaaaaataagtatttgcatataacatacacacatcttcccatatactttaaagtatctttcaattacttataacacctaatacagtgcctacacatcatttcattcatgtggattcaacatagtacttgctgtgaagaatattcaagttttgcttatttggaactttgtgaattttttcttccaaatattgttgatccatggttggtttaatccacagatgtaggacacagagatacagagggccaactctacagtatactagaaattttcttgaaagcacaataaacaacaaaactctgtccaattctttttttcactacagtgttaattctacaaattatattctgttttgggataaatcattttaaaacagaaggttgaccaaatattattgtggattacctgaataatgtcattttataataatttcaaacctgatcacatgagtatatatagaattatcaggacccttaagttatacttcacaacatgagcattatattggaaaaatattgcctatgaaatttgtcaactaagaagatttgtaaactttggtaaattagtttctgtacctgaactaaaatttttctcatatttgggaatatttttcctttcttctcacatgaaattcagttttaatcaggcttaagagtgtctttaataccttttaagaaatccgcagtgctttcttggagcaagaataggtctaatatttagctttttattgtttttgctatcttgacttcttggcttctggtaactaaaatcaatagtttctctagactgaagatgtccaacattagttagtggtatctttttctatggattgtgcatgataactttgaaatttcataaatattattatgagtttttatatattaaacatgaaaaaatggctaagtaagctaataataatagttaatacttatagagtgcatgctatgaaccaggtgctattctgagggctttacctttaatcttcacaactttattagtagatactattattattcccattttacagatggggaagttgaggcttagagaaatttaaaaacttgttaaaggtcatttaccaagtagcagagcccagatttgaatctaggtaatctggctccatagtctatcctcttaacctctacatgcttttattgttagaaaaagggaaaaaacaaaactatgttgaatgtatagaattgatttttaaactcttattcagtaaactttgaatatcaaccaatcagtatttaaaggtttccttttactttttttctttttaatgtgtgtgtatgtccttttcagtttgtctcccagtctaactgccagcagttcctgaacactgtttggtttggacagatgtcgggttaccgacgcaagcccacctgtaagaagataatgactgttttgacagtaggcatcttttggccagttttgtcactttgttatttgatagctcccaaatctcagtttggcagaatcattcacacaccttttatgaaatttatcattcatggagcatcatatttcacatttctgctgttgcttaatctatactctcttgtctacaatgaggataagaaaaacacaatggggccagcccttgaaagaatagactatcttcttattctgtggattattggtaagtatcaagttagtttgaaaggttttgtctttatttagcccactgattctttcttgattgatggcattgtgaatattgggttcaatttgcaattttacactgttcacaccacaagaatttgaacacttccatgatcactgaagacttaactaacatgtctgtaaagataaatgttcctgaacttgatgataaggaagcatctctcttatttaatatttcttaaatacatggaattttaaaattatttattctcagactctatggttattcatgattgtaaaacagaaaatcagctttaacacatgaatgcttttttggtgtaagaatatgaagttttcttaggtattttgaaacaatctattttatactgttgtgcatttttaaagttaactattctatttcatttataacattagttttccttttaagaacctatgagctttttggtttttgttttgttttgttttgttttgtttgagacagagtctcgctctgtcgcccaggctggagtgcaatggcacagtcttggcttactgcaacctccgcctcccgggttcaaacgattctcctgccttagcctcccagtagctgggattacaggtgcgtgccaccacacctggctaatttttgtatttttagtagagatggggtttcacttcattggccaggctggtctcgaactcctgacttcgtaatcctcctgcctcagcctcccaaagtgctgggattataggcctgagccaccgtgcccggcctagaacctatgaacttttgcagatatatcttgctttatctctattttggaaacattgtttaaatttagatttaaaggagtccctggtgactcattccataaatcatttctttgtagagatagccagatctctttagaaatgatagttttttaaaaagtataagacattttattcctgaaaattatttttataagtattacactgtataataaatgtcttaaatcatcttctacaatttttactcgtcttgccttctgtgtgtcggggtgcgtgtggagagttgaggtagaatcacattatctgtttatggtattttaaagatattttctttatttccctctgtatcttctaccttgtttttaacctcagcacttcccatctgtccgtctactatttgctatagagtaaaagggtaataaaatttagtcttatctatggcacaaagtactgagtgtatttatcttttgattactacattcctgattgtttcaattatttagtactttcataagttatttcacaatgttcaattttagctctttagctatacaaatactttttatattttagaatgtttatttgaaaatcagttaatttcaggtaactagattgtaattagagttttgcttttaacagtatttaatctatgatgcattaatgtttaaaattaggtagataaaataatacacatctaaactctaggttaaagagaattaaataattccttcttgttaatatttttatttcctgtagttttgctcttatctaaaatttaatcttttaatttaggaaataatttaaactttaccatatatggttttatattggactgtgggactctttcaatgtgaaatatgtttgtattgctagttgagtagttaaaaaattcctggaagaattttacacattagtttgaagagaatcgctaaggagcactttccctatattcatttaaactatttctgattgttatatattccttagtcttaaacagatgaaattttataacatttatctataacctattgtttagtagtaagaaagaatattttctgtgttttgttagatttagtttaccccagtctgtataagaatcaaattaaagtttatatgtcttagcaatgagtaaaaactcaccgaactaaaatagtcataccactctttgaatagcataaatattactgctgtccccgattttcataataatggtaaaactatagctcttcccttttatatgatgctgttttcaatgatattacacgtatatatacatgggtacccccttacacacataatatgattaattttctaaccatattctacctcactagaagaatgcatgtgcattaagccagtaaaattcctggaagtatcttcctttcctcagcacagcttctgctttgaaacagtttgatctgaataagccttgccaaggaagtcttcttaagccttttatgtaattaggtcactctgggctttttttcagtatatagatccaaaccggctctaagtgagcatggaggaatattttgcttgcttgcctaaataaagtcattgcttggttcaacttactatttcaagcaatgaacacagtgactttttaactcatcatgaccaatttttgtatatttgttttgtttgctttcattagcttttcagaaaaaagtaaggttaggttataaaaagcaaggtaggtaaaaagagaataatttgttgaggaatgcacagaatattaatggtatccttttacttaatttttgctattaaacataatagaatggctattatagaaatgtattttttaaatgtcatgtacctactttgtctaagcacaggcaaaagcagatatggcccatacactcgtgaagcttatgatctaataaaagccaaataaaaccatcaaaaacttgacttgagaatcatatggaaaaatgaaaactcaaaaatggattaagtgctattggttaaagatcatagtgttaggagagtaagcatattataggggcatttgccctagtcagggaggttgggaaagacacgttgaggaagtaataagtgagctaagatctaaaagataaatagatgtcaactgagagaactgggagaggaagctactctaggctgagataaaagcacattcagaagctcagtggcaagagagagaatggtacaaagaagggtctgagtaaaggctaacatttctggagcagggagaaccaggagagcttgattcaagatgaagctacagaaacatattgtaccagaccatgcatggccttgtaggtcaggttaagtaattttgactttatattaagaacaaggggaaaccattgcctacctgaagtaggcaagtgacatgatcagttttgcctttcgaaaagatcattctatctacagggtggaggatgagctgggaggatagtgctgtggcaggagtagatggagggagaccaatatcgatgctgttgcactaatccagatgagagctgatggcaccttggacttagggtgattgtgatagagaaagagagaagggaacagacttcagagatatttataatgtaaggccagtaggacatcgaaatacatagtatatgagaggtgaaggaaagggagattattaagcaatattggtcttttggaagagtactaggcttggggatttgtgtgttgaggggtagatcctgagtacagtttcggatatgttgagtttgaaaagcctttgagatattttttaaatatcccttttagggatgtcaagcagacagttggtctggagcttgagttagaaaggtatgcatatctgaaaataggtggtatatgaaactataggcataggtgagacacaaggagaaagataaattgagaaaaagagaggacctaagatcaagcccttgagaaatcccaagatggctgggattgctgccttctaatgttattattaacattaattctaaaaaaaatagaccctaaaatatagaatgttggttatgtagtgtttgtattgcttggattagtttcaacttactatgttctttgtgatccagcttggaaacatgcaatacatcaagtgtattagcttcatttttgtgggggtattgcagaggagctgggaaactaaccaattggtcttcactgtactttcatgtctgtcttttttgatcaacagttttctccaattcatgttgtaagtttttgttaagagtttcttttaggtaaaatattgcatttcacagaaataaacacatttctgtaaacatctttcttagtttgatgttttaaatattaacaggagtgtatctaaagtttaaatataagggtttttgtttgaagatgtttcataaataaggattcgcacacatcaggatctagaattagacaataattttgagtcttcaagaaagtatggtcatggaggatttgtttaatatgtttctgctccacagctctgagtggtaggtgaaggttgaacatgagaaatatcagaaagctttcatccctactccttccccaaataaaacagtatttgagttaataaaatgttacctgctagactatttcattttacatttttagacagttttcatctattcattttgagtaaaaacatactaaggtggaattgttaaaaatgtttttcctgtcaaatctgcaaatgttttaaacactttttttctgtataaaatatgggtactgcataattaagatgttttgaacagagatcttcaagaatgtttcttgtgtttcccaggggaattattttgcctactgataagccagagaatgattctgattggcctaatttgatctccacccatgtgtgatgctacagcactctattcttttgttactctgtagtctccccgaaaatgacttaatgaaggaatgtaccataaaatgatcctgaattatgttactgaagtctggtacccataaaaatatatagttatagaggagcttctggccaaaaaacggaaagtttttctgtttgtttgctttggtttttatttttgtatatttattcatttggcaatattttttagcaccttgtttgtatcaggtacttttcaggacatttggaaacatcggtaaataaaacaaagattcttacccttgaagagcttacccaaagtgggggaaagataatcaattaataatagacctaataagtaaattatattcagtgttagaaaagagataagtaatacaaaagaaaggtaaaagcagagttaggagaattgggagtgggggacaattttaaagttgcaaagagtttgcaattttaaatagggtagtcaggaagggtgatgagcaaagacatgaaaaagtgaggtagttagtcaaatggatctctgggtgaggagggtccagccagaaggaagagccagtataaaggccctaaaggcaggagtcatgtgttcaaagaacagcaaggaagcaaggaggccagcgcgactagaatagtacaaggaaagattagtaggagatgaggtcagagaggataggtaatttggagacttgcaggccattgtaaagactggttttgattctgagtaaaatgggatttaagggagggtgcagtgcccactatgcacaatgagcagcagtggttttgcatttttttgacatttgcactcacagaacaaaacaggctgaaacctggtactaggtttacttaaatttgtagaagtaaaagatttgaacttaaatatataaacttgagagcctttgccatgtagatgatatttaaagccattagattgggtgagatcattaaagtagtaagtataggtagagaaaagaaaaggatcagggactgagccccttgtgcgggggtgtgtacgtgtgtgcgtgcacatccatgtgtgtatccgtgtgtgtctccgtgtatgtttgtatccctgtgtatgcatccatgtgcatgcatccgtgtgtgtgtgtttgtgcccatgtgtgtttggcattaatttatttggtttcttacgtttgttccacatccaaagatgaaacttaaggttattttcttcaagtcgtatgaaagttaaggttattttctttcagattttaagaacttttcactaaaatgtttttggttttgtttttttttcttttgaataaggcccaaggattatttatttaatattttgagtcttaaagtattatttagtttatttattgaattaagaaagtgttatctgatttttttcttccttttctcagggatgatttggtcagacattaaaagactctggtatgaagggttggaagactttttagaagaatctcgtaatcaactcagttttgtcatgaattctctttatttggcaacctttgccctcaaagtggttgctcacaacaaggtgactatttactatgtcaattgaaggcacaaattaagtttattttggaaatagctaagatatttagctatgtaactcagagttacattgagccagatcagtgtctggtgtgttttcattttaagcctatctgtgtgcacatagtttcctatttttccagtagtttacaggtgttacttacctttacatgatggttatttattatataacagggaccatagttcacatttggtatactttatctctttttatctacactgggattctttgagactgaagtccttatttccttattcccattttgcaagtaagaaaaatgaagcctaaaaatattaaacaacttgtccgaaaccacacaataggaaaccaagactggatttaaatcctgccctgtctaggcattttctttctactagatgccaattccttatatctgacctaggttcttttagcttattaacctgtatatacttaaaatgagaacaaagtaacttaaaatgattagtgttagatatctttatatctgccagaaaaagagtttccattccattccatttcataatgaatgaaattggttatgtaatattttacacatttcaaatcatgattaacagctttaaaagtgatgtaaatgttattatttttctaataactatatatttttatttagaatttgacaaaaatctacccttatagataacttacaattttactttcatcagaatttaagctcccccaagcccagaaagggtaacaaattgtgtgttaactatctttgtttaaaccctgagtttagaattcttctggggtgtcacattcaaggaactaaaatatataatattctctgttttttattagttcttagattattgaaaaggcaagctcattattttacataattttactttattaaaaaattctgtttaattgatcagtagtatggaatatgttaggtacgttcagtgtctagagtgtgaaattactaagaaaatgaaaattggtcatatatagataaatggtttgataaagggattgagagacattgctttttcagattgatctctttcgttctataagtggagtacccatataattttttatccaaatcaggacattttgagagtgaaagggggcactattaataattatgccaggacaactggtacagcatcttaaactatcccaggcaatggggacaattgaccactgtgtctaggtacaataatgccctcttttttattttgtatttaaaaggggggaaaaaaactctgaattccaagtcaaagcagtaggttaatgtaatatgatagggaattaattgacagcacatgtacttaacgtttgtgttgtggaatttaagaaaactagccaacatttcattaataaaaagcttaatgatcatttaaaaaattatttaattttctaaaatttaagagtttctggaaaaacctcttcatatagagtgataatgcctcacatacataataatattttatttcattaaaatattatttctatttttaaaaaaccctataaaacataagtggagatcccctataagaagacaaaattaaaatggctttctttcaacagtcagaatatttgcttttattttcctaaattgagagagcttatttacctttggctttttcttcctaaccttagtttcatgattttgctgatcggaaggattgggatgcattccatcctacactggtggcagaagggctttttgcatttgcaaatgttctaagttatcttcgtctcttttttatgtatacaaccagctctatcttgggtccattacaggtaaataattaaaatttcttaaagaacattttttagatgtcattattgttacatctttctccttgtccagtggaatactgttctctcatgatattaaagctaaactttgctcttgagaataagtagcaattagaaggacacagcatgtttatctactttgcttctggctcagtgataatcctttgctttcaggtattccaagttaattatgctgtggtccattagcctcctccccccacttcatagacatagatatgtttaaaatataattacacttcagacagtagagtaacataaaaatctgctttttatcaaaatgaatctcacatttaaagttttaaatattttaggttataagtataaaggaggacctgtgcaaacaaaaataatcatatttgatgatttttgaataagctggatttaaaagaatacttacactttcgtttaataaatattaaatgtaataagttggaaagtagcatacttagagctaaaaaatttacagaggctatgtagttcagctttatattttataatactttatagttaaagaaattgagcttttgagatgggatttgatttgtccaaagtagtatgattattatgtatgagagttcaagactaaattctcagtctctttgcaccaaagaaaagactcataattggttgcatttaccccacagaatttagtaactggttttcagaaggtggggtcaactctgctagctctatgtaatactatagcttattatttctgaaaatctgaacaatattcatttttccttaagtcaaaatttactaacaatttagattgtctcatatttttaaaggtgatattttaaataaaaggcataattaccttctccaaacagggatatgaaaataaaatatataggaaaaacctgatttgattaggcttgtgctgtcatccagcaacagtgtttcctgaagtgtggctctcttaaccaagtcctgtgagatgctctgaattaagtaagtttgggacacactgtatactgtatacctcttgggaattgacagtgcatgttatcacattaaagcctctgagaaaaaaatttgtttaaccttgttcaaatcatcattacctaaagtcatttaacctcatacctgtttttcatgaaatatgtgcaagtctctgtatttttccaaaacacagtaagccatagaaacactggcttaaactatctgtccttttgatttatttttgccactaatatcatctacgaatgctttaatcaagagtctacagtgtttttacatgcacattgatttttttttaactgaaaatggacgacagaactaggtttctatactggaaatttctttatggactcctataaagggttaaaaaggagaaagtataatattttttaggaatgaagagtcaatttctgacttctgtttccagccaacatggagtaataaggattggatttacccttctatctaaagcaatcaaaaaggaaaaaagaacaaaatatatgaaacaacagcttataagaaactagatatcaggcagtaaacaacagtgatctctaagaaacaagaaacaaagatcactccagcttactgctttgtgagaatttttaggctattgtgcagagtgggtcagtgcagtcagagcctggcagaattctggatttagcagcacagaaagaaaattctggagatctgcagttgtctcccttgagtattcagcagagtactgattagcatatgcatgtgaggacactacctcgggcagggaaagaaccatctcatccgacgggattagaagaatactcagaagggtcttgcctcaatagttatctcaagcctacacactgctctagtttcaacgaacaaatattaaaagcaagatgtgaaaggattaaattttttccaagtaacttaaatgtgttcattaaaacctatccaaaagcaacacagatgttagagttatcagataaggactcttcagcagttattattattgtgttccatatgtacaaaaagtttaaagtttagtagagacatggaagatgtaaaaaaaagaaaaaaacaccaaattaaactttcagagatgaaattttcactgtgacctgaaacatgcactggatgtgattaatgacaggttagaccttgtagaaaaacacattagtaaactcgaataggtaacaatagaaactattcaaaataaaatggagaagaaagaatttttaaaaatgaaaagagtatctgtgaactttgggacaacttcaggtggcctaatattaatactaatgtaattggaatccctgaaaaaaggagagaccaaaaaaattttttaagaaataatagcagacattttccaaatttgaagaaaactataaacccacatccaagaagttcaataaacctgcaaacacaagaaacatgaggaaaatcacaccaagggacatcatattcagtgtatcactgctgaaaatcagtgataaaaaaaatcttcaaagcaaacagagaatagcaggtcatcatatacagaaaaagaaaggtaaggatgacagtagatttcttgtcagaaacagtgcaagcaaggaggcagtggagtgacatttgtaaagcactgaaagaaaaaaaaaacaactgtcaacctggagttctctacctagcaaaatatcattcaaaaatgaaggtaaaatgtagacttccagacacacaaaagctaaaagaatacatcactggacaccagcactacaaggaacgttaatagaagtccttcaggtggaaggactacagtaacataggggaatatggatctaaacagaagaatgaacaaaatacaaatatacccaaagggaatgtaactacaaagctaaatagacaggcatttttttgttgtttcttttgcttttatgaaggatgccagctaatccacttcagcagatacaagaaacatgattgggcataaatcagtaatgctttatattttaaagaaaaaacgacatgaagatagaatctgtacataattgtggtaataatagtaataacagcagacatttattgggcccttactatgtgccagatactgttctaaagtctttattcacatttattacctcatttaatcctcacaaccattctaagaggcagactcttttatttccattttacagaggaagaatctgaggcatagagacattaagtaacttgcgcaaggtcacatggttggtaagtagcagaactgggattccgcctaggtggtttggctccagagccagtgatcttaatcactatactaaatcgccccccaggttgtataatactacagaataatatgattccctcattaactcttactgtataacttctgtgggcaggctttaataatttacagttttttaaaaagttattcaagtcacatgtttcaaatgaattaaacagccttttacactgacagttggataatttagacagaaagaacaacccatggccacacagcactctacccttttttccttatttccttatttccttttttccttacctggtcccagggtagggccctctctcaggtcccacatgcttcctgtctttattcttgtagcttagtacaaaagatgtgattattatcagttcctcctgctccaagactctgctgcgtgggtccctgattcttacccatctgtagcacatactattggaaaaatggctcccatagacttactcaaaaaaggttgccacaaacaacacagtatctgtggagcaccacaaagttaagtgtaataaaacgaggtatgcttgtattttgagggcagttactggtactaagtagtgagagggttctaactgaatctggcatttaaagtgtagagtggagtggattgaggaggatagaagagaaagaggcaaggccttcagagaaagcaacctttcaaggagttttactcctgctgtccaagggactgtcaaatccaaaatctatccaaagagaaacctaaggtttattatgattgtcatatttgataggacccagacataaagtcgagtggacctgtttgcccttcctctttttttcttccccttcgcactgtaaaacatcaccaccttttcttcagtgctatgataagaagtccttacaaaagcaacaagtctcccacttcagcttctgtttttgacctcatgctttcaggcctcacatctagagaaactaagtggaaaaaaggttgttttttttttttttggaggggaataaattatttggcaattttctcaaatattaatcccttttcttccctaaagttcctccccttcctacttcatttaggataggaggtgcgtttctttcccagaggttgaaatgtttcctagggaaatctgccgtatcatgtgattctaaaacagtttaaaggcaccacatacactgattaggtttctctgaggaggagccccaaagcagaaatctctggcaaggattagttctggaggggtggtgatgagcaaatcagaccaaaggaggggagctcttgagggtctatgcatgcattcctaggcctcaacatttatggtacttgaaagagcttgtatctaactgtcttgcttttctgtttggtctaattattagaattactaatattacaaatgaatgaacatccccttgggttctgacaggttggttcaaaatcttgctccatcacttactgtttagtgtctgtgagcctcagtttctttatccgttattgtgaggattaaatgggtcagtgtatgtaagatgcataccacagtacttgacacatggtgggctttacgtaaatgtttaggtccattttttccattccttttatagttagttaactatggcagacctgaaaaataatataagaaaacttggaaagcttagtacttgaaacatgagtgtgtattttatttctagtgaattatttggttttactggataattatcagatttaatttagtagcctgtataatataagtggcatgttggtgctgcttctaacgagtaaagagctgtttcaggtgttttgcattttggtgtatattagagttagagaaaccgaggagtcatgtagtccagaggttcaaactggtggggctgcagaatcacctggggagcatgttcaacctagattctcaagtcctaccctcagagatactgattaaattgattgggttaaagctggaaaatgacatgcagatgagtctgatgcagcatttgactatatcccttgtatagatcaggaaactaaggcccagctcacacagtgttagaaccaggacttggtgttaattaactaagttaattaagaaactaagaaagtggtaaagaattattcaacattttaattaatgcactgggctctggagcttactaagacatggtgcctgctcttaaagactgctagaggagacaaacataacataaatactagtatgaagtcaaaaatactgttttagcaataacaaacaaagttactttggaagcatgactgaggaagtagccggagagagtcaggaaggctccttagaggaggtggcatttgatctgagccttgaaaggatgagaagcctgcctggcaaaggacaaagggaaagtaacacgcagaagcgtggagtcctaaagcatggtgtgcttagagaagacagcatatcctttatagttggaccgtggattggagttggggagatgaggctaaaaaagacaggctgggctggacactgaaggtctctgtgccaggaattttaatatcacatgtgcaaaggaggtttttgagcctgggtgacttgtttagatagaacttttggacagataattatggctttattctggagggagatttggaaagacagtgactagaagttgtgattattattgctttcttttgttagcaacttgtgtaatttaatgagcctaatgatagcaacctttcccttatcagagatttaggttgtttttgttgttctgcatagtactctgtgtatgaggctttttgcctctgttatttctaagggtaagtctccaaaaatagtattaacagatcaaaagatatgatccacctaacacctcagtatttttatttttttacaataaagtgtgttaattttctgcaatacaagcagtataaaaatagtttcactacattaatagcatttggtgctgttttaaagttatgctaatttagtagtttgctttaatttccctttttctgattagcaagaaggattttttcctctgtgtgtactagtattaactctatgtaaattttagtattaatattttaattacctttctcttttcatttcacaagttttcatatttctcaagttaaaccgccaagtactttttaaaaagtaaatgtttgagaaagcattattacttttacaaatacataaaccttataatctctcagtctaaaataaatttactgtttttaatatttgcctttcacatgaatatttcattagtgtcttcaagccagtgttttcctcagtggtatccactgttctacttttacttcttcttgtattaagaaccaataccatgctattaaacaagtcaggccgggcatggtggaacacacttctaattgcagcactttgggaggctaaggcgggaggatagcttgaggccaggagttcaagaccagcctgggcaacatagcaagaccttgtctacaaaaaaataaataaaaattagccaggcatggtgggatgtgcctagtttctcatgaggcttgagtggggaggactgctgaagcctaggaggttaaggctacagtgagtcatgattgtaccaccatactccagcctgggaaacagagtgaaactctgtctcttaaaaatttctttttaaatttaaaatttaagcaagtcatgaagtttgtggtgttctcattcagaattgcttaccttgatattgaactcgattacatttatttaaaacttaggttaaattaaagctactttgactacatgttttaaaattaaaatgatatcatacatggtcactattggaaaacctgatttacctgtaagcttacagtgtccagactttcctcaaggtgatcttttctgtagttatcaaaagcagttactgtattcttactgtcataagggattgagttctgtactgagatggtatagctttattctaagcaatcacaatctgaatggatgcttttctttctcaaggtgatccaataaagctgtcattgattaagaggaaaatgcatttcttctccttcttacatattttgagttttctgattctaagtgtcccctgcttcttgtgtcagaattttgtaagggggccaagtgagggcagcataggccttgaaaagtaccacatggtctagtcaaaagcacaagtcaggcatattggacctctccactatggcagagtctgggttactagcttgtggcgtgcctaagaatttaaactcacctattctgcttaagtagctggtccactttagtgggctggaagcatctggccagttgcctgtggctaccattttgtatcactgaaagcgggatgtgctatgctggccgacttgggccaattaggaattttatttaaagcttgatgtaattaattatataaatttgacctgttaaatttgaggaagggttgtttcaaaacactcaattttgtacattaaaaataatgaggccaggcacggtggctcacacctgtaatcccaacactttgggaagctgaggtgggcagatcacttgaggccaggaatctgagaccattttggacaacatagtgaaacccgatctctactaaaaatacaaaaaattagctgggcatggtggtgggcatctgtaatcccagctacttgggaggctaaggcaggagaatcacttgaacttgggaggcggaggtttgtagtaagctgagatcacaccactgcattccagcctgggagatagagactgtcttaaaaagaaagaaaaaaaaaaaaaaagtctccctactatacccttagatatatgcccttccatagataaacatggttaacaatttcttatgtaaacttccagaaacttcctatgcatattaaagcatatctatattaaaatatgtatcttgtctatcctttaacaaaatagaaatgggggccgttctacatatacatactgttttataccctgctttttggatttactgtcttacagccatctttgtatgctagcacatgtagatgttcttcattctttttaaaaacaatgttgagtaatgttacagctcttttagaatttgtctagcaggctttccggttcttgcgggaaagtcccccccaaaaaatattaaaaaataaaaaataaaaacaatattgaggattttctaaaatttttttgctacctctaacaatgttgcaatgtaaatccttgtatatacatgcatctttgtgtacttcctatctattggttaaatttctagggatagaattgctgggtcaaaaaagtactatcacattattccccaaatttgcatgccaatttaaaaaccaagaatttatgaaaagtacctaatctctaaattttgaagaatgaaattaggattaaagcttccatatgcactatacatgtctaaactacaaaagatactcactactaatactggacaccctcatttggcttgcacacataatattttcttaaaatggacccaaagggaaagaaaatctatcacttcagcaaaagaaattagggcagtcccataggaggaaatgctgattttaggaattggtttagaattggtttcaaaaatcaggtgaaatactttgcctcataatgattttatgtttgtaaaatttaagaagccatgtaaatataagcatttatttctctttaagtttgagcagggtattttccttttatcccttgcaaattaggccttttcttaaatctccatatctctgcctctatctccataacaacaatgtcctctgaaaccctgatccaggttctaggaacgtgccatctaacactgatagtgttggtatgattagaatgactttttgttaggcagctggattttcgatgtttttaaaatgatctgtctcaaccagatgcaatagaaggggtggcctgtggattatgtgtttgtcttcttccttttgttgctgggtcatttatatttaatattttgtttttctgataatcttaatgaacacctgtgtaatatattccacagatttcaatgggacagatgttacaagattttggaaaatttcttgggatgtttcttcttgttttgttttctttcacaattggactgacacaactgtatgataaaggatatacttcaaaggagcagaaggactgtgtaggcatcttctgtgaacagcaaagcaatgataccttccattcgtgagtatcttttaaatgttttagtaaatatatttgtcttttttttttttaccatcttctatatgaattagtatctatagaaatggaacttcacattttaagaaattccttagtaatgttcataaactttaataaatacttatttttcatgaatcactatagtcatctttacatacagcatcttaaatagtgggtccaagttattaccttgtcttccctactgcagtctatcttaacagaggaattcttggcattttgtgtgttcttagcattttgagcaattctttgtcattcctatgtattgcaagatgttcagcatctctgtccttcaggtattaaatgtcagtagcaactctcagtcattgttacagccaaaaacgctcacagcttcaacactttttaagaggtcattagaattgagaatcattagaacttcatgaacatttttttctctaatgtatcataaggatttgaataacctgttttgaggtaaacaaaattcctcccgtcatttttaaataaaacaatggagaagagttgtggaaggacacatttgtcatgttcttattatgtgtcaactattctttagttattttgtgtgtcatcttatgtaaagaataagattaatgagtatgtgtcagtgtaccacttactatataccagccaatgttctaagtgctgagcaaatgaagtattagtaaacaaaactaccctgatgaagcttacattctagggaggtgatacaggcaataaaaagaggagtaaaatattcagtatgttacacagtggtcagggctacaaagacaaataaagcatgagcaaaagagtgtctgtgtgtcagagttcagttttaactaaggagctagggagtgccccagaagagatgacattcatgtgaggatctaaagctggtaaaggagcaagccacgaagaacatttctgggggaagagcatttacagagagagagaacggcaaaggcaagtgtccagaggtaggagcatgactggtatgttcaagaaaaagccaggcagccagtgtggatggaatgtgttgaatcagagggggagttgtaggaaatgaagtcagaaaggtaatggggatcatgtaggacttttttgcccttgtaaggattttgagttattgagattgagagttatttgaaggttttgagcagaggtgtgacaaaatccaattagatattagcaaatcatataggctgccttgttgagaacagacagaaatgaagtcagaagggtaatggggatcatgtaggacttttttgcccttgtaaggattttgagttgttgagattgagagtcatttgaaggttttgagcagaggtgtgacaaaatctaattagatgttaacaaatcatataggctgccttgttgagaacagaaagaaaggcagcaaggggttaaacagttacaaataatttatcttccttagggtctctttgtttaaatttaaagtaaggcatatcagtactgtggaagtcaacatcatttttaaataaggaacttttcatggattatcaatgttttatttaaataattttgatataaacaaatgattcatttttgctaatttctttaattgccttttaaacagaaatgcaattgtctttacaggttcattggcacctgctttgctttgttctggtatattttctccttagcgcatgtggcaatctttgtcacaagatttagctatggagaagaactgcagtcctttgtgggagctgtcattgttggtacatacaatgtcgtggttgtgattgtgcttaccaaactgctggtggcaatgcttcataaaagctttcagttgatagcagtaagttcattcttttaaaaactttatattctcctcagaccatactaagtgcatacaatagataagatagccaaagattataagattataagaattgaaaaatagtatttttaaattaaatatagatttttaaaatgtaagtaatgtataataattgcaaatgttgaacaaaatttttctgcaaggtgtggaaacatcccccatatttgtgtgtgtattaatattctagtttgctttttaatttgccttttatatagaatcatgaagacaaagaatggaagtttgctcgagcaaaattatggcttagctactttgatgacaaatgtacgttacctccacctttcaacatcattccctcaccaaagactatctgctatatgattagtagcctcagtaagtggatttgctctcatacatcaaaaggcaaggtcaaacggcaaaacagtttaaaggtaagaaattagaagcttgaatggcaacataaaagttttaacaattcctaatctcagatatttcttaaagcgtaagtatgcaggttccctaagggctgtgactgtctgactttttttcactgctatataccctaatgtacggcatcgcatccaacataaagtaaggattcaataaatactattgagagtgagagggctgggtgcggtggctcacgcttgtaatcccagcactttgggaggctgaggcaagcacatcatcacttgaggtcaggagtttgagaccagcctggtgaaaccccatctctactaaaaacacaaaaactagctgagtgtggtggcacatgcctgtagtcccagctactcaggaggctgaggcaggagaattgcttgaacccaggaggtggaggttgcagtgagccaggatcatgctactgcactccagcttgggtgacagagcgagactccacctcagaacaaacaaacaaacaaatatatatatacacacacacacacacacacacacacacacacacacacacatataattattaagaatgggagatagtactgagatttttttttttacttttcagattcctccaatatataaaatttcatctcatagttttaaaacatgggaaatattcaaaatacccattctgtcactgtagctaaagaatgactactagaatcagctcatatttttctggttcttcttgaaagttattcaatacatcaataattcaatatatgttactataaaccaggggttgggacattttttctgtaaaggtccagatagtaaatactttacacttttcaggctgagacaaaatcagagatattgtaagcagtgatacagtaagagagaaaacaaattttcacaaaacttttattgataaaagtcaaaatataacaataacagtaataactttttaaatataggtctactagtgaaaagaatggagttccttttgggaggggataaaatttcacttaactagagtttaaaattagtgttattatcaattgatgataaatgttcatctgtaaaatctattcttagctcacaggctgtaaagtcaggatatggaccatatttggcttgtgggttgtagtttgccaatccctgctataaactaaggattcctaagactaatttttttcaatcaagataagcataaaattaaattcattaaacaaatatgcaggctatatttgttttaaacaagtgttgaatattataccatgtagtagaaaaactatagtctaataaagcatttaaagatgtgtttgtgtctgtgaatatatttttgaactctacctcatttaaatatcgtttctgcatatccttagtatcatattgttgttttgaaggaatggaggaatttgaaacagaagagagatgaaaactatcaaaaagtgatgtgctgcctagtgcatcgttacttgacttccatgagacagaagatgcaaagtacagatcaggcaactgtggaaaatctaaacgaactgcgccaagatctgtcaaaattccgaaatgaaataagggatttacttggctttcggacttctaaatatgctatgttttatccaagaaattaaccattttctaaatcatggagcgaataattttcaataacagatccaaaagactatattgcataacttgcaatgaaattaatgagatatatattgaaataaagaattatgtaaaagccattctttaaaatatttatagcataaatatatgttatgtaaagtgtgtatatagaattagttttttaaaccttctgttagtggctttttgcagaagcaaaacagattaagtagatagattttgttagcatgctgcttggttttcttacttagtgctttaaaatgtttttttttatgtttaagaggggcagttataaatggacacattgcccagaatgttttgtaaaatgaagaccagcaaatgtaggctgatctccttcacaggatacacttgaaatatagaagttatgttttaaatatctctgttttaggagttcacatatagttcagcatttattgtttaggagtataattttattttatctaaaataatagtctattttttcttttgtattttgttataatcttaagcaacaaagaaaaaaccctaatatttgaatctatttatgtctttcaatttaaattcacttcagtttttgttattgtaatatatttacttttacatggttataatcactttatatttttaatgtttttttcacttaatattttatatatacatttccatgtattgatgtagttagtccacatttaaatttttatagaattatatagtttttgaaaaatacagtcagtagatgttttattttttagctattcagttatgtttataagtttgcatagctacttctcgacatttggtttgttttaatttttttgtatcataatagtcctatttttttttcaagttggagtgaatgtttttagttttaagatagataggagacacttttttatcacatgtagtcacaacctgttttgtttttgtaaaacataggaagtctctttaatgcaatgatttgttttatatttggactaaggttcttgagcttatctcccaaggtactttccataatttaacacagcttctataaaagtgacttcatgcttacttgtggatcattcttgctgcttaagatgaaaagcattggttttttaaaattagagaataaaatatgtatttaaatttttggtgtgttcacataaagggatgtagctaaaatgttttcataggctattatatattctcgcagcatttccagttaagaggatattaggtatataattctcttcttaaccgaatgtcagatggtcttacgccacagggtgcaggtaacccttggtctgtaagcaccaccgatccagggatcattgtctaaataggttactattgtttgtttcatcttgcttttgcatttttattttttaatttccaaattttaagtgttccctctttggggcaaattcttataaaaatgtttattgtaaagttatatattttgtctacgatgggattatgcacttcccaattgggattttacatctggatttttagtcattctaaaaaacacctaattattaaaacatttatagagtgcctactgtatgcatgagttgagttgcttctgaggtacattttgaatgacagcatattgtaagaaaaaaaaaggtgaataaaatttgacattagattataaatggagtctgttcattgtattaccaattttaaaaagttgagatatacagtagtccccctttatctatctgcagtttcactttccatggtttcagttacccacagtcaatcataatctaaaaatattgaatgaaaaattccagaaataattcttgaagttttttttattttttagagacagagtgtctctttgcccaggctcactctgcagtggcatgatcatagctcactgcagcctcgaactcctggtctcaagcaatcctcctgcctcagcctcccaaattgctgggattacaagtgttagcctccatgctcagacagttcttaagttctaagttgttcactgttgttctgagtcacatgatgaaatctcatgccatcctgcctgggcgtgaatcatccctttgttcagcatattcacagtatacactatccaccactgaatcacttagcatcattctctgttatcagatcgacggtcatggcatcccactgcttgtgtaacccttgctttatgtgtaaccctaattttactttataatggccccaaagtgcaagagttgtgatgcaggcaattcaaatacgccaaagagaagctgtagcctgcttcctttaagtgcaaaggtgaaagctcttgacttaaggaacttcaggaaagagaaaaaatgtatctgtggtaacatctacagtaagaacgaatcttttgtctgggaaattgtgaaaaagaaaaaaaaaaatctgtgctaattttgctgttacacctgaaactgcaaaagttacagccacagtgtgggaagtgcttagttaagatgtaaaaggcgttaaatttgtgggtggacagtatgaacagaaacgtgttccagttgacggcaattgggctcagtagtatctgtggtttcaggcatccactggggtgttggaacatatcccctgtggataaggggggactactctaccatgttttgaaataatctgtcaaagacctgtatgtgaacatttatagaagctatattcatggtgtcaaactgagaacaaccaaatgtccattaactagtgactggatcagcaaattgtaaatccatacaatgacaatttattcagcagtaaaaaggaattgtatcagtcacaatcagagaaacagagctactaggatatttgcaggcacacatgtatgtgtgtgtatagtgatttgtttacagggatctgacattacacaactgttggagttggtaagcagtctctgtaagtccctgtttttttatctaatgctggagcagagctggaagtccacagggtaggcaggtgggaagaaaagatggatgtcaagtgggagagatcagggacaagctagaacccatgaagacagaccgagtcccatgtgactcctcacatctccaaccttatgatgtggtaccctgttggagaagtgttgccctttgccacttgcttttgcaagtatgttactaaacactcacttggcccaggaatcaagagaagctgaagcaggatccaaggaaaggtgggtcaactgtaggcctggctgctgccccacattagcaaagtgaaccagcagataagttacagcacgtgtgagctgcagaagtgcccgcatcaagaacaaaacggctgctgcttcacttctgctctccagtcttgcactaaaatgtctcttgtaactggaagcatacaagaaagggaattttgggaaacataattaggcctagccaagttgatacattataaagccaccacaggaacaaactgctgatatatgcaatagcatggatggattttaaaagtaagtgaaagaagccagtcacaaaaagctacaatactgtatggttccatttagatgacattctagaaaagacaaaactataggaactgaaatcagatcattgagtaccagggtctagtggtctaggagacaactgactgcacagctcatcaaactgtatgcttaaaaagagtgaattttaatgtatagaaattatgccttaat

SEQ ID NO: 14612 - DNA, 5526 bp, Human
tgccgccaggagcctcccggccgccccagggctgcgcagccactggagcccatcacccaactccagacgctcctggctcctctacgtgggccgggagggacagccttgaggactaggggagggggcacgggaccttgcagagctcctggccggaaagggaggattgaccgcccccggcatatcaccccggagcactggaacccgcccccgcttcttgttttggcactggtggtgcttgcggtgaggtccaaggagcccagcctccctgagtggaccgccgggcccctccccgttccgggacacaggagagctcccgccccttgctggctgggcagcccctagatacctggctcccaggggccagcttccctgagcctggggatgagccatgagcctgcagcctggccccagggcggccccccacggcctgccggctggctccctccggctccatggcccacccggccttcctaattgccttcggctcccaccggtgccttagctcagcctggtggcccagcgggttgggtgccacccagtgagcaggtggcggcaccagctggacctgtttgtggccctgtatgctaggacttcctcagagacagctcagggaccccccccacctaccagaacctcacttagggggtggggggaaaaggaattggagatccttcctcctcgggctactccctggaggcggggataggccccagccggacttggcactgtttttggccacctggggctcccactcccaaccccaggatgtcagcccaggtctcactgtcctggcctgctgctctccccttagggcctctgcgggcccctctccagatctgttctctgaggcatcctccttacccccagtgcccagcactagctccccaggcccgggatgtccctcccactcctctgcccacggctgtccctgacagaaggcagcagcctccccctccaacaccatgcactcacaaaacagagaatcacgaccccagctgggtgtgttccagattctttctccagcagtgcagagggtcctgtgcagaggccgaggagcagtacagcgacccatctggccctttcctgctggtgggaccagtggcacgcagccttgtctctcggagcccatttcccagccacagaatggggagtagcagatactgagtggggtgctttcctcggaactgagtaacatcaggaatggggagtgctttccccctcagccatgccccacctggccccaggtctccatgtgaggggagctgcctgggctcaaaacactgagccatcccaaggaaaattctagatacagattagctaatatacactgacagatacacatatagatgtgtatatagatttctcttttttttgagacagggtctcactctgttgcccaggctgcagtgcagtggcatgatcatagttcacttcagtcttgaactccctggctcaagagatcctcccacctcagcctcccaagtagctgaccacaggcacgtaccacgcccggctaatttttgtattttttgtagaaacaggaggtctcactgtgttgcccagggtggtctcaaacccctggcctcatatgatcctcctgccttggcctcacatagcatggagattacaggcgtgagcccctgtacccagccccagactagctaatattatgactgatcaccattccccattccccattcccccaccccaggaccactggcagaggccactcactctgccttcttttctgtggttctgagaaggctgctgagtttcctcctcttgcctgtgcagccccctcctgccaggtttcaggagggagatagcctagagcatgtctgcactgagtgaggagtgggtcaggagagaagcagggaagtccttgtgtgctggcaggtcccttcccctctgctgtctgtgtcctcatctgcaaagtgggggtgcatggtcttggggaggagtgaggcaccacccggccccctaaccagtgtgtctctccagagcaggacaggctgctttggtttgtgacctccaggcaggacggccatcctctccagaatgaagatcttcttgccagtgctgctggctgcccttctgggtgtggagcgaggtgaggtgcccttggggaccccagacctttgtccagctgtgccctgctccactccctctccacccctctcccctgagcagacgctccaggggtccttccaggccgctcccagcagagggctcacccggcctggccacactgtctcactgtgtgtttgagtgtcgcttgacctgctcgacggccagggtggggtgtcactgtctttgctctgccttcagcccagggcctggtatacagtaatttctcagtaaatgtccactggggtcaggcctgggagggacactggaggcttccctgagacaggtgtgtcctccttccgcagccagctcgctgatgtgcttctcctgcttgaaccagaagagcaatctgtactgcctgaagccgaccatctgctccgaccaggacaactactgcgtgactgtgtctgctagtgccggcattggtgagtgccaggcctcagaccgtgccttcctcccctggccatctccctagcccgggccggggctcagcagaggccattgctgtctgtctgcagccgtctgtctctcccctgacagcctcatttcccatgcagggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtcccccagcttcctgctctgagtgtggctgccccttgcggggagaggcagagcaccccaggtttggagggtcctggggtcttctgtggtatggcccaggggggtggtgggggaggaggagtcatccccctgagccacagccagctgcttgcctgacctcagagggagcccctccccagtgctctgccctttcttctgccccaggttcagcaggtcaagtgagttcctcctccacacagcggaaggaggatgttggggggcatggaggaaagaaagcgggtgcaagaaggagcacgctcaggctggggcagcacccagggccgtaggacttgggaatggagggtgtctgtctggacccgctggtgcagagggcacaaaagctgggctggggcaggacagacgggccggagtgtagtgagtggcctgtgggaggggcagggggctcccacgcagaagctctgggcagcagccctgacccatccgtgcctggactgcagcgctgcccgcttccccctggcaaacaggtggcagcctcctgacagaggaagccggcccaggccgccgtgtctgcagttgggtgctgtgcgctgcccagagggctctttgggctggagagagaaaacaagaacagacacccagtggaggtgtgtttgttcatttctccgggacagtgggagggagccggccagggtctcagccacttagggcccgaccctgaattttcccggctggccagaaactgtggtgtgtgtgtgtcaggatcccaggggcaccgtccagcaggaggggccggtggtcaacgtggaggcccgagattcccacccctggcagctgatgtgaatagccgggtcctcccaggtccctgaggtcaaggcaggtcaaagacctgtgtcctcctcctgggtccctgagctagtgattcctgtctgaaacacatgaatcattactgccacccatgaggggcccattgtaaccgagcgagagggcctggaagaggtcagcgggaggaggggcctgatcggtggatcagctatccctgtgcaaggacccggagcccatcagagcagcctgcagagactgagcttgagattccgtcgggagtttggattcgctgagtgggtcgctctagcattgagaaatgcaagcagagaacagagggtggaaaccagatggtccaggagcctgggcactgtagccaggaggacagagatcccggtgtgcagtgcgttcactgcattgttcactcggaatcgcaggtggctttgctggagggacagacagttgatcatagtggagctggtgagaggaagctgcacccaaaagccatggccgggaacctggatctgactgcagggaaacagaagcgtggtgggcgctgggcgatgatggaatttctaacaaatgctttgtttctgctaaagctaacttgcgcttccatctctggcatctcctccacttcccaggtgagctgactggttactgagcctcacaaccacactgagacgggggcgcggtcatcccctcgtttccccaggggagacaggctcagagtggaagccgcttgtcctcctaggatctgggactcggggcccagctctccctctgctctgggtttagggctgaggtcagaggcagccctgacctcctgctggtggtgggtagggtagtcccgccgggttcctgctgccccgccctcgggaggctggaggccccccaaggacaggtggtttccaggagcagcgggagggagcccgggttgtgtcctgggcctggagcagagaggggaggagcccagcgcctgagtttcaatttcctgaagcctgggggagggagaggaagagagcctcgtttcgtttcggggctctggacctgagcctcccgcccagggcccaccgcaccccgctaggacctgggatttcccagtctccacaccggcccggaactgggccccctcctctccgcagcccatccagccccacttccccgcttccccgcttcccagcatc

SEQ ID NO: 14613 - DNA, 30656 bp, Human
  misc_feature (1)...(30656): n = A,T,C or G
cagtcgtgtgtgcgggccccaggtgtgcgtgtgtgggagccccaggtgcgtgcgtgtgtgggggccccaggtgcatgcgtgtgtgcgggccccaggtgtgtgtgtgcgtgtgcgggccccaggtgcgtgcgtctgtgcgggccccagttgcgtgtgtgcgggccccaggtgcatgcgtgtgtgcgggccccaggtgcatgcgtgtgtgcgggccccaggtgcgtgcgtgtgtgcgggccccaggtgcgtgcgtctgtgtgggccccagttgcgtgtgtgtgggccccaggtgtgcgtgtgtgcgggccccaggtgcgtgtgtctgtgcgggccccagatgtgtgtgtgtgcgcgcgcgtgtgtgcgggccccaggtgcgtgcgtgtgcgggtcccaggtgcgtgcatctgtgtgggccccaggtgcatgtgtgtgtgtgtgggccccaggggcatgcgtgtgtgtgcaggccacaggtgtgtgtgtgtgtgtgcatgtgtgcgggtcccaggtgtgtgtgtgtgtgtgtgtgggtcccaggtgcgtgcctgtgtgcgggccccaggtgcgtgcatgtgtgcgggccccaggtgtgtgtctgtgtgtgggtcccaggtgcgtgtgtctgtgcatgtcaggcgtgtggcctgcaccaccccgaggacaagtcaggcatggcggttcagcctggcttatgactcaggtgatgggttgggaagttgctcggggtgaactcatccatgtagaagcgatgtcagcctgagtcccctccccagctttgcacgcccttcagccacctgacttccctgtctgtcttcaggcctggcatgctggggctgtgcagggccatggggtcgggaatggcagggtctgtggccggcccaggcccttttgaggagaggatgagctgagtgcagtggccagaggcacagtcatgcgaagaggggaagggtcttctgggggcaccgctggggaagagccctgaggggaaccagggggcctggggggctcgggacattcttgtcaggaaagggaggctggccaggggcagggccagggccagcccagtggcctttgcagagccgggtgggacatttggacaacgcccagggcaggagagtcagggaggagtggtggccctccctaggaaggggcagtcacctaaactaagtaccccgcaggtggtgaggaggaatggcccactttattcgggtcaccccggcacccggatgacaccccagctcccacactctcctgcctctgagcagggcagaggtgccctccagtgcgctgatcacctcccccatgccgctgtggcgggagaggagctcacagggggcagggctagaggtggggatgcctggggccagggctggcggctaggcctagaagctgcaggggactgaggggctgtggaggtgacacagagtcacctgccgaacagagagcgaggggtgggagggggagggctttggtgcaaggaagctggtcgggatgtgtccgggctgtggagggacaggtgggtgtggggtgtcagggcctggctggatggcatcttggatgggggtgggccggagtcaaagcggctgctgcccccggatttctcgaagcctgggcccaagaggactgtgcgtgtgggtgggcctggacctggcacctccctggccccgtctgcagtgtggggctggcgcctgcctggaattgacggggttccgagacatgatggcagcaaagacttatctggcatcgggcttggcatatgactgtggggcacaggcaaagggcccaacctcacagagcacagccccgaaagggagttctggagggcctgggctggtagaggaaacccctcgtctgcagggggcgggtggggaggtggaggaggggctgggccaaacgctgggggtgtgacccggggctgcgggctctcgggtctcagtcttcgggtctgccgagtgggcgagtggggtgcctcactccctgcggtctcttcccggtccccacagaacatggagaaggcgactctgccgtcggtgacgctcatcgtgggctgtggcgtgtcctctctcaccctgctcatgctggtcatcatctacgtgtccgtgtggaggtgggtgccgcccaggtgctgggcatgcgtggctgtggctcctgcatcccacgcctcttcccctgaaggtcacgggcggggtcgtgggtgcccctccctccctttgtcctcaccttcccagtcacctccgcctttgccacggacccagccctgctgtggcccctccgaggcctccacaggttcctgaggccaccccacacactcatactgtgtccatgccgcacaaacacagggggtggggcctggttcctcccctgaacgtgccccctctgcctgcacttcctgacttccctgtctacccttaggcctgcaggccaggccacagccttccccggacccccagtcaggccttaaggcccaaagcccctgctcactctccaccccaaaccccctttccccaaggccacagggctctcagcctgctgtccattctgattgtggccagtgggtttttggggccacccaggcaggtgtggagagatgtggaggagagctcgtgtttgagcagtaacatgcctgttgagtgtgtggacgcgcctccaggcactccccgctatctgctcctgtcccattgagtagaagtgtggagcagggagcaagggctcaaggtcactcactgcccatggggccgagtggggactcccaacgtgtccagaggacacgtggctccggctctgcaggcagcgcgatgtcagccgataatcggaactgactgcctgtctgctgcccaaggtcgggcatcgggaggtcaatgtggctggtgggggagggtggccgagctttcccggagacagtgactgggttgtgggtagtggcaggggctctccactgtcctgcctgaggggacagcatccactgggctctagggggaccatggtgtttcctcttcccgggacctgccttcccctagggcctggattccacaaaacatctggggaatggggttcaggggctctgaactcagctctgatgtcctgagttctgaggaagttttctgccgacagttttcaaagcatctccccttggtgagctcctccctggccatcccctgtgccctatgagctgccggcagggactgttctgtggtccccatgaggaagtggggacccagagagagaacgtgacctgcccaaggtcatgcagcacatcagggtcatgtcagagcccctgaggctcagccctgtgccctctgctctccagctgggtggacctcagtcctcaagggctgctggtgatggtggtgatggtggtcctggtggtggtgtttgtggtgatgatggtggtaatggtgatggtgggggtggtgctgctgctggtgattgtggtgatagtgatggtggtggtggtggtgattgtggtggtgatggtagtgatggtggtggtgatggtggtggtggtgctggtgctggtgattatggtgatgatgatggtagtggtggtgatggtggtagtggtggttgtgatggtgttggtggtgctggtgctggtgattgtggtgatggtggtagtgatggtggtaatggtcgtggtgatggtagtgatggtgatggtggtagtggtggttgtgatggtgttggtgctggtgctggtgattgtgatggtggtagtgatggtaatggtcgtggtgatggtggtgctggtgattgtggtggtggttgtgttggtgttggtggtgctggtgattgtggtggtggtggtgatggtgatggcgtgatggtggtggtggtggtagtggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgttggtgatggtggtgatgattgtgtgatgatgatgatggtgtaatggtggtgatggtggcggtgatgatggtcatggtggtggtgctgttggtgacaatgcctgcaggaagtggggtggggctctggtcttggtgccacaggaccacagcccctgtgcagatggggttctgttgggtgctgaccttgggcccctgcactctccacaggtacattcgctcagagcgttctgtcatcctcatcaacttctgcctgtccatcatctcctccaatgccctcatcctcatcgggcagacccagacccgcaacaaggtaggcagccttgcgtcctgccatgcacttcccaacatcctcgggtggtgaggatggaccccaggaggggcctggaccgtgggatccctgggaaactcaggcaggcgggtgtgggggcaggaggaggctgccccagctacagggagttccctgccctctgctgtggctgcaggagcctgtcaggggctggtcagccggccaagaagggcagcttgtgttccagtgtctctgctggacttgcccttcaggatgagcctgctgcagccctgcccatcccgctgtgggcagtggactcggcctcagctcaagctgcctcagggctggggagtggcactcaagacgagtggcactgtggtgacagaggctcccacggtccaccctctcacccctaccctcgccagccttgaagctggcagctcatggagggcccctgcctgccctccccagaccccctatccctggttcctaccctgtggtctccagccccatcccactaaatgtggcaggcgcagcctttggctgggggcctctgcttcctcaaggggccacgctgacaatgtaggagagaaaataaagcaagagggcccgcagtgagacagagaaggcctggccccagggcctgccatgtgctgtggcagaagctcagggccgctgtgtgggtgaggttgcctgcgacttgctgtgtgtccttggggcgtgacgtgccctccctgggccttgggcttactacctcctgaacgcatgggcgggtacctggacttttgagaaggcccctggcttagcatttggtgtggctatgaatggtgctgagaaagatggggagggaggatctgtttgtcccaacggggcttagatggtcaacaattcatctcagggcaaggaccaggtgatctctggattgccttctgcctggggacctggttgggtcccagtgagggtgctgggtgctgggctgccagctgcagacaggcactcagtgggggcaggtgtggggccggggagcacctgcccagcctgccccgccctgggcctcacacaggtggtgtgcacgctggtggccgccttcctgcacttcttcttcctgtcctccttctgctgggtgctcaccgaggcctggcagtcctacatggccgtgacgggccacctccggaaccgcctcatccgcaagcgcttcctctgcctgggctggggtgagccgcggccttcccgaccctcctggacagatacccttcctcccccactgcttgttctgtcctggcagcccctcctctccccatcccctgtggacccctggggcctcagttgctgcttgggtgggcttccccctctgggccctcgttcttccatggagtcaccagataaagcacaggacacccagttccctttcatgtctagataacgaaaacgtttctagcacaagtatgtccggtgcagtatttgggaggtacatttacaaaaagatgattcctgatttctctgcgagtcagatgtgccgggcaccctatgtgttctctgctcattggaccaccctgcgcccagctccgcaggcccttgccttgttcacctcctgccccatctcttgctcagccccatcctctgttgggggcttcagaagcgcctgcctggcccccgcccttcacggcagggctaggaggaggtggaggctggctggggacttgggtggggccaacaccctctctctgctccttctccagggctccctgcactggttgtggccatttctgtgggattcaccaaggccaaagggtacagcaccatgaactagtgagtcggggcattgggggtgtggtggatggccacatggccccccagagacttccaccgccctggagggtgagggctggccatgccctccccccgtgtgaccctgatcatctcacagaggctcagggagggtggggccccaggggctggaggctgagccccttgggcatcccctccctgttggccagccagcttctccctggcagcgagcagtgggcagcagtattgaaagaaaccgggccatcagggcctccccctctgtcagttggtccattagtcactctgagcctcagtttccccatctgttcggtggggagcccccctctgtacggtgctggtgagagggagggctgtttgagacatgagctctgggcacagtgggcacaccccccacagcaggcctgtggcaggcagggcaggggtcggaggcttatttcacagatgatgtcactgagaccctgaagggtcagctggaccaggtccttggggccttaaatggcaagccaggaagcttggggtcatcctagaggcagtatggttcaccgggtagggagaaagggtctggggctcaggatgggcagaagaactggggtggggaaggggaaccgaggcttggagggagggcctggctgcagggaggggagcagtggggagcgcgaggcaggaggaagtgactgatgctggctgagtgggaggggcggagcaggcctggctcactgtggagcccctggggacaggatgtggcacccccttggagcactgccctgtctaggtggcagtagggggtagacatagctgagggcccagggggtgagtgctgagagggaaatccaaacactgtccccagagatgagagaagcaaatacctggcctgccgaagtcaggggtggatcaggaggggatggggacattgaagtggggttctgaaggatgaagaggagtttgtttgacagatgacatgaggtaggctgctcagggtagagggaacggtccttattgggtttcaggtttccatgggcaccacaggtggtgtccagagatctggagaatgtggggctgcttactgggaggggggtggggagggggcaggacagatgtgtgagcataggaccaggtgctgaggccacggggcctgagccccagcattcaagcatcgcgtcaggaaggagggtcggccagagaccccaagagaagagccaggaagggcccaggcctggggaaggagggacagtcaggtggccttggccctgccagcctggtgcccctgctgtgtggctctaagcaggtgggtccccccctctggtactgtccccatctgtaaaatgggggtgacagtggctgcctggggtctcctgaggattctaaggctaaagagtgggtgtgacctgccctgcatgccgaaggcgcttaataagtgccagttttcttctgccacttcccagctcacccctactcctgagaggccggcagcacctctctgcacgcccctctgcacacgggcggtgctgatggcctgtctcctccccagctgctggctctccctggaggggggactgctctatgccttcgtgggacctgccgctgccgttgtgctggtactgacccgcccaggccccactccccacgaccccacctgggccccccacctgcctcctgggcctcggtgctgtctcatgccccaggctgtgcacctgctgtcccttcaggatggccctcatggccctcatcaccagggggtgggggtgcccacagccccactctgacctgcccttggcatgcagtgcaggggctgggccagggtagtgacccttcacacctgtgagtctcggcttgcctgattattgggtgccagctgtgtacctgccaggagatccccgcgggtgtggtgagtgagtggcatgggaggaagctggggatggacggatgatgcgagcagcggggagctgcaggctggacctgggttgtgggtgtctggccccagagcgccagatgtgaggctggtgaccgcggctgcttgccccttcgggggccccggtgaggaccttccctgtgtgggtccttgggctttccttcccgctctcctcccaccttagtgtggaggaaggcaagactgtggcaggtggcacgcagggtcaccgtcctggggtcacagatgagctgcggcagcctgggggacccgcctggggtcactggcctctactgggtccagctctgagcccactcagccagcccccacctctctactctggcagagcaccagggttcacacccaccctcacatcccctcccctctcgccccaggagaggccatccacttccagtaattcctgctgccatgagcggtgtctctgcagggccacaccccatcctagtggggactcaggcacaggctgggcctagcagagaaacgtgcatgaggggtgatggggagctagccctgtaggggcagttggggagcctactgggggttggaggggcaaatgggggcgccatccttgggcagccccagacccctccccacagccctggctgtgggatcctaccttctttattccttcctccaggcgggaggcaggagaggcgtggggtacctggcggtaccccaggcacctggggatggaggttgtgggaaaggggacagagacaggagtcccaccctgtacacccctccccaggatgtgtcaggaaggcaggctgaccctggcggctgtgggacccgagccccagcagcccctcctgtccttggggccacgtggggcaggctgggcagagcctgctgcaggcagtggtccgtcactggtgtccatcctctcttctctgctccggccacatcagaaaagtaggctgcccaggaaagaggccaccacccatcaggctggccaaggctgtgatgtgggtgtctgggaactctgcatccattgtggaaagcaggccggctgtgtggtcatgagccctgagctggagggctacacggtctaccaccctggtcttctggacgtgaaatgcctggtcaggggtccatggagtcctggggtctcccagcctccagcttctggaacctgggcctgaggaagtcaggccttgcccctcggggtcctagcagcatctttctgcagagtggggatgcaggaggagggcctcagggagcctctggcagttggggagcagagagtatggcctgagactcctccttccccccagcagaggaggccaggagacagggggagaccccaggatgctcagggccagtggcttcccgggggtgctccaggaacagctcttgtattgactggtagcctggacagtggcaggcatgggagacttatgttagagcccaagaagagcctccctgggtgcaggtgcccagccagggcccttatggggtgggcagttaatctgatgggaataggggagggagatcaggaaggaagtctagagagaggaggtggcctgcccagagcagagagccaggaggagtgtgaccccagggagagccaggattggtgtcccttagacaggtttcagctgcaggctggcaggggcctccgggccctgtgggtggggagctcgctggtggaagggatgcaaggagttgcagcagaggtgccgacggtgcgggtgacacacagagagggccctgcacagttggcagctgggctggaggtcacctgacatcccatcaggcactggggttcctgtgatggaggcacgggaggtgaccctgggtggggtagggggtcgtggttggcgtagccagcatcggtccggccagtgtcagcccctgagcctacggcggcccccacccccacacccccaccactctctgcccggcaggtgaacatggtcattgggatcctggtgttcaacaagctcgtgtccaaagacggcatcacggacaagaagctgaaggagcgggcagggtaggaccggggctacgcggctccttgcccacccggagtgcaagacccagagcccacccagccccgggggatggagaacgctccatgcccaatctgagactgcaggtccagggaccccggagcgggtgggaaacggaggcactgagtacagaggccccttaggctcagccagcccctgcctctcaccgtgcctcagtttctccatctgacctggacagggtgggtcccataaagtcctcagaagctgtgagactgattgtgcagggacaccccgcctctgcctggcttgcaggatggcagcagggtgcccccaaggctgggtgctgggggtccctggccccccactcccctaccacaaggcttgctccatggccagggggaggatgtcgcctgtccatgcagggactccctgtctttgtgggaccttcatcatggggaggatggtgcagaggacaggtggagctgatgttcctccctccggggaacccaagcccagggagtgctctcagcacagcagctggacagggtgctggagcaagacagaggcgcttgggatgtgtggctgcacccacctttgagggacagggccctgggcacagaggggaagctgcggggcgtggggagctgactagggcggacaagcccctcttggtcctcccgcccctcacctctgcctgctgttctgtgtcatccagccctggctggtgtctgcgtgggcccctcccctccgtgccagtcttgcttggatgcttggtgtctctctgtctctctctctgttcctgtctctctcttcctggctcctcctgctgtccccagtgaacagacgctttcaggaagccttccccttgggtgcctgtgggttctggtcctggttaggaaccagccgagctggtgtctgatgctgagtgcgtgccatggccctggggtctgtcactctgggtgggagtcgcggtgctttgtctcctggcctgggagatggaggctggaacaggcctctctaaggccttgccctacctgtccccggaacaccctgtcccacactgctcccaagacagtggtcacactcagaagaggtccccagggctacacatccagggtctgagcatggcagactgcctacctggtcgtaaaagcagcagtgatctcaggggctcacccagggtggatgttttgtttgcttcttagaataaccattgtggcagattctatggttatagtcccatcttaaagctgagaaatggaggtttagggaggttgagtggctgatggagctgagcttccaggccaggtgggcacacactagaactaagcccaggcggcctgcactctgcccacctcaccctgtgtgtgccacgggggccagctgcgttaggtgcacacagcccaggagcgcacccagactcgcctgtgtggccgtgtaggtctcgccgcccacgtagacgggatggaggttggggtggaggggcacccagtacaccggtctatgtgtgcacgcacacccacacgcatgggcacacacacgtgggcatacacatgccacgaggacctgcacgaggtccctgcccaggtcagctccctcgcagacacacggaaaggggactggaaggcgcagcggcctccctctgggaattttgccgctttgtgcagacggaggcagggtccaccctcagctgagcgcagggacccctcactaccttccccccatgcctgccacttgcagccctcagccctgcccaccacagcgcccacgccccaggcctgagttcgtgaggtggctgagagcccccaggaccgtccctgttggggcccaggctggactcctgaggggctggttttgcactttggccccgcccctcctgcctggtttccgagagcagggcgcttgctttcgtttcagccttttaatttcacttgcagtcagccgcccccgcaccccctcgggcgcgccctcaagtgtgccgagtgtggagtcctctctgccgccgatgccacctccgacgccaccagtaacgccatgttagtgcctccgctgccacctccctcctaggcccacccttggggctccgcgctctgagtcaccttctgtttgttttatgtttatctttcatttcttccttttctaccgtccactctgggtttctaggccactcccgtccccccgatccactgccctcagctcctccttccatcctccccacaggcctgctctaggcctggcagcacaaggcaccgcgggtgcagggcgtggggccgggcctgggcacaggtggagtgcagctgtgggctgcgctgcggtagggaaggagcggtggtcagtcctgtccctctggggcccgagtgtgtgccaggctgcaagctgtggtttcttgcttctggagttgaacctccacccccacccctggtgctgctggcacggagcccaggatggctgatgcctgggcaggggtctgcacccatgacacccccgcagttctgtggtggggcgaggagactggccctggcctgcctgatgggaagcctccctccctgtgagtgcacatgagcacacatgtgagagcatggctaggtgtgtgcatgtgtgtgagtgtgcatgcatgccactgggggtgtgtgggtatgcatgtcaccaggtatgtgtgtatgagtgtgcatatgtgagtgtacatgagtgtgcattcgtgtgagagcatgaccaggtgtgtgcagatgtgtttgtgtgtgtgtgtgtgcccatgtgagagtacttgcttttgtttcaggcttttaatttcgcttgtagccaaccgcccccatacccccttgggtgtgctctcaagtgtactgagtgtggagttctctgccgccagtgccacctctgatgccacaagtgtgcaagtgtatgtgtacatgtgtaagagtgtgccttgatgtgtgcaagcatgcatctatgtgtgtgagtgcaacccactgtgcatgtgtgagcgtgcatgtatgtgtgtgagtgcaacccagtgtgcatacgtgtgagcatgcatctgtatatgcgtgtgtgagtgtgcatctgtgtgtacctgtgagcgtgcatcggtgtacctgtgagcgtgcatctatgtgtgtgagtgcaacccagtgtgcatatgtgtgagtgtgcatctatgtgtgtggacgtgtgaggatgcatctgtgtacctgtgagtgtgcatctgtgtgagtgcaacccggtgtgtgtatgtgtgagtgtgcatctgtgtgggtgcaacctggtgtgtatacatgtgaacgtgcatctgtgtggatgtgtgagcatgcatctgtgtgtgtacctgtgagcgtgcatctgtgtgagtgcaacccagtgtgcatacgtgcaaacgtgcatctgtgtgtgtgagcgcaacctgctgtgcgtatgtgtgagcgtgcatctctgtgtgtgagtgcaacctggtgtatatacatgtgagtgtgcatctgtgtgtgagtgcaacctgatattttgcgttagtgtgtgtgtataagtgtgagtgtgtatataattgggcatgtgcctgtgtgtgcgtgtgtgtgtatgagcgtgtgagcattgtgtatgtgggaatgtgtttataggtgagtgtgtgaatgcgtgtgtgtgtgtgtacgcatgtgtgcctgagagcaggaggcagccagggccaagggaacagggaaggaagggttcagggtcaggggctgatctgctgaccttgggcagccttagcagctgtgcatagggcagggcggtatgggctcaggtgggtggggccagttgggctttccagcctgaggggtcatttcgtccgtgccctgcctccctcaacccaaggtgagggtggtgcgcccaggtgcatacccctgtaccctcctgctttgctccctgagccaggcactaggggtccagggttttaggagccgtgggagaagagctctgggccctggcactgtgcagatgcgagtcggggcgaggctagcctgggtgggaggagcaagcccggagctggggcagcgtccacactggcctgccaggccccgggaagttcaggttctttggggctagtgttgccctttctttgtctcaacaccagggatgtggcaggggctgtgggatccaccccatctcattccatcagagagaagtgggggccagaaggatgttccctttgaagtcactcagagcctctccccgcaccccgggcacctgcctctccagacaggagcaggcgcggtgcagctgggcactcctggcctccccttcagcagctcccgggcctttctgcttccttcccaccgctctctgcagaaatgtttcccagccgcagaggctgagctgctgtgtgggagtaatttacaggtccccaggccccaggccacctgccagccgcagcagatcgggctgtaaatgtcaggcctggagacccagctgcaccactgtatcccctgacgggcagcagcaggggtgactgacagcaggcaaagaagtctccatggggagggaagccttgcacctcctcccttaggacttgggtgaggagaggagtccagggtcccggctcaaagaataccagctttggaagggagaagagagattctccagcttatcgccatgggaaaaccgaggccccagccgaggggtcctgctctgtgtcagtgagtgtttccttggctctgtgaatattgatggagggcctcctcatcacaggccctgtgccaagtgcagggacacagcagtgagtgacagccagggccctgtccgctgctgcagcctggagggagcagcacggtcatgggcaagggaggcctctccggacgcctgagttcccaggcgtggggtgcacagggagcaggggcaggctctccagggccaggggaagggccaaggaggttggtggcctctagtacactccaaagttgtacagggaagaaggagtcccatgaggctattagagcccatcctatgtccaagagcaggaggggcgggtgcgtggccagggccaccgtaccctgagacccgggaggcactggccatgcaggaccaggccctctgtcctggtgctgctctgggctctgggcctgcacgtgtcctagccatgggtatgtggtcatgcctgaggctggggccagacagatccctgccggacagcatcactgaagaaaagcagaccaaggcctggggtagagggccggatggaggagaggaggaagagagtccaggaggcaggcatggctggctgtgcctgctgagaggtcctgagagatgacgacacagatatcccttgggggctgggccctgcacaggtgttctgcactaggggtgggagcagcattggtggccaagccacactagagagggctgaggagcagagcgtgtggttttggaggcccttgtcctggcagactccaggtcattccagcatctctcctgccagccctggtgtgccagctcctgcctggcattctgaccgcacacctgggccccctactccctattcagtcctcctgccccagctccccctgtgtaggaggaggggaggagggaagctggcgccagcacccattccgggtggtgatgacagtcctgcgggctgtggggccccctgcgggcaggcacagggccacctcccgagcactcaccgcagccggggtcctgctggcctctgtctgtgttccacagccccgggaagcaggttggtgtccccactgtgagcaggagagcacaggctcagaggccacgcgcggaacccagtgggtggatgtggggaggggcccaggccttcactgctcccagcgaggctgggctgcaggggcgagggctgctgtgaggctcctggaggacctcctgggagggggtggcactgagcggcagaggcagcaggaagggtctacaggcaggtggccgctggggctcaggaggcatgggcggagctggcccacgaagaggaggaggcgcctgtcagtctgtctgttgccgtctgtctctgtctctcccctgctcctcccctgctggccttggccgtctgtctgtcctcatctcattccctctaagcttctctctctccaggtctctgagttctgggctccaccctcccctccccaccatggccatcttgctctgcccttcagggcctggacccctcgcctggggcctgtgggctctctgagggtcctggaccaggggatcctccttggcgcaccccacaccagacagcccatccctctccagcctgtctcccttcccctgtcacctcctagactgtcaggaacctggatcttcccaaagagcccttcccccttgcccagcttctcaggacctccctcctgagtccttgggtccactcagagaccttgggcttggggagggggtgctgggacctcagtgttgacggtgggctcctccccagcctggggcaagggcttgagaggggaggggcagagtgtgggacaggattgggggagtcctggggaggagagagggtgcagacgcagcctgggcagcggtggacccctagggagactcaccccagagaggaagggctgcttggcccaggcccccagagacagagacggggacttagggctgggtccccaccgaggcctggagatgcagggttcagggcggggtgtccctgggggcaggggcaggggcggcagcgctgacgccctccatccccagggcctccctgtggagctcctgcgtggtgctgccgctgctggcgctgacctggatgtcggctgtgctcgccgtcaccgaccgccgctccgccctcttccagatcctcttcgctgtcttcgactcgctggagggcttcgtcatcgtcatggtgcactgtatcctccgtagagaggtgggtgaggcagcctctgtcgggccgggctcctgcggggtcctggggctgccgagtggcctcctccttccccgaggacctcggcagggagattgtgggtaggcgcagcatccatgaccctgacacatctgcaggcctcggtggtccacagagcggggcctgcaggtgagcgtgtccaccccactctccctgggagcggcccaggcagtgcagcaccttcccaaggatgccctgcgcccgcactggcttgggggcgtgggggacgaaagcacatggggcccccatcctcaaggggcctacaggagtgaggaagctggcagcagaagtagcttccagggcaatagagactcctgcttccggcgttttctggatctttccagaaggtgtcactagaaggttttcaccaaactacatcccaactaccgcctggctggtggccacgattgggatgctcttgcggaggctggaatgtgggaaagcatgcatgtcgacctgggtggcgtaggacacctgcttccagatcagcgccaggagggcggaaggcccaggagcggggcggccacctcccccttcctgggtccccctggagagacggcagaggggctgttgaaaagcacacaggttcccgaggatgaagaatacaggagaagccgacagcaggggagccggtaggcggggaagcaggatgagaggtgcagtcccagctaactggagacagcccaggcttcggccagctgcaaggagccagacggtgtcaggagtggggcccgccccctccccaggatctctggctgccacaggaaggtcaggcgtgggaggcctggttttccggccttaggtggcgatttccatcccagcctggaagggcagggctgccctcttggcctccgcggcctgggcctcactctctgggcagagtgaacagaggggctctggcctggggcagctggcacagctgaagatggggatgccgcctggaaacaagtcagggaagtggatgtgctgagcctgggtcacgtgtcagcgcaggcctcccagacccagacctctgcggggaggtgtgaacgcccctcccaaggcaatctgacttcgaggaaagacaagaggaggaagagccagagttctgatgtccagcagcgaaacggctcctgtaccagtcaaccaccagccgggcagtgctccacacttacatcccagcagctcctgatgaggacagcagagctcctgttggagttgcaacccaaccagacaagcaggaaaacagcgtggggacagaggcagcccaggaaggagaaacctcagtggccccttcttatcctcacctgggagaagccgctcaccctggtgcacgccacatgggccaggccctggtcccagcaatgaactcgtgttagtgaatctcatgacagcttctaaagcaggtgccacctgctccgttccagacaggacagctccagggagctcgtcacaggagctcatcaccatggctgggatttgaggccaggcggttcttctttgaggccacactcctggcccccagtgcctggcttctgtgaaacaagaacagtagcctatgaaaaaggaacaaaaagagccttgtggaaattaaaaacagagagcagctcaaagctcagtagaaggaaaatggaggcaaaatatctcacaaaatagaaaagacggaaattggagagatttctcaaacaattaggcaaatccccaaggaccaactgaccggtgacgggagctgcaaaggagacagcggagaggaggggctccagggaggcagagcccagggccagctggagcagagggctggcactgggggtctcagatgtgcaagaagcctcatggttggcaaatggggtcagggaaggaggggacccagcatgctcctatggtgggcggggacagaggacaccagggccagacttccccgaagcccccagtgagctcccagcccctgtgtgtgggctccgtgctgcagggccttcaaggtcctgcccagagatggcttccacctgggcctggtagcaaggggccttgcctacccaggtcctcagcctcgggggtggtggccagggctgcagagcatgctgaggaggctgggccaggtggaggccatgccgggcagcccagccggccctgtggcctgggacactcctgcaggtgggcaagtcagtccctcgtctgcccatgaggctggggcctcctgggctgaggctggctcgggtgttcctggagagggtaccagagggacttggggagccccagctcctctgctcgcccacagagagcacttccctacctgcctgtgggaccgggcacacggtaggtgcccagtaggcatttgcggggcaggtccatgagggagaggatggcaggaaggcacacctgctgtggcggcctggagtccttagctggtgtccgggggtcagaggccactgagaccctggtttccaggcctggccctgcctctgaccagctgtgtggccacggacaattctctcgcccgctttgggcctcggtccccatctgcctgatgagaggggtgggctgggtgtgctcagccccccagcagcatgaagcagagcactaggtgagggaacagggccacaggtctgtggttgagtgggtgggtaggtaggtgggtgcctggaagccaggagccccagcttgccctctttctgcctctgccaacttctgtttggatgcctcctccaggaagccctctgtgctttcatgccccccaccacccccaaggattccctttatatactgttaccaccgcagtgtcagtgtgctgcccagagcagcccacaggaggtggctgctggccccacgggagggacagttggcattcgtagatgatgtctcctggatatccagtctttacctccttgggagttccctgtccataagctctgctggccgctggtcttcccctgtagcccctcctacagagtctgctgccgtcctcaccactgtcccccctgaagagtgggtggccatgaagggtgaaatcccccttgacagagtgctgttcccagtggggtggctctggggaggggccaggctcagggaccctggcacagcaccccacactcccagggcagtgagggccaggctttccactggctcagaggaggcaacgacattgaggctgctggagatgcaggccaggtccagggacatcttcggcccgctgcaggtcagggcaggttctcgcaggcggactctggcccgagggcctgcagcagctctcggtggctgggagcttggtagagagaatctcagacaggagaggggtaggctgttcccctcctggggtctcttttccccttctccacccagtgggtcatgactcagcagaccagaggtggccctgtggggaggcctcctgctgaccagccctgcccttccccgagacgcccgcccccccacaggtgctgctcatctgatctggcgctggcgcagggtgggggcgtggctgccactgaggtgctcggctctccctccccaggtccaggacgctgtgaaatgccgtgtggttgaccggcaggaggagggcaacggggactcagggggctccttccagaacggccacgcccagctcatggtaggactcagggcccggggactcaggctgccctacctgcctcgtacccccgccaagtgcctccaggccctcaccgtgccccaagctcccctaggccccagcaaccctgctgagaggagctctgaacccagtgtgcagttggggaaactgaggctcgccaagtggaacccctggtccggggtttccagctgggaaggcctgagctgatgagtttggaggtctcagcggaggctggcatccaccccacactcacccccgctggcagcagtgcccgtctggctggacaccaccctctgagcatcccagccctcaactcaaggtccccatccttacacctcccaggcccaccctcagtgccctccatccccacccaggaaagtcctgctcagctgccacctaggggtccagcctagcctgcccatcccctccccctaccccgcatattcccacctgctgcctccctggcgctccctgggtgctgcccagtcctcagcccctgcagggtgactctcccttgtggcccctggccatcctgccttcaccctctctgggctctctgccctccccctgcccatcctggtgtcctcagcggtgtgttctgcaccccccgcccctgcctgtgcctgcgcctgtcctctttacagcacagcgttcccacgacacgcacaggccctgggagggcggcccaagtggcggttcctacgtaagggcccccaacagccccctgtggagcctcaactcttccacacctcgacctcagcatcttcctcctgcagccttgtgcccctggggctcagccaggaccgtagtgggctcctagtcaccaagtctgctcccacccacacccgtcactagacctcctgcttctgcacccagaggctagcacacagggtggagccaggcccccttctccaccctctaggcctcaggacagcatccacgccctggcctggtcctgtgcagaacccgcagctgtgctggtcttgctcctgcccctgtgtccttcacacaagcttccaccccaggtgttggccaccctgcgcactcccgtgggtcccctcctccagggagccctccttgactcttgccccatggtgccacctttctgggctcaggccacgcccctggtgaactctgcacggctggtgcgcgggaggtgctccctgggtcccggggtgcccagccacctcacagtggttgtgaagctcacaggcagggcctcagcagatggcatgtccagccccgggtgagggtgaggtccttcagtgagagacggccacttcggctcttgggtgacgtccaggcaggcccctcatggctccatgcctcagtgtctccatcagccagggagcaggtatccaccagtggctagcttgtcattttgggacacagcttccccctcccccagcgtttctcctggcctgacctctgatcccagggggaagattttgttgtctccatccaacccaacccctgcatttgcagggaagaaacctccaggttttcagtgaagggtgggcctgtcccctggagccccagggcccctggagaaggacagccccaggcttgggcaggtcctgagctccctgagggcgggtctgggccgcccactcctgcctccccagctgactgtcagcttggtgtggctgcctgagggtggtgggtgccggccttggccctgaattgcatgttcaacatccccccccaccacctctccctccccagaccctggatggggcccccttggagggatgtgggggaccaagggggagagttctggtgccgcaggcccagagccattcctgaggcctggggggagagatgagaccagaggaagcaggaggtcatcagctcccagacgccttggagagagcacacatgtgtgcctcacaaacagtctcacacacacctcagaaacacacacacagccacatacagaaatacacacgcatgtacgtgtacaaaacactcagatgcattctctcacatttacaaacacctgaatccacacgcaaacacagggacacaaattcacccacttatacacagacatatccacaaacacgcacacatacactcacacacgcatccacccagagacacaaacgcccaccacacaggcaggtgcatggggaggcatggtcgcccacgtggggcactgggctgtggacatggacaggggttcctcggggcagcaggagcaccgtggccctcccgagcggtctgtgcacgcgtgcacacacccccgctcccagaggcgctcaccctgccctgttgtctctgtcctacagaccgacttcgagaaggacgtggatctggcctgtagatcaggtgagcgcccgacaggtgagaggacagtgccagcccggccccctgcacggccccactccacgcctccgcctgtgcctcccccacatcacccatccctgtccactcctgctgcccccacccacacccagccacaccgtcaggcccacctggacccaggggacctgccctgggggcccagccttccacccccgtccacttcctgaggccgaaggagggtccatggggcatgatcagaagcttccagaacactgccctggcactcctgctgagcaggtgcctgtggagcgcctggctgcgtcccctgcccacctgacatctcttcctctgtcgtggccccagcgaggagcacagcctcaccctagtgccgctccccccacctgcctcctgcccaccgccctctagcacctgtgttctgtgccaccttcatttcctcattgccagtcccagcaggggcagaagtgagtggggctttcaggctagggggacaacggggagcaagaggaaggcggggagaaggacccaccatggagcccccggccggtgctgagcttcctggaaccaagtgcaaaaaacgaacgactgcccaataaaggaagctccgccgcccatccccaagcatcagactgcgagggtctgtttctgtccccaccactgttctgtgaaccaggtcctgaggcagtgacaggcagtggctttctgagctgtggagaggccaatggaccatgctccctctggtcatttagatatttgaagagcaccttctctagagacagccctggcagaggagctgggacagccccaggtggggagtgtgtgctggtgccagttgggccccaggagggcttcctggaggaagtgacttcggggctgggctgaatgggagctggacaaaaagcaccttctgcccccttggggtctcctgtgaaccagtcccacagcctctcagaggggtgaccctaggacttggggcctcaggtggcttgggtgtatgtgggcctctctgagcccctgattccctctcattcatgcgctggctacagcgcctggtggatccacatgcagctggtggatgcgccatgagcagctggtgctgagcgcctgggagcttcctcagagcgggagggtgggcggggtgccaagcgaggggcctgggcctggggggagcttggcttttattgtgccccaaggtgggtacatgcgagggaggcacatagacccctcacgtgccaggcgctcgttctgccttgtggggagcaaagtgtgaggtgtgtgggaggtcgggagccccagggtctgtgcggggtggggcggccttggggacgtgcgtcccgagagtgctgtggctgtctgggtggggcatgtgggtctgacggggaggatgacgggtcactcttgggtagggacgagggaaggggcggggctgaaaatgggcacagggtgttgctgtccagagggtggaggagaggaccaggccgggagcatggcctgctgagctctgagggggacggggaagcctgtgttcgggagagagagtgacccctggctaggcagcttggggggcattggtgaccctggggcccgtgtgcctggcaaggtggctgaagggagcagctggtgaacacaggcacccagggctggcttggcgtggtgggtaaccatctgccagcctgcatggggcaggacacagggggcaggccaggcttcccaggaagggccctggggtctggatctttggagactggggcttggagaaaggaggggtgtggagggtgggcacccctctgtcaggggcaggcggctgggtcagagtcagcttggggttctccgccagccagtaggggctagattcattggcaggaagtcgggggcaaactggagccccactcagaggtcaaggcggctgggccccttgcaactgaccagagacagaatcagaggtgtctgggtatggagacctctctccagggaccaggcggccctcagggcagagcagggaggcttgcaggccccaggggcagcgatgcaggaagggccgtgacagagggccagggcctcgtggctgcactcagcaccactgggctcccgcacactgccccccacccacacaaggcccagggccgtgggcgtcgggagcgttggagggccggctgggctctgccaccagcacagaccgttctgcctgtgtccctgtgcttccgggagtcaaggccgccctcgcctgctcttctcagcgctggggagggcagtgtgtgggtgacagccatttgtcttcttggggccagtggagagggccacccttgtgtggcagcctcatctgaggacacaggaaccctaggggccgtagcgccaggcttgggtagggtggtacctgcagttggccctccgatcggtacccagcaggacctggccagggtctcccaggaggtggcggcctcgcagggcagactgggcccctctcctgctggggactgtcctacgccatcctcacccccacacctgtccccgctgtctcccccgcggcccctgcagtgctgaacaaggacatcgcggcctgccgcactgccaccatcacgggcacactgaagcggccgtctctgcccgaggaggagaagctgaagctggcccatgccaaggggccgcccaccaatttcaacagcctgccggccaacgtgtccaagctgcacctgcacggctcaccccgctatcccggcgggcccctgcccgacttccccaaccactcactgaccctcaagagggacaaggcgcccaagtcctccttcgtcggtgacggggacatcttcaagaagctggactcggagctgagccgggcccaggagaaggctctggacacgagctacgtgatcctgcccacggccacggccacgctgcggcccaagcccaaggaggagcccaagtacagcatccacattgaccagatgccgcagacccgcctcatccacctcagcacggcccccgaggccagcctccccgcccgcagcccgccctcccgccagccccccagcggcgggccccccgaggcaccccctgcccagcccccaccgcctccgcccccaccgccaccacctccccagcagcccctgcccccaccgcccaatctggagccggcaccccccagcctgggggatcccggggagcctgccgcccatccgggacccagcacggggcccagcaccaagaacgagaatgtcgccaccttgtctgtgagctccctggaggtgaggggggcaggggtgggccacaccccagccagcgagggcagggctgcagcagctgggtcacccctgctgggtgggacccccacgccgtcagcggggcgggctggctctgcctcctagctacaccccccacccctggccctgctgggtgtgctgtgtatgtctgacgtgtggtccccaccctaggcttggcagggtggtctcaccccgtttcaaaggggctcagggacccacagtctggacccacggagcaggacctgcacctcgcacagtcgctagtccagcccttggggcagcctggcagcacatacctgcctaggtcagcctggagcctgcagctgacccagcctcagtcagcctgtaggatgttgtttttgggggagcccgtccccacaggatatgctcccaccatatcctggctcctggcctctggtgatgctgccctgtgtccctgagttctctgtcgggggacccagccatgtggccccaagttcaggtctccttgatcctggggagtgtgtcccgggtaggcgagccggacaccccagcccagccttggtgctgctcgctggcacccagcgcatagctggaggagctgcctcagtgcgcccccaggcatgtcccctgggtctggcctggtccctgaaggcaggcatggggcgagtgagtccctgatgccctcagtctgaggcagggagaggcgtggacttgtcagggacccttggcgaatgttcgcaaaccccttctccctgcagcggcggaagtcgcggtatgcagaactggactttgaggtgagttctggtgtccccccccaccagacacttagggccagatgtgctctgggctcccacacggccaggcagctccccggcagccaggggacgggcggggcaggcaggatgggccatgccctcctcctggcccaggactcactgcccagaccccgcctgcagaagatcatgcacacccggaagcggcaccaagacatgttccaggacctgaaccggaagctgcagcacgcagcggagaaggacaaggaggtgctggggccggacagcaaggtctggagggcagggaggggcggggtggggagagcccttaggtcaggccaccgtctcccttcttccctggatttgtgcacttcatccatccatccatccatccatccattcgttcattcattcattcattcgcccatccctgagggctggcctgaccctgccatgccagactctggaggccatggccatactgggagctgagcggtcacgagcctgctcctggggccaggggtctggattggggtggagccaatccagggcagggtccccacagcctgacccgaccgtggggttcgcaacctctgccaaggctggggagaggatctgtgcctgccgctgcccagctctgttctgggctcttgtcctgaaagcctcatcctgtcccctgtcccctgtcccccacctcccgtcccttcctcactgattcgtgtctgcctcctcccccctactcctcgggctcatggctctccctccgggccccacccctcctgcaccacgggccacccagcagccggaaaagcagcagacgcccaacaagaggccctgggagagcctccggaaagcccacgggacgcccacgtgggtgaagaaggagctggagccgctgcagccgtcgccgctggagcttcgcagcgtggagtgggagaggtcgggcgccacgatcccgctggtgggccaggacatcatcgacctccagaccgaggtctgagcgggtgggcggcggccacgcactgggccacggaggagggatgctgctccgcccgctcctgccgcagacgggcacagacacgctcgcgggcagcgggccaggcccgcaccccggcctcagggcgctcagacggcggccaggcacagggcccgcagtgctgggaccagagccagatgcaggacaggaggcggcccggccagcgggcacagggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtgtggcctccctctgtgcggcccggggccctgacccagccctggctgctggggtgaagtcctctgcctggccttggtgtccccgcatccctgggccaggaggactctggaggccaggtgggccctgcagctcctgctttgccctgggcctggacgtctgggccttggactcccaggccagtggtcacgtggctcccaaggcgtcccctctccctggggctctgggaacattcaggaaaccccaagtgctggtgcccttggctacccccgacccttagtacgtgagcttcacacagctcttaggccccttggtggggacacatttcactccccttgttccttgagtcattttcaggagggacagcatgaacacaccaattctttaaaacagtctgacacagtggaaatgcgtgtgggggcagggactccaaggcagggaggaagcctccctctcagcgctcccacctccttcccgcccacctggggctctgccctcctctgctcctgcctctgccctggggcaggcacagttctgggtcccctcttcattgctggggcacttcctgtctccaggcctcggccccgtttgtccggggaggcatggggagcctatgtgaacacccctaggccatcccccaccagcccagaaggaggaccctccttccacaccctcctcccaccccaggagctttgagatgcacgtcctgcttccctctgtgtctccagcagggggcagcctgagcccccgaagggagcctagttgggggaagccacaaggctggcagggacaatagcggggaaggaggggcccccctccgactgtgtgctgcaccctgcagggccccaggaccgggagaaaatgctgcacagagcctgggcctggagagcaatgcgcgccaagctgcagaggcggctacagcctagcaccccctcacccctacaacctcaactgtgccctgtcactcctgaccccagagtcctcaccagcagacagggcgggacggggaaggtgcttggagggtgcagtgaccacagtgaccatgggtgatcacagatggtcacgtgtggccatgactgactgcattgagtgggtggacgttgagcagatgaccgggaacggggtggtgtgtctgcagtagcccagaggagatggtgcaaagtcaccgggttcaagcagttgagaagcacagtccctgagctgtggatctgagcaccccagaaaaccagaatgttttgacgagattggacaacaaaacctgatggaaaccgagtcacactacatatctaaagctcctttgaaccgctgcacgcacacacacatatgttctgcagcagggatgctgatgcactttattaggcccctcccaggatactaagtgaaatatcacacacatcacaccttctttcttaacccggacagatcccacttggcaccagggtttcagatgagaggctgtggactgtggtcccttcctcatcctaagttacggaaagaacctgggaggcccctgggaagcaggtggagaaagcgctgagcacccagctcctcccctgcagaaggcagcacagagcctggggcaggttctggaggtggggcttccactcaggtcac

SEQ ID NO: 14614 - DNA, 8610 bp, Human
accagggatggaaattttaaagctgacggcagaacacacaccagagctgctggctcgtggaagcctttgaagtgatgatttgatgggcaatctgagttcctcaggagctgcccaaagcctcataggctcaggagccatgctctgctttcagagtactcaacctgggccttcccctacctgtgtgagatgtctgctgctgcacccgcacgtgccccaggatcgaagggaggcctcagagtcctgccctcacagtgtcccccatgtctgaaggcaaaaaacttggaatcactgtgcatatactattttggatgctcgctttcttgctttctcactttcttgctttctctctctctctctctccctctcctccctccccactccctctctctccctctccatccctctccccaccatgtcctgctcctctcactccctccctccccctccctatgtaatgtatactttagcattttaccatgttaaatattttttcaataatgtgatttttgttggctatattattctacagcaacgactactgcagtggtgtagataaatctcataatgttgatcagaatctcccaggcacaaaagagaaaaaaagatacatgactgtatacttttctgtgtatagactgcatagttgagtaatttttaaattattttatatggtactgtctttgatgacttctcagaaacatcagattgattcatacctttttttggtctctatttactcatttgccagtaataaagcatcttgctccctaaggcttcacaccatgaaatagccacagtgctgggggccgtcccaacgtgttctttcttccacagacgcaagatggctgtcctctctaaggaatatggttttgtgcttctaactggtgctgccagctttataatggtggcccacctagccatcaatgtttccaaggcccgcaagaagtacaaagtggaggtaagtgggaacacaagctggtgcccttgtaggcttgtctgggggccacaggcttagccaagaacttattttcagccatggagggagaggcaaggagctagttgtgagaagtggcagtttcaggactgtgttagcgattctgcttcttcatggtaggaaagaggcaagaaatacagggccctgctagggagtagtttccatcttgtttgactttgtctcttcggtagaaagaccaggaatgctgggattccaatagtacacttctgcttggagctatttgctaggaagagagttactgtattttccacagagggttaaatagcaatattgtttcatggtgtgccactttaaaaatgatgtcttatggtgattttcctgttttccaagtagaaaagaggtatgtggtgttgagattagcctggacttagacataggaaggtggtctattaaacacttcctttagttttaggtgatctagaagggataattaccaaagttgtccctggtgagtggttttaaatgtctgtttctgtttagcaacttaataattaaactcccttactagagcttcttttaagtttttatatttagtttcttcttttttttcccttccagtggacacttccattaagattctcacacactcaatttctgttcttctattaagggaaatcttaaaaggatgtggtatttgatgactcttaggaaggctctatttccctacagtatctttgtaatgcatctgaaatccaccattgatgcttaacgtcaatgaaaagcacggagtttggcgcaaagctgcctctttcccttgtgcaactacagcgcagacatacattcttattcctggatatttaatagaaacattgactctgcttctgagaattgagacccttgtcaccataaatatttaagcagaaattgaatggtcatctatcaagggtgtgaaagaagatactttggaatatattgtttttaaggttcattttaactttcaacactgaatgctcctcttgaccatctgatcagtatgtgctttgttgtgacagtatcctatcatgtacagcacggaccctgaaaatgggcacatcttcaactgcattcagcgagcccaccagaacacgtgagtgtcggccctgccgggcaccaaagacatctgcagagtgggtgttttctgtctaacacctcagcccttagtgcgctgtatttgctgagtcatagtgatggtgacaatcatgggcacctcattaaaagtattcaaaaattatgtatgtgaacacattgactattaagcaaacttaagagtggttggaatggtgggatttcgggatattcttttcaaaaaatgtcttcatggttgcattacctactacagttttgcagcatgacccatctaaaccgatgttgactctcccaggcctagggagtgaagaggttttgaatgctgtaaggaaacccactctgactcaccaggaccttccacttccatttgttagatgtgaggtccttttactcagcatgttccaagtgacctctaatcccatgcagagcaaaggagggtggatgatagtgaccaggtcttctccctgcggtgaatgtttatttttacccccaagcttctaacttggcaaggaagatgtaaagattcatagtgctggctgggtgaggtgggctcacacctgtaatcccagcactttgggaggccgaggtgggtggatcacttgaggtcaggagttggagacaagcttggtcaacatggcaaaaccccatctctacaaaacttagccaggcatggtggcacgcacctgtaatcccagctactcaggaagctgaggcatgagaattacttgaacccgggaggcggaggttgcagtgagctgagatcatgccactgcattccagcctgggtgacagagacactccgtctcaaaaaaaaaaaaaaaaaaattcataattctacacaggcatacttaaaaagggcactttttaaaagtttctttctgtcaattccaggttggaagtgtatcctcccttcttattttttctagctgttggaggtgtttaccacccggtaagttttccaggaggtgttcatctatttggatagtagttcactgagctattatcaggcacagaagaaggaaataaacatttaatgaatatcttcagtgtctaggcactgcatatttaaaaggattttattcaattatttcttacagagttctttaaaggagatgggattttcctcatattttacagataaggaaaagcctctcatatactatttaaacttcacaaggtcaaatagctacagagtagaaggattagaatttgaactcaggtctgtctggttctaagtttcatgtctataagagttcatttgttatagtaattcattcacacaacaaactttcactcaccacctggggtaaagcagtgatcaaagcagacaaagacccctggtttcatagagcttgcctttttgttgtggggtgtggggtggtcacagagaagaagcaacctaagtaaattacatcatgtgttaggaggtggtgagtgcagagaagaaaacaaagtggggaaggtggaaaggggatgtggagtgggataattttgaatagggtggtcagggaggggggctttgctgagatgatagttaagcaagtataaaaggaggtgagggagcaggtgctgcacgagtttccccaacctccagccagaagacaagcaaggcctgaggcaggcacctgtctggtttgtttggtgagcagtgagaagccaatggagccaggagaggggcagcaacagagggcagaggggtgatgaggcaggtcactggggacttgcaggcctctgcagtatagatagccctgtgggatggagatttagtctgcacttaaacatatctaaataaagcaagtttatcagcctctaattaattgccatttgggtcttgtcttagacagaagtgttccccttttctgaggacagattatctcctgaaaccaagttctgaccagagtggcccttcagacttctggttctaagcctttcctaaccatctggttcatcctgaatgccttgtacttttgttaaaaagctgccagaatggcatatctactgcttatgaccttgaaggcctgcatttttttcaaagaaacatctactgctcttgtatctcttagaaaatgtatctttctggtgcctctaaagatccccattcctagcaagtgactagactagctgatctgaatagctcaggtctctagattagtcctcatttggtgtccccactccatccccattcctatcacacatccctggatcccattccttatgggtagttctgaaaaataagagctagtttggggacaagcacctaacaattgttcctaggttgccagtcattaggcaacattatagtaaagaagggcctggcagagactagagctgctatatcgtgacttgagggactggtgttattttcatttgtttcaccctcctgttgacatttaatgttacccaaaatcaactcaaacaaacaaaaaccctgatgcagtaaccttatccctaacagtagcactgctgagtgggaaagacactggggaaggcggccttctcacatgctgtcttctgtgttctctccttgcttattttaaccaaggaagtcaccccagcatgacagccaaagggatggatttttcatctaagtttttattctctcttctcaaggacattgggaacagggagacttttccctcgaagaccatgtattctgggagaagcgctccccttctttctagtggagctacacccccagtgtagcctgcagaaccacctgagcccagccctgccagtgactgacttcacatagaacagcagctgagtcttcagtcaatctcatgctcagagacccatttgagaaaacggcatttcccctagtcctgactttggggcagttctcttttctggcctgccctgagaccggctggcccacatgtccttctcttgctctgacacaagttccccaagatgcccagggcaagtggggggattccttctatcccacctgtctagaaggccaatactcatctcccaggtccacaagccaagccattcatagaagaatcacagatattttattttcctgctgaaactaacttaattctacctaatttgggtggggagtagttggccaaatcatgaaattgttaactttttgctaacatattgtgtaatcaaccttaggtgttaaaaaaggtttgcttgtttctttcatgcaaatactaatgtagcccttttttcttagcgtatagcttctggcctgggcttggcctggattgttggacgagttctttatgcttatggctattacacgggaggttagtatatattgacatttgccaaggaaacaactttaaaattttaaatcctatgctggccaggcacagtggcttacacctgtaatcccagcactttgggaggccaaggcaggcagattgcttgagctcaggagttggataccagcctgggcaacatggtgaaaccctgtctctacaaaaaatacaaaaattagccagatgtggtggtgcacacctgtagttccagctacttgggaggctgaggcgggaggattgcttcagcccagaagtttcaggctgctgtgaaccatgattacactactacactccagcctgggagacagagcaagatcctatctcaaaaaaaaataaaatcttatgctactatatttttcttcttgggaatttgagaaaaggggaagtcacttgatatttaggtgaaaggtctgttttctttttattaatctttcaattgtaacgaaacttatttttattgagcattttctatgtgccaaccactactctaagaactttgcatatgttatttaaccttacaacaattctgtaatacagatattattgcattttacaaattaggaaactgggactcagcatgattaaagctctaggtcacagagctactaagcgtaaactagtaaactaggaatcaaacccatgcagtccgactccagagcctcaccattactatacctgctatatctgagtaaggaggaggaaaagccatttttagctgtacttctttgaaacagagggaactccttccaaaggtcctagagcaaagttgctgtaattattatcccataattttctaagatccaagcaatactactgtggcacgttacttggcatgtggtatctgacttgccaacagcttcaggctaaagagttagttaacctcctaaggccagtttgtctaatgtacaacctcagatgcgatgatagaatggcttgcgaatgttgaaagcatcataattctggagcactcctggtaacttctgttctttcttctttttcagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaactcctgactcttaccactcatttccgtttgagtctgtatctgaaatcagtagcctagtcctactagatgagaaaggagccacaagtattgtgccctctcctcacccttccagcagatgcttctgtagtatgtgaggttgagaaaaagtctgattgtggtgatgtaggtatagtcatgccacagtgatgaaaaattaaagaaaaatcttctagctctcaggatatgcattatcacttgctacagatactccaaggccaaaggaatgcttgagcctaaaagatcaagaccagcctgggcaacatagcaaaaccccatctctacaaaaaaatatacaacagttagccaggcatgatggcacatgtctgcagtcccagctacttgggaggctaaggtgggaggatcacttgagcccaggatgtcaaggctgcagtgagttatgatcacactgctgcactccagcgtgggtgacagagcaagaccctgtctcaaataaataaaaattaagtttctattaaagattgtttctgttgcttaaaaactgaagcaatagactaaatgtaagatgaaggttaacagagatgaatgtaacttgctacatttagaaacaaagatctgattgcctacgtacaaatgaggaagacttagaagatttcagttggtttagagaacactgccaagttggcagaatgagatagttactccaaaacactgatgtggccataaactaccttaataggaaatatagtgtctagacctgcgctgcccaattggccacatgtggccatctaaatttaaattaatttaaataaaaaagcagttcttcagttgcactacccatttttcaaatgctcaatagcctgtgaggatgagagacagtatttgaacccagtcctgactctaaaatccatgcattttccattgtaccagtttattgcttaagctccgaagatgaagcatttaaggatagaatgccatggccagccattgaagatggtcagccttggccaaatggccacctggagcccttggggcatttgatgaggaggctggaccagtttagcacacactccagtgttagttcatgagaaagtttcaccagtggagagcaaaataaggaaaatgagggactgtttttcataaagctttgacttgtactttttacattaaaatgttctttatgaaatgatggtgacgatgaatggtagggatttttggtcctggcttgaaaaaatgatataattgagaatttacaataagacagggttttggtttttgcttcataagaaacacatctagagaggccagagaacttgccgaggtttcctttctcactgcagagaacagcaggcatcagtgaagcagggcagggaagacctggagatgaagctggcttttcacctttaaaagtcttaacagggtgtacttttcaaactacagatggtccccaacttatgacagttcaacttaacaatttttcaacattacgatggtgcaaaagcaagactcaggctgggcatggtggctcatggctgtaatcccagctctttgggaggctgaggcgggcagatcacctgaggtcaggagttcgagactaacctggccaaaatgatgaaaccccatctctactaaagatacaaaaattagctgggtatggtggtgcatgcctgtaatcccagctacttgggaggctgagtcaggggaatcgcttgaacccaggaggcggaacatgtagtgagccgagatcacaccactgcactccagtgtgagtgacagagcaagactgtctcaaaaaaaaaaaaaaaaaaaagcaatattcattcagtagaaatcgtactttgagtaccaatacaatcattctgtttttgactttcagtattcaataagtcatatgagatattcaacacttcattataaaagaggctttgtgtcagatggttttgctcaactgtcagctaatgtaagtgttcggagcatgtttaaggtcactaggctaagctatga

SEQ ID NO: 14615 - DNA, 8801 bp, Human; identical to SEQ ID NO: 11791
  misc_feature (1)...(8801): n = A,T,C or G

SEQ ID NO: 14616 - DNA, 7952 bp, Human; identical to SEQ ID NO: 12326

SEQ ID NO: 14617 - DNA, 10383 bp, Human
  misc_feature (1)...(10383): n = A,T,C or G
tgagcagaatcagagtcagtggatggaaggaaaattacattaaggctaggaggattcttgctaaactgacctaacaggatctttcctgaaggcaggtgagggtgatcagatagatcagctatcaagggtggagaagcgggcagggaattatccctaaactgacttggcaggattcttgctataactggctaggcaggcccaagacagcgcataaggacaagacctagccaaaaagaggccttagaggagcctgttgaaagtctggttaaggagatggtctttgtcaataccaacataaaaatgaacacataggccgggtgcagtggctcatgcctataatcccagcactttgggaggctaaggtaggtggatcatgaggtcaggagttcaagaccagcctggccaagatggtgaaatcccgtctccactaaaatacaaaaattagccgggtttggtggcgggagcctgtaatcccaactactcggtaggctgaggcaggagaatcgcttgaatccgggaggcggaggttgcagtgagctcagatcgcaccactgcactctagcttgggtgacaaagcaagactccgactcaaaaaaaaaaaaattctccttgaagactgggtatttgggaaaaaaaaaaaggaaaggaaaggaaaaaaaagaaggaagggaagggaagggacgaagggagggagggaggaagaagggaaggaaggaaggaaggaaggaaggaaggaaaaagagaaataaaattaagaggcctgatgctgtggctgacgcctgtaatcccagcgctttgggaagccaaggtgggcagatagtttgagcccaggagttggagaccaacctggacaacatggtaaaactctgtgtcttcaaaaaatacaattagctggatgtgctgttgtcccagctactcagctactcacgggtctgaggtgggaggatcccttgagcctaggaggttgaggctgcagtgagctgtgatcttgccactgcactccagcctgggtgacagagtgagaccctgtcacaaatttttaaattaaaaaaaaaaaagtaaacaaaaaggccgggcgtggtggctcacacctgtaatcccagcactttgggaggccgaggcgggtggatcacctgaggtcgggagttccagaccagcctgaccaacacagagaaaccctgtctctactaaacatacaaaattagccgggtgtggtggcgcatgcctgtaatcccagctactgaggaaggctgaggcagaggtcgcggtgagccgagatagcgccattgcactccagcctgggcaacaggagggagactccctctcaaaaaaaaaaaaaaaaagtaaagaaaaaagaaattaagaaaagaatgaacacgtgtttattttacctaactcatgaagaaactagcagatgttataattaatacaagagaaaatctagagaacggacatatttatggatcaggaaaacagaaatgaatatgaaaatggacgccaaaactgctttttttccccacagtgtggggaacagcaggttaattgaacctctaccagacaggatagaatttgcatacagatcagttacctacatgaattgtaaaataactcccatgaaaacagaatctttaaagcagaaggatatgctatagacaagtccttcaggtttcccattagccatcacttctgggaagcctttctagaatctccacgtatgaatgagttgccacttctaggccagcatatttatcacgttatattgtttacatccctccctccatacaagatacacaagaccatgggctttttggggcagattctgtgagttattcaagtctctgattgcttcttcagcgtgaatatctgcttctaaggaacacaatatgctaggcggtagtgtttgtcgtaaggtaaacatattgcatgttaacggagcatccattttactctaatatctggggaaacatcatttgactttaaagaagacgctgtctttccctccaccttcaatgtttcattgttttattaactaatcgctttttatttccaggcctgcgggatacaacgggaatacaaaaatgcgctagagcggtccgcaacgctgtagcctgcgtaaggaacaattgatactaagtggcactaggctgcagggggtgccactgacacactgggagagggctcagccaaccacaaggtgataacgaggtcagcggagcaccagaaaccggctcactagcctcctgatcagtctcggcccagaggaaaatgaagggcttgagcttctgcttttacaaatctgaggggcaggaaatgaaatcccactagcagtctgcgtagtggagttgaaccctagcacccgctccccagggggtcgcctacaacgcgttccaggtgggcaggctcaggcgctgctccctcacaagcccccggccacgcggtgtctgggaccgggtgcctagtcagcccgggtggctccgccccgaggccccgccccatgacgcgagaccccgcccccgcagcgcccgcttccaagatggcggcagcgatgcctgcccggctgttggggtggcggtgacgacaggcagcaaaagaccaggtatgtgcgctgggaatgcgtcgacacggaggcctgggataaaggtttgggcattcgagagagtgagaagttttgggtaacgcctggagacgagcctgagcagggacggggtcctaggtggaagtatggacgggggccgggcgggctcacgttgctagtaggtagggcaaaagcaagagactgggataggatgggcgtgctccgaaagagctgggttttaaccccctccacagcgcggaccacgcccctctaggtgagcccttccagccacccctgactgtctctgcccctgctctccctctccctttctcttcagcagtaaccctcctccccacccccgctagaagaggggaaaggtagaaaaggtagaggacgccacccccaccctactctccgccgagctccggggctgttcgcttacagcccccaggtggtcacggtccctgcacctgaggagttggcacccaggcacatgaagaatagaaggagcctgtttcctacttcgccctgggtactccttaggccactccacggtcctgtcatgactctgtcgccacttcaactggttcttggtctgggggaaaacaatgtttccattagctgtcctgtccccactccccaatctgtcctgttggggtgggggtacgggggtggttaagtatgaacctgacacttatcattccagggtagcacgggagataggcgagggacctaccatctcctgctcctcctcttcctttccaaccactttccttcacttcgcctgctgggaaaccagcttcaccctgatcctgatctctggcggtgcaggtagctagttatcctttaccacttctgttccagctggtcccagattcgctgctggagtgctggatggagcctttctctgccctctgtgacatttccaattttagataatgcctcacatctctgtccccccgggaccccctggagcccccatgatccctaagaagacagcttgaacctaggtgagtctatctcttcccttctaaaattggaagagggggttctctagagactttctgaaatgaacatgagatttgaatgatgtaaacatttttgggggtgaggactgacagtagatggtgggagtggtttggggggaggtagaggagagcgaaacttgggctgaagtgacaggtggtagggttactggtggttacattctgtttccttgcgtgactgtgcacctgtgtgctcccttctgtgactttgttttctgctttttcctctttacccctggcatcaccttcaaccctacctactgacctctctgctggcttgctctcttcctgcctacccccagaattcccctctccctccctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttaggtaagtgcaggaggaaggaggtggtgaaaggaaggacaaggtgcggagacagggaggcttggggatagggaggcatggagtggcagaagtggaacttagaagaggataggtaggctgaggctgcaggtaggctgaggttgagatagagggctgaggttgagatagagtagactctgaattgggagtttagattagactattgggtttccactttctactgcttgtccctttatgggctcttcctgccccaggctaggaattgtttttccttgtagatgagccctggtttaattagttgcaagtctctccagccttcaactatagcttccaaccctgtaagacaggagaaagttaggcaaccctaaaataagaagagaaggctaggtaaggatcctgcaccttccagcctttgtagagctgtcccagtgataggtaatccaaggcatgcgagatttctgagtgagccctgagaactaagccccagaaccagactgccagtgtcagaggtattcccaaaccctagtttgattcttttctctttgcccctctgatccctctacttgccattccttcccaacagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggtacccccaatctccacctcattttgactgactttcttctaaggaagcctcaagcacatgccacttcactttcatctaaatgggtccctagaataattttaagaaggccagactgttagagtgtggagaagcacccggcactgctcttccaactttgttagtcccatacttttccttaatctgcttaggttattcccactgtcctacactctcctgtgattttttctttattgaatggcttgtgcagagttggaattggacacaatagggctaaaattctagttccgtcacttgttacatgtatgactctgagcaagatacttaaacatctaacatgaggaaagagcataagataactaatataccatctgttccacaccacaccattgttggttgccaattgtcaggattaaatgttagacagcagcatcttaagtatcaggtccataccaatacacaagcaagatttgtcaaatgactaagtggaaaaatgaaaaagatagtctttctttttcattctccttgccctccaccccactttgatttccctcttttcacttttattcttttttttctttttttttttttttgagatctcactctgtcccccaggctggagtgcagtggcacgatctcggctgactgcaagctccacctcccgggttttacgccattctcctgcctcagcctcctgagtagctgggactacaggcgtgtaccaccatgcccagctaattttttgtatttttagtagagatggggttttaccgtgttagccagggtggtctcaatctcctgaccttgtgatctgcccgccttggcctcccaaagtactgggattacaggcgtaagccaccgcgcccggccttcacttttattctttagcccccttttctccgtgccacctacagacatagtctggttcccctccattatcttccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacaggtagagggcatggaagggtactgggaaacagggaagcctactatcctgtggaaggaggagagccaagcggattgtggttggggatgtgtccccagaagactcggggtatgcaaggatctttctctccctagcctcccgtacccccagtacttcggaggagtctcagcacttactcctgaccagtacctgaagatgaatggcttccccaatgaatactggggctggggtggtgaggatgacgacattgctaccaggtcagacttcctgccacttcctccctcctgaccccagtctggatccctgtcctctaagaccacctttgaccatagcccttcagcactaacctttagctccctggtcctgcactgagcccattcctttcccttagtctttttaggatacccaggtcaggcttgcatgctactgcccattgtgtcatccttcagtctcctggttagtttgttcttgggagaggacataagatcaataggaaatagtatcgtcggattccagaactggaaaggggcccagagacagcttagtcttgccttctgctggggttccagccaggccacttcctatggggttaggagagaggggctctgctccatgttcccagaatcgctttgtaaaaggcctgtgccattggcacagggccaactcatttttagcatgtgaaacattctgaccttcagcctcagctgacccaatttcatgtctgtggtatgaatatttgggcttggtatgcaggaccaattgcctccattccccctgtgtcctctgtgatgacatctctgtgaattctcatcctctgtatgtgtgtgaaatacccagtgaattgtaaatatacataagtattcttctagttccttcccaggccatctgcactccatgcttctgtgtgtcagaagtggagtttgtttcttttaaggtcctgattacctggttctacccttttcttttctttctttcgttttttttttttttctttttctctagagacaaggtcccattattttcccaggctggtcttgaactcctggcctcaagtgatccttctgccttggcatccaaaagtgctaggattgcaggtgtgagccactgcacctggcctacctttttcttaacatgggggatgtgggagagaagctggggtagctcagtcactattctaagattctcagcaactcccagtcttctcttattcttttgacagaatggcctctctctgcgtccttcctagactgcaagggcagctcctaggagccctttaggaagccaagggaataggttgccaactgtttaaaggccctagggtgactggcactgggccctgaggatttggatacatccagcttttatattctcttcagccatttccttctttctgtttgacttctgtcctgggctttttttttcttttgcctactaagtaatagttgtttttttgtgtgtacagaaacatttaatcccttccttgcttttctctactctggatcccccatgataccctcacttttcccatagggtgcgcctggctgggatgaagatctctcggccccccacatctgtaggacactataagatggtgaagcaccgaggagataagggcaatgaggaaaatccccacaggtaggaagaaggaaggactgcctgggaattgttactggatcctcagggttctgtacccctagccaggaaaatcctaaaggtccctagatttctggctgttcctttctgggtcttagtctccaacctctaaccctcagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactcctggtgccgtgctagggggtaggggcctctccctcactgctggactggagctgggctcctgtagacctcaggggtccnnnnnnnnnnnnnnnnnnnnnnnnnnnnnnnnnnnnnnnnnnnnnnnnnnnngaagcccctccctgggcattttctgcctatgctggaatagctccctcttctggtcctggctcagggggctgggattttgatatattttctaataaaggactttgtctcgcatctgctcctgctttctgcatcccaggcacactttgcctctttgctgccccgcattcttatgcctataggtgatagaacagccagaccaagccaagctccagcaatttttattttcatgaatgagagttggggatcagctgttaggttctgtgcccaggacactgactgctgcctggcgcccactctctatacagtcattaacagcaactccctcataggaggctccagccagagtcaggggcaacctgtgagcagtcaggaattgcctagctgactctggaaggaaaggatgaaaggaatgttttagctgggggtctgatgtccttggccctcctcagcccagctgttttcccaacttacctagtttttgccagtgacctagtgtatactggggaatgcagttctgagaagagaggagaggatgcagggaaaagtttattattgatgtcctaggccttggctgacatacagtgacaaatgttccagtctctgtcttcaaggccttcagtggagagctgagggaagtttatcccaacttaccttgtgtagatggaccaagcagtggctcggcatctccttcagtcctaattgtgtagcagctgcttcctgggcccgctgttgaaacagctcctgagataagacacagccactagcctccagtgtctgtaaccaggaacctcccagcatcacctaaggagggaatatagcactgatcagtctggccttgcctacaatggagcacagaggagccctctggaaatgccactaggcaaagtttcctcctcctcacagtcactctgaggccaggggggctcccgtcctgctcagggaaagcaactgagtcatacacgattcccaggactcctggatcttctgaagatggcaccaaatgtccaaatccctggagagaaggacattcatgcgtcagaaggaaagggctctagctgaggctgtctctccttcccatttttttgggggggtgggggggacagagtctcactctgtcacccaggctggagtgtaatggcgagatctcagctcactgcaacctccacctcctgggttcaagcgattctcctgccttagcctcccgagtagctgagattacaggtgcaagccaccacacctggctaatttttgtatttttcatagagatggggtttcaccatgttggccaggctggtctcgaactcctgaccttgttatctgcccacctcggcctcccaaaatgctgggattacaggtgtgagccaccatgcccagcctctccgtccctttatcatacctggacaggcagatgggctccttggtactgcagattcaccacagctacagacactgcagtgatggcactcagggcacgagccagaggggcagcctcagcagggagcagctcactgagcactagagatcaggcagaggcctgactcagaaggcattcccattacagttgtcagtcctctttgggattagactcccatagagatgaccagttcaggggcatggtgtggtcctgctgacccaggaaggtatagcttttgcttctcactggtaggggttggggaaggggaaggtggctattccattacctgaagctggaatggcactaataacgtggtcagcctccagactgctgtcccttagagatacctgagagcatgaaaacatttgagagacccagaaaatgagaatttgatgagtgaaaagagacttctggtgcctcactctcagtttcccaggcacccatgtggccggggagactgtgtactgacccaggatgaagagattgggtgactatgtagacttcacaaaaaatcattcctctgtgtactc

SEQ ID NO: 14618 - DNA, 8417 bp, Human
  misc_feature (1)...(8417): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattttctatctgttgagtatagtgcctgtcacctagtaggtgctcaataacttaattaatgctttctctgtgccaggtaactgtgctatgctcccaaaggaggatgtaactggggctcacagaagttaatttgcccaagttaattcaactaaaaacttgtgcaggccgagcacggtggctcacacctctaatcccagcactttggaaggctgagacaagaggattgttgaggccaggaattcaagaccagcctggtcaacagagtgagatgtcctctctaggaaaagaagaaggaagaagaagttgtacagtcagtattcaaactcaagtttacctgactcccaaactcttgctttttccatatcacacgattctcactatggaagaatgaaaggaaactgtagaagtcaaaggatcttggtctgaattcaagatcttggtctgatcttggatcttttgcagaagtcaaaagattttggtttgaattcaatctatattacttattttgtgaccttggttctgtcaccagaatctaagcctgtccacatttctaaaaaatgtgattgggctgggtgcagtggctcacgcctgtaatcccagcactttgggaggccgaggtgagtggatcacttgaggtcaggagttcgagaccagcctggccaacatggtgaaaccccgtctctactaaaaatacaaaaaaaaaaaaaaattagcagggcgtgatggtgggtgcctgtaatcccagctagtcaggaggctgaggcagggagaattgcttgaacccagggggcagaggttgcagtgagccgagattgctccattgcactccagcctgggcgacagagtgacagactccatctcaaaacaaaacaaaacaaacaaaaaaatatatatatacacatatacacatatatacacatatatacatgtatacacatatatatacatatatacacatatatatacacacacatatacacacacacacacacacacacacacacacacacacacatatatatatgatgaataccagccctgcctatcctggggttgtttcattcagtgggatttaacctcagaagttttgaaattttgctaaaacatcagataaaggtttatttgaaaggattatttgattatttttgaaggattatttgaaaacatcatataaagtgatgttctaggtatcaagacccctccctctacactgtttccccaaaagccctcgcacctttcctcacatctttcatactttcctcgccacccttcccttctcccccacagtgcagttttctgctgcagttcttcacaggttggtggaagtgtataggagccccctgcctcctggagcctctaggactttagccaagcccaagaaagtctcaggaattccccccactgcccccatccttcgttgtgcagggcagctgaggggccccagatcagggaccagcagagagaaatgctctgctggtctcaacagctttgtcatgatctcttgcctggcacagtgatactgtcggcaggaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttagggtgagcaccgacaggatttgggttggaatacaactaaaagggcacccaaaaatgctggtctgaaggagaggggtgtatgccatgcactgatactgagaacagatctccagaaccccagcctgagcaggcttctcagcaaggaactcttccaagataaggctggcgaggcctaaaggagggccctagggccagagcctctagctaatgttctgatcattgcagcctccagctcatctgttcatccatcaccagcccttgcccaccctggcccctgtgctgcctctggtcacacacttcgcagacatcaacactttcatggtactgcaagtcatcaagtttactaaggacctgcctgtcttccggtgagtgacctcccctcatctttcaggaggcaaacacttcagtaaattgtatatccaccccgaaaagtcactgactacaaattatcacatgcgtcagcctttccaagcattaggtcttgaattcccagctttggttttaaatgtgccaatcagaactgggagttcttctccatctctgaagtacaggcttgcatctaaagtgcccttgaggtgccgcgcagtggctcacactagtaatcccagcactttgggaggcggaggctggcagatcgcttgagtccagaagtttgagaccagcctcagcaacatgacaaaaccccaactctacaaaaaatacaaaaattagctgggcatgatggtgggtgcctgtagtcccaggtactcaggaagctgaagtgggaggatcacttgagcccaggaggttgaggctgcagtgagctcagatagcaccgctgcattccagcctgggtgacagagtgagactctgtctcaaaaaatgaaagctaaaaataataataataggccaggcacggtggctcatgcctgtaatcccagcactttgagaggccaaggtgggtggatcacttgagctcaggaatttgagaccagcctggccaacatggtgaaatccgtctctactaaaaatacaaaacttagctgggtgtggtggtgggcgcctataatcccagcttctcaggaggctgaggcagaagaatcacttgaacccaggaggcggaggtttgctgtagccgagatcaggccactacatccagcctgggtgacagagcaacactctgtctcaaaaataaattaattaataagaataataataaggtgcccttgtcggctgggcacagtggctcacacctataatcccagcactttggaaggccaaggcaggaggactgcttgagcctaggagttcgagaccaccctgggcaacatagtaagactccatctttacaaaaaataaaaacatataaacaaacaaaaaattaaaaagtgggccgggtgcagtggctcatgcctgtaatcccagcactttgagaggtcaaggcaggtggatcacctgaggtcagtagttggagaccagcctggccaacatggtgaaaacccgtctctactaaaaatacaaaaaatcagccaggcatggtggcacacgcctgtaatccaagctacttgggaggctgaggcaggagaattgcttgaacccaggaggcagaggttacagtgagcagagatcacgccactgcactccagccagggtgacagtgagactctgtctcagaaaaaaaaaaattgaaaagtgtccttgtttcctgctttccacagttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtggtgagatggtgctagagcaatagggggcatgtgtcctcatggtacaggatgtggtcaggtgacctagaggctcctaatcctagtatctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgtgctcttggctgccatggccctcttctctcctggtgagcacctcccaaagcccagtagccttttgctgcaccacctctgcccaaatactcagctccttgagtccatccacccaggccttctagcctagctatcaaacctgcagactaggtctatcccagcctcagtccccggggcaccacgcaggcccacccctgccacccaacttgtccttcccagctccctatcttacagaccgacctggagttacccagagagatgagattgatcagctgcaagaggagatggcactgactctgcaaagctacatcaagggccagcagcgaaggccccgggatcggtacggtgggacactgcgggcttggaggccacaccagggcaggaaggggttggtgaaacattgagcttgggaggaatgtttttttactgtcctttccttagggaattcaggtatcttggggtctagtccttccccctggccatccctgtctcacatcgtttcagcatccaaattgctgtatttggatactgctgtttcatctcactttttccagattttttttttattcagtacagatgcaaagtagtagctcagaggctctgggtaatagcattcctgagattgatgacatccattacctcactagtccaacttctccagactaacgcagacttttctcttcccttggcctttcctctcctcgccattgggccaattccttcgatttctcatttcccttgaagttagggccattcacagtttcatggtcaaagccagttccaggttcaatagtctgtgatttatccaggctctgaggtatgcaccgcttctgttttgctcgttcctccaagagctagtttggccagaaaggggatgctttataccatagaacacatccaccttctagaacctgctctagaaggccaggccctcagattccacatggttggagttctggccaagtctggagctttcttcacactcggctctcagagctctgggttcagaaaaaactgagcatggtgagagaagacagtgtcagaccgaggccccctggaggacctttggaacctctgatagtctgtcataccagagcatgattttctctaatgttcagacctggcttcactgaggaatagttcaggggatcagggcctagagacaagactcccaactgccttatttccctcctgttttcctggcaaccccactacttcctccaaaggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaaaatgctgggaccaaagattgggccgggttcaaagggagcccagtggttgcaatgaaagactaaagcaataactgcctcttcatgcggtcatggggatagtgggggtgaccataggaacaaagttgttctctggaagcacagaagatgggaaggaggaaacctcagggctaagaggtaaagaagctccttctgggaatgggtgggccccacttcctgagaccaaacatctagcccttcagccctactttcccagccttgggaggctctgggatggaaaacaggatggtcagctaatcccatgcaggattaaccaaagggaaaggaagaaggaagcctgagggcaaggggtgccgggggaattcagccataccccttaatccttctcccttagtccacagccacaagagcatggggaaggtgatactggggctggtagcagaggggggatcctcaaacctctgcctcatcaactgcccctgtggcagctccagttctgaggagggcatggtcctgtccaccactctgctcctgggtcctagagatcacccagcaaggtgggctctgaagaggggcctagtctttggccctagggcacctgactcagaggttccagctgctgtgggggctggctctggacaacctcagcccacagtgatgctgaagccacaatggaatctgttgcgccagtgattgaggaaggctccaagggctagggtgacaggcagagggggcatcttcttctccagcacagcacctacacaccagttactatccaccaagcctgttgggggagagaatacccactagattatttaacagggattggaggaaatagtcaccagaagtaaggtcgagcttccctccctcctctgcatcccccattcctcaggatagccaaatgtctcccaataaccctcacctctaaataccatgttggcctggggcagagtcaggtggtaaccaaaggagaatgttgtgtcttgtagccttgtgtttgcctcaaactccactccaacctgaacctgagaaccatgggcaaggatgagagagagatcagtatcagtgaagaccagaagggtcctgatggggaatcagcagaatggaggcatgcatgtaaatatatacacagcgtggtaggaagaaaaataggtcagcagggcgatagaggtccagatgaacagaagttcatgactgacttgctgacaaggagggaatgagatcagaggtctcacctgttcatttgccctgtggtagtaacttgcatgggccccgcctgatcccacattcaatgtagctacccagtgtacagctgtaaaatccaaagtacagaggggaaggagtgttaactgtagtatgacacaggccaggaaccccagaaaagtccagaattgccccccaccaccaccactacttcacttcgccccatacccgagtacttcccagccagtgtcaagatggccccctcttcgcctggccgccggtgataaactagctctcctcccagcaccagccgatgagtgaggctctgcaggaagtgagcaaccatgatcactgtgggggaatggggagacatggagtcagtcatagagacaatatccagacctgctccctcactcccaataaccgccaccccagcctgcccaagaagttccttttctaaactccaaactgtacagaagatgaagaggcatagtaacattagcaaatgggccgccaagataaaaagaaccctgtcccagttcctcacccgactccccaatcaggtcaggatttcctagggtcagagtggctgtgtagtcatctccccgatactcgccatcaaactgccatgtcaggaacttggcctgctgcgtctgggtggcaagagcaagaagtaaaatctccctccctctttatgatcattatagactctgctcctccttccaagccctcagagcaggaaacccgtggaggagaaagaggaagtgcctcaggggatggaggcaggaactgtggtcacctggaagacagccttagctcggagccgctctgccaagaggagcaagacctgggcgttcaggctgccactgctgtccatatcccctaccacagtggggaacacctgtggaagggtgtacacagtagtaaggctgagccggatggcaccactcagcctaaacccaaatatagaacttcattaagagtgcacagcgccccctggtggagtcacaaagacacactctgggctcttcacagaaaatgtttctctaccctctctcattcagaaaagacacagagaatcaggttacggcccattcctccccataacacacacaattcctcttcctccagacctgggtcccagattggtttttagggagatgacccaggtgtgtggagccctcacctcagtgggactgagctgccaatcccctgcataggccgcatggaggtgatatcccggcaagcccagggcactcatgtgtatagtgtgcgccacctgaggaaaagaggattcagtggagaaaagcgcattcctgctccacttcaatccctcatcccacccttagtcttttccccatccagagggcctctcaagaatcctaaatattccaacatatacagagaaggtcatcggattaaaagcaacaagtcccacaggcacggaggtaaagagaaccccacatcctccctcatttgtcccacatagactggctagggctggagtacaaaggaaaggagaagatgatccagggacaggaaagggggaatagtaaggaggggccagagaagtgggagcacct

SEQ ID NO: 14619 - DNA, 78649 bp, Human
tgtgtaggggaaaaacagcaacgttaaaacgcaactgtgtaaatgaggatagagagtgcgaaaggagggagaggcgaggagctgctctatttctagggaggttttggggagactgatcagctccaaggacagaccgctgggaagggaaaaacggcccacatcgaactggatgccggatggaaacctctctgcgctattagactgcgtccagtacagcagatggcacgagcacgtgcggcgctcagcttaggctctcggaggcagctgagttggaaatcccgacggaaagcacccacaagctcccactctgcgctggcccacccgcgtgcacgcccaccccccacgcgcgtccctggctcagaagcgcacagatgtttactgcttagagccggtaccgctggggagatcgagcgacttgcgcggcgcacagtgcggcgctggcagggctctgggctcccggtcgggggttcgagcggccaagggatgggggtgggggcggggagagtggggggagggcgaaagaccgccgagaggaggggggagtgggtggactaatgatgaaaaagtctcctccatcccagttccttaattaaatgcatggaaagaaccgaggcgagcacatctggtttcaatctacagccctttgatggcatcaaatgttcttttcccagatcagggctggaagttctgggctaactatggccgtttggagcccagaaaccatttacacacactcgtacccttctttctctccagtcgagcctcttgactataggacgaaaaaaaaaaaaagtctagcaatcaagggagtgcgggagtacggatgcgtgtgtgtgtgtgtgagtgcgcgtttaaagaacataaaacgccacaaataagcacttaatattttactgagtcgtcatacagtaactcatttctaatgagactgttaaagctgttaccaaattccaacaggtcatgaaaaaactgctcagcacctctctgtcttctgtcaggttagggctccgcagacggacgacagaggattatccgtagacttagatgggggttcctccgcccctctctgtcctcctgccaccacagccaggctggacgcagaaccgcacggaagcctccccaactcctgcctctgggagtgctcctgcctgcttcaaggaatctgggcagcgggaccctctgggtttagcgtcctcgcctggggaagcaactttggccttaccgtagaagttacaaaattggcgggggtagggagaaagattataatatatatttggagtcctttcttccagtttaataaacacgtacttttctcattgccctagtcctggtatgcctaatggcggggaaagcctcaaataaactcggtgccctctggatctccccaacctgcctttagtccttgcgagaggcgtgagagaacttcctattatcatcccttttgttatttttattacattatttaataggctccctctacggaaccaaaaatagccttaatatgcttactttctccctgtactccgccccaaactgttagaacagcagaaaatttttttttgggggggggcggtttgggggaaggcagaaggagaagaaaatttgattgtgatggtggtggattttttccaaatttccccacagctgttatcaaaacatgcaaatgagattttccaacaggatcttaaacaaatctggaggagttaatgccgaagcaaaataatcagcacgtttgaagtgactgtgagtttcagtttgtcttttctccccgtgatattattgcaggggaatgataattagacctttagaaatccaaaggggctctcttgctctcttccctctctcatttctcttctctctttctctctctctctctctcccttcctccctccctccctccctctctccctccctctctcttgttccctccctctccctttctctctaactctgatgttggcaaagggggttttcttaatcagactgttttttggtcccagggaaaggaggaagaaggagattgtgatggagaaagggggtctgtgaaacgtcaggcacagcacaaaggctttgccacgtaattacaggctcctattaagtcgagatctgccctcccaggggtctccaattttcttgtattccctacaaagcctcctctgcatgccagtttgtgccttttgaagtgccagagagcttcttgatccaactgagaaggaaaaaggagcccagcaagaagagggggagagagagaagggaaaggggggaacccaccagcaccctccgtcggactcttgaagcctttttttttaattcttaatttttttttttactctttacaaaaagtaaagtgagaatcctgctctctaatacatctgcaagacatcaccctctcctcctgaaactttagtcactcctgagaatccacaggagtgcagagaggggggaacacgttttcttgaagatgttttaaagctggaacaagccttcttctgttggtgcttgaactcttgcctgggaataacttttttaacctttaaaaaaaccattcactttgattcttctctcccaccccttcttctctcttcttctgtttgcctaactcccccgccctgctggcctccgctttcctctctcccccttgttattatttttagtctgtgcgtgtggacacttttggagagttggaagggatttttttctcctgacttgaacatagggtgactttttaatattgtattttagtgtggattatctctttggaccgcgccggacttggcctcaggaaagcaaccaaggctgcggaaggcggctggtgcagaacgctctgctctacagaagggggtcccccgccctcttttccaattttttttttttggccttcctctccttccctccctcttcctccctctctctctctctctctccactacccccctctttcttccccactcggctcctctcccccctcgcgcccacagcgtttggtgttgattcgagcgggaagaggggggtgggtgggatcggtgggggagaccatgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacagtgagtgaggggcgcatgcccacgggggtgtgtgcccgggacagagggcggggacccgtgtagggcagctagagcccgtccgcggccagaaagacaaggtcctgggaccaggagaggtgatggcagacttcaaaggaagggccagtcacaggggaaaccagatgagaaaagcgggtctcggccgagggcatagccaaggaggacgctggagagaggctccaaggtccggggacactccgaggccctgcggtctcaggcagggactctgtccgcggcggactctctttacttcggccaggcaccggctcggttcatcccgcacgcggggcggcggggctgggctgggaaaaggtcttagcggggtgcaaactcagagagccagcgctgtttgggaaagcagcaggttaaagatgctgagtcgggttggaagggcttctctcgggcagcgtatgacggcttgagggagggcaccaggcacagggagcaggacttggcgctgctcaggctgcactctccacgcgggcaccgtaaggccgggcgcgaccgggaggccccgagagaacgcccggccccagacgctggagctgctctctgccccctgctgttgcctctaccgcaaatgggtttgagactggcagagtcaaaagcccggctggcttgggaaaactcgggccaagcaaagggaatgtcctttaagggtgaaacctgaaatccagccccgcatgatcccgcacaggcgagctgcatccgggaggcgcgagcttcagtgcggaggccagtgtcaccttagaggagctctccctattggctcttaaacgcccagaaaagtccagtttcccttccccatcctcaccgaccaacctcgcgacccatgaaaatctcgcttcgctagtgccttaaaaagagactgcaattgtatccccatgcccccaagtctgtaacagaccggtcaccctgttcatcccaggtgacatgtggccagatatgtacagatactccctcttctcctcgaggttgcaagagtctgaacttagctgtaagttctcaaatgaggctggttgctttctatgtcagtagttgctggttaccatttttgtcttcaaatttggaaatcgtggaaccggggggccctccagcattctatgattttcacaaaacgttgcctatttcagactctcaaagaatagacatacaaatcaaactgcacatagaaacaattggaaacagggtccgggcacagtggtggccccgcgggccacgctacagcaagccgcagagagagcctctggtgtgctcaagacgcctggtcttcaccctgcttccttagttccggcctgggcgcccctgggtgtttttagccaaaagcggcctagggccgatccacccaatgcattagcagacggctacaggaactgaatgaggaagtctggcctggacaccagagaaaggtggccaactctgaggaatgaagaaccaggtgtccccaagttccgcataaagggctaggcgcagagacagagacgttctctttagggtttgggtgcttgagaggctgcacccgcagcattacttaagtgtttgcataggcactcttagttctaacaaaatgcactgagaaatactatgattgtttttaaacgttttaccagggaaaatgaaaaacgaaaaatgtagggagagtccaggcgcggtggctcacgcctgtaatcctagcactttgggaggccgaggcgggcagatcacgaggtcaggagttcgagaccagcctgaccaacgtggtgaaacccctctctcctaaaaatacaaaaattagccgggcgtagtgccgagcgcctgtaatcccggttactcagcaggctgaggcaggagaatcgcttaaacccgggaagcagaggttgcagtgagcccagatagtgccactgcactccagtctggatgacagagtgagactccgtctcaaaaaaaaaaaaaaaaaaaaaaaagtagggagaacagcatttggtgtagaccccagcttcaccaattctgcacgtccagtcgtttctgttttgccaggacgacttattaattgcaacatttaccactgttcggatactagaggctggacccacaacagaaaacaggaccacgaagaaacttctgcttagaagaccagagtggggcaggagagactagatgctgctttgccctatgaggaggctggaggatgagaaaaccagggccaaggccagcggcctcggccagcctagggaacaagccagccgtggtggccctcagatactgcaggggaagagggatgaaaattgtaccggttgtttggctctgagtggacgccactcccaagaagggagctcgggattcgtcgtggccttagagtgggtatggagccgggctggccagaggaagctagctatggagcgcccccgagcagattcggaggcgacgcgcggtggctgggaggctgccctggactggggactggcttctgtgagacctgagcctggcgcctcagaggccctgtggagcacgtggagtcctcaggagcgctcgaggacaagctcagcatcccgggcggaattggggactgtatgtcccgggagaaggggagaagactctagaaactcgcccacgtgatactcgggctcatctcagagttacaatgactagagaggccttgtggggagaagacccagaaaggaaactgaggctcagaaagaggatgctctgcggaagcatgatcaagagacagcttccggaggaggccgcagaaggcagagtgaggtgatggggacgaagtgacaggcacctggagctaggaaagtagccgagaaacacacacgcgcgcgcgcgcgcacacacacacacacacacacacacactccaggccttgcttcctagagagatgagggtagcgttctaacgaatagtttgttgcttttataagcacttttctcaacctctcttttctccgctggcatgagaatgggagggcctgacgagtcttatggtagcaagcgtccaggggaacccgcaatcctagtttttgggctcccatcaagagttgccaagaaagctgttgtgagctacttggaagtcaggacagctgggcctccagcctgcagtgacaatgaggctcagactgtgaatcagggaagaggggagtgtctcgggaaaggatggctagagcagactctcccccacccccaaagggactcagggatgaaaccaggagtctggcgctctttgtatcccgctggaagtctactcgagtgggaaacgattgtctcctgcggagagatggggaatattaaaaagaagcctttggctcttttagctatatagaaacagtcctcgtcctttctaaattttctcttcagctgaaattagcaaaacaaactccacttacaccttcaatattagattcttaattttgcaaaattcctaactataacctgggccgaatatagttagaaggagtaggtattctctaaagtgagggcttctcccagaccctccccaccccactcaccatcagcaattctgtccccacccccaccttggttgatattcactacactgtcctctctgtagaatgctttctttcactttttactgagtctcccagactagtaaattctcaacttctgtgctcaaatacattaagtgttcaaagaaatagttctttaacattgtttgggatccagtggctaatgggagagtgtggagtgtgaatgggggtggtggcagaacatgggtaatcagggagaggaaagaggaacaggtcataaaaataggcagacctacttcaatgaggacagtgcatcccgctgtcatttcttaatctgaacttctgcaaactctttgaaaaaaaatgcgcctgccttccacgtttccaacctctaaattagcgaaaccagattgtcctaataagaccttttgttggaaacacatgtagtcataaaaaggtagacggaaagtcaattagacacgcgcgcacacacgcacacattcacaagccggtgctaagtgtgcacccggcgcagctggctcccgggccgcggcgggatgcaaatacaaaacagcgacgcgggaaatcgatttgtcacaaagggagaggtgtaaacgcagcgcaaaggaattgcttgcccaatctaccagccacactctctcgggaccttgccccgccaacttctcttcgccagagaaacgcccaggagagcgggaacattttctagggcgctcccaagttggaattctcatcacagtaatatcagcttctagagtctcagcttttgcaacaaccctggcgccagaaattttcttatgcagcaccatcctgggactctggggcccactggcagtctaaatttgagcttcaattatctcgttgaagaggggagccaatgaaatataaagctttaagggtagcttggaaacttttctctttagaggaggtgaaatacaggattaagtgcctcactgagtccccagagctgaatgtcaaggccagccaagaggtggtgatttcggtttattttacatgcagaagtaggggcccgggttacctccttctcttagaattttggggaaattgatagtccagtgactcctacccacttttgggtgaaggacgatttggaatttgaagtgtggggagacaggcctgtgaagtccgaaggactcactgggtctccagatcccccaactctggaatgcagtgaatacccacccccgtgtttcagagcatctctcccatgtgttagacgtcgtgcagtcctgcattttggctgagacacctaaccccggtgcactcaggtcagagcgccagggcttcaggcagacagcaatgggtcacacgggtccttatagttccttcctcttcccaggagtgtcattttagattttacaacacgagcgaataaatcatctccaaaccaacaagatgtcaccttcaggctccccactgcaaaaaaaaaaaaaaaaaaaaaaaaaaaaattcagaagcagtgatgcgtttctattccaccgacccagctttgaatgtctctcccagccaggccccttttccaagaaataacaactgtagattttcaaccacgacaatccctagaccagtctgattttttattttaaaaggcatgtttcttttacaatccctctcctacacactgtttcccgctccatccatcagcctaccacaccaccatcgcagacccctaactcctggaaaaccctccttggcggaagcactagggccctcaggtaccggattgttgcaaaggtctgtacgtgcctgtgcctgcattgcgacccccggcgcgcctccagttccaaggccgagctcactttcaacagctctggaaatatgaatgtatttttcccccctttagaagaagctatacgaggaacaactttttgaaatcgggagtgtgtttgtagagaaggagataaggattgcatttcgcttatttttctacaggtgatagaagtgttttgggggtcagagtatcctctcaaggaaaatgtaaaacgtgggggctcgcattctctatctaagcctttgtaagtttaattaacaggacccttaaagtattccttatagctacagataaaaaattacaggcaatgtttggataaggggccaactctccgtgtccaaacatttagagaactgcctgtgagtgtacaccgttgtaatcttattgggagccctttgtcgaattctgtattttactttgatgctttttgagtaccattcccattgtttgggtgtcctttaactccgtttacagcaatatattaataaagaggatgcatatgtcagcgttatgtatccacaagaatttggattcctttaaaatcaaacggcttggtgagcaggcaagcactcaaaacccaacagtctcaaacagcaataataatgtcagcaaacggctgccatgcctccttttctccaaatgctgtttattctaaaatcaataagttaggagatacattgcagagaaacagtcattagtggttcagggttggcaggtttgtttttcaggtgtagatgttcttgagtaatacctctccactgtggactaaatattagtagattgtcgttgtcatttttctaatttaatgcggcagcctcagggaagtactcatccagacaattatggggtatcgatttttaactttaagattaaaaaaataccatatttcacttgccttgggactacttttcttgataaaaatatatctgggaagatgattttagggccatgttagcgtaggggaggggaattaaggcacaaatggtggttggttaaggaaattttatgaaagaaaataaagaaaacatgtcagaataaatcaatcagaggcacaagtgagttagaggaatctgaggacaaccagcatcttggggattcttctgttcccgcggttctcagatataggaataagggtctgagttatgcccagaatacattcgtctggtactggatgtcccagtcccttagctgttccacgtaatgaagaagctctaattcccgagaactttggggcttatttttaccatcattgagtctgcccaggctcagctctcttacaaaggtataaatctgaaattcatgtattaatttgaatccccaagatccgagttatgagaaagggcaagggcaggctctactcctattttgtttactttcaccgagttactgtgaagtgattggaaactttcttaacgggcagagagagaatacacggaaactcggatgcagtaataaagttgacataggagtcggaacagggggctctttttggatctcacctttactggggcttgaggttgtggaatgggtggaagagtaattaactgaatgaagaattttaacgttgaaaacagagcccacagtatttttggttatagtggtgtggtctctgcctcggcaaagaaacaaacacccccaccccatcttcgcagttctcctctctgctgtagcgacgccaggcgctgctttccgccgggtaaattagcggcgagcctcgccagacgctttcctccttgccttctttcgccgaaagggggcgcgctcctcccaggctgcgctggtacctatcctgccttcaaaaatttctgggttcctgcaggacagacagtaacaaaacgtgggaaataatagtttgatgacacttcagggactataggaatataaggtgcacacacatgcatcttaatggaaacatgtagacacctggcaggagcattggctgcctgcctctcctcctttcaaatgagggtggtcggggttccagggtggcaggaggggagtggggccagatgaccgtggatggaattggtgggtgctaggactgacgcctgggttccatggcggaggagagggtttgtccccatggagctgtgtggacttttctgcatatgtacttgaggtcttcaaagaaagaagggcagatctgagaaatggagaagtggctggtattagtgagatgttgaaaaactgccacagaagccctcacagtgcctggagtgttaagacagaagagaaaacctggcaccatagagttttaggccctgggatcagggtaacctttcctcctcacgaaagaacaataactgccccaaatcttgtgtgagcctgcaacttgggtacctaaagccatttccaatctgcaaatctgactcctggcctccactgatcctccatttttgggcaagagtttcaagagactcacaggacagatgaggataaatttttaaccccttctgtaaatttagggattttcgacttcttaccactccctgacaatgggggtcaacaaatcaaggcacggtgagagtaacaaactggaataatatatattttgtcttcatagcatagatgatggttaatacatactttccaagataatctgagctggagtgttcactagaaacaggagcacaaggccagaactgtaaggcaaattgctttcccacaaacgtttgtctgagaataagaacattcaccccattcacttaatttctcatcatcagtcatgtcattatattttcaaggacctcacagtgctggaaagtggtgtagttataaataagcataaaaacagatgggtgatcccagtcctctaaatataatcggggatgccaaatcttttcaaagagaattcatatatacaacttaaaggccaaggagcccaactcaatcaaaatttgagccaggatatgctaagttcaatcagcttgaatatgggcaaagtgtaagacctagccagcacttcagatatatacagagaaccacattttctcaagtttccattgttattttccacacaaatttagtgttagtcttcaaagggattgttagatttggtttgggccgggagggtggtgagagtcagtgccccaggctcctgtccttgtctactcccctttctttggtactctctctgcttcagcagtttgccgaaaatctgtgttgcagagaaaattgacacctagaggccacagaggtctcctaaatgctgttttctaggatcctcagaaaacaagaggaccgctgagctcaattatatgtaatatacctggtatctttatgtatttttcttttctgctaattcattttataatagctaagttagagacttcttggagatttaggttttggggactggatatcattctgttttattttcagctaactcataaatatatgaatttgaaagttcccattgaagtaggtattcaatgtaaacttttatacctgggcattttcacatatcaccattaattcaaactgggaggtaacattaaataattatgtacattgtgactttccattttctaccagtgctgcttccctaaatactggtctagactccagcagtagtatactactgggacagttgctaaattgttgcctgtgttcagttaatgcttaccaagtgagagaatgagctctccatccttggtggaacacctttctaatctagcctaagtactagccactttaccctccccttcccatttcataccttttgcctaggagttatcttctaggcccaccattttaataaccatctatatactaaccactcccagtttacagcttcaagactctccattggagctgcaatccatatctgcagccacttatttgacatttccatttgaatatcacaaacgtgcttcgacctcaaaatcaacaaaacatggaactaacgaactttctttccccagtctgatcctcctacagctttccctgttttcctatatggtaacatgtggatgcaagacttatgcacttcagactcatccttgactctccttcctttatgtttctgttccatccatccccaaatcctatcaagtttaccttctaaaataatttgaattcatctactgtttaagtctctatcctggctcacctgcactgctgtaccaccctcctagcctgtggaaactctctgtatccatgcttgtccttaatgtgttggttacaaagactggatataatagatccctaaagaatatttgttgaatttccaaatgacaaatgctagtgtatttttctacaagtacatgtaaaaaatcatgtcatgttctttctttagaactcacaatcacttttcattctttacatcaaaattgaattatcttgattttaaaaatcactcttgatagtctaccttcccatccctgctctagcagcctgcctgatacctctctctctctctctctctgtcacacacacacacgtgtgcgcgcttgcgcacgcacgcacacacacacacacagattgtaactgttttcctattgttccctagtatgctagctaggctagtatactaactccctgtgttctagtctcctttcatgtgctctggtctcattttggcttctctgacttctgatgtgaagtgtccttgctctgtgcctcgtttttgcaaatcttcccatgctttcttccaagattctgctcccatcacacctccttgcgaaaccttctctgactactttattccagaccacacaaatctcttttctcaagacttactatgggaaataacaatcagtggctccacaagtagtgctcaattgttttctaaatattttatgattatctagatttttttaagatttagagacttttggggaaaaggtgtattctgcagtgtacaacaccgctgcagtaagcaaatttttttttttttgtacggagtacttctactgtttttgtaatccttttttttctcccctcctccccatctctgtttttgtaatctttagctgcaagtaattttgtaaattataggagtaataccaaagtgtaatacatgttcatttttgaaaatgtattattgtacatttcaaaattgaaacgggactatcaagacaccaatttttcaccagtctgagctagatacaattaatattttggtgttaaaatattttctcttacactttttacacaattggcatcatattgcattaacattcttcattattgatttttctttactcagtggaaaaagttttaaccccattttcaaagactgtgtttctctaaaattaaaaaactgtgtaagcatttaacccacttgctctgatcagaaaaattaaacaaacatgcaccacactaacaacagttctccaaggattgtgaaagctgtggcatcagttaattcccagctttctgaagttccagtgggtacattttcagcagtaaagtccttcagagtaaacagcttcttttccttttctgcttgttctagctgggaaacttccctagatatgagcacatgtcttcttttgaaatgggaaaagcctgcgtaatacctaaaggatgttcttagaccacagttagagaactactgctccaaaaatcaatttttacatgatttggtgaggaagagctcacaaaattagtcggggaaaaattttgtagcaaactagaaattttctactactcttggtccctgaatcttgaatttttaaaattaaatatcttaaggctcatgcatgctttttgaaagaaagaaggaggaaaatgatttactatataaaggtatttctttataccttttagaggtatacgtaagatagtgacatcttccaggacatgatagtgtggtttgacagaggaagaagcaattattaaaaattaaagatagtgcatttacccagacatgagcatctacagcatttcagcttttttaatgtgataatttcagggaaacaacatattttattattatgaagtctatgtaaaaatttttcccaagcaagtggagattaaaacatttgcctgatgaatacaaatattttatttagggaaagtattaacaagtgatataaaatcccgtagaacagaaattttaaattatgaatgacatatatgttaataattaatctttctcctcatgagaaagggagaagagagagagtaaacaccatttttgaaaactaaaaaccacacttgcctaataaaagtttctgaagttcccccacattgcctatttctaagagaggaaagaaagagaaccacccagagagctcttggcctataaccagatgtgctgttcaacagctctaatcctcaagatcaggggaagaccacaggctgaatcctcaacacatttaagaaataaaatataatttagttaattaatcatggaaccaaaatctgcagttttgctagccatatttcaaagactgaatcccttctgacaagggaaatagaaaataatatcactccacatttgactgttacagtctgttcttagctttcctcagggaagaaatttttcctggtatgatcgttcttactcagaatatacggactgctatttaaatttatatctcccctctcttttttttttctttacttcacattctttttttttctgggtggtgagaatatctgttttctgaactgttttgggctttttgatttggagaatcagagctaccttgaaggccaggaaatccaatctatgcagtccttgaaatataatcatttcagctgaattaatatactcagactgctggtttatttagatgacttactttgtcataaagaattaataaaattcttaatatgaaagataagttgggataaaacataaaactgcttcacaaactttaagaaaatgtgcagatgctgctatgttctataaagccaattttaagaagatagggctaattattttcattttacagataggaaaactgtggcttggagctgctctgaccccattttatttatttttcattatattgtatgatctttgatgtcaaccaaattcctctagatgcattattatctggtgaaatcatactgagttaggaatgaagagtctggcatgccatttcataacatattgccatgctgcacagacctttttaaattcctctggttcatgttcttcattataaaattggcatgtgactgctgcacctatcttcttcatgctaacacagcaggttggaaagagattgtgtttgtgaaaatatttgagaaataaagggctaaatgcatgtgagttgtcatactataagggagtgaatggcgaattttctaaattaagttgtcaagtaacaataaaaaaaacaagaatgcattttgttggatttacagcaaggtctcaaaatgtgaaatattttaaatttagatttagacacgttaggagtcttcatgtgttttatgttggattcagaaaattctgtgttaaattatggttccaccattcattaatacttgccaactgattttagacaaatctctgtgtctcaatttcctcatctataaaactggcacattaatatttatcacgcagatttgttatttggaataataaaatgatgtaagcaaaatgcctagtaccctactcaaataaatgctttattataaattgttataaatgccctttagggcaagcatttatttgagtgccttcagtgggaatggtagtagggtactgggcattttgcttacattatttccaccccacagcatctctgactagtatgacttatttcaggcatggatatatgtccactgtggcttcccaaacaatgttggaggccatttagtgccattgaaattaggaatatttgcatattccaaaagccatactcttacagcatgtcacttattgagtctatttgttttctatctacaattagaaactgatgcctcataactttcagtgatacttataccgccacaccatgagtatctggaagagccaggagtttggctcagaagttgctgactatggttatcacctttaggtcacccttcctctctcagcgtgaaacaataacacagatcattttatatttttggatggcaccaatattaaagattttacagggatttaagatgttacagtgattgaagaagacaaatcccctttcctctagtttctgaattttatagagactctatgacatatgcttgggacacaaggtgttaaggtttcttattccagacctgacatagctagtaaatttctggaggccaaccacgttaatttctctctgtcctatagtgcctctaacatagcactgccttactgctccactgagatttctgtgggtttacttaactttttgtacatgaataatgctcaccatgttaactataattatacataaagttgccattcttttgccaacttagatttcctaaaccagttgagtaagataaacattctgtcctccatttgatatgtgacctgttttcatacatattttcctttgaaatctgataagcctggaagacatacagatggcacttctatatcatgaaacatccaggactctatttttttgccaagcaatcaacaattaaatctctctggcatatgtgagcaatagatcagcatggctagcagttgtcgtacatgtggagaaaactggtcaccatgggtgaggcactttgacaagtttattgcaaggctagtgtgcttgtggtctaggaaagtagcttaacatgtgccttatgcaagagagaaggggcaggtcagccccaacatgctaagtgagtgttaggcgaagattaggagcacagctctcttggcaatagcattctgatatacggaaaagtgtttgtgtgtgtgtttgctaaaaatgctgtcaatattttatcatattgtgtaggatctctaactggggatgtagataactctgggtctctgttctttggagcacatgaagcccttcctcatctaggaagattttcttttggccgttgtttttcttcttctgtctatgtctctcccatatgtgcagttcatgtctaataatttagagaatagggataagagaaataacagattatgagattctttctctagtgtccttatactctaatcctgcatatcttcaatgtgatgcctggttcacttgcatcagaatgaactgaggtttctcaaaatgcagattccagggccccactcatacccagtgactcagaatctccaaagtatatgcatattaaatatcccagatgatttttatatcccacaaagtctgaaaacactgatccagaccactttctcccatagcaattggtattgaataatattttcctcgtgacatccactgtatcctgtgtgttccattgttatttaactctccttaagtgtcagtctcatctcttcaaaggagtacatacagctttaaagacaagggcagaggcaaacagtttaagcctcagagcacttatcatggtgctttttatattataggaggcttaacaaacggttgctgaataaacgaatatgtgaacaaacaagtgagaaagagcacacatatagcacttattaggcatctggcattttgttaagcactccacataaaaccaagaaaaacaatgtgaggcaaccatcaggggatgtcaaaattctaagtaagactaactgttttattttattttattttattttatttgagacggagtctggctctgttgcccaggctggagtgcagtggcacaatttcggctcactgcaagctccacctcccaggttcatgccattctcctgccttagcctccctagtagctgggactacaggtgcctgccaccacacctggctaattttttgtattttcagtagagacggggcttcaccgtgttagccaggatggtctcgatctcctgaccttgtgatccgcccacctcggcctcccaaagtgctgggattacaggcattttattttttgtcatatattgataaattgtggttgtacatattaaaactagttttaggtggttgttagcacttattctagaagaaaaaacatgtgtcaaagaagtggcaacttaccccatggatgatgtttgcaatttaattttagttttaagtatgtttttaaatgaaagtttatctttatcttcttttcttacaaagtccttccttactttcagacagttgataaagcacaatatttctattttgaaattttgtttacttatcttttttatggtctgataaagccaagttttaattttcccttttttctgatgctgatttttgaaaaggttgtgtacgaaatttcaacataacctatccaaatgtatcatttaaagacaactgcatttattccactagtagttttgacatatgctaaagttatatctcaaatatccccttttaaggtacgtttcagggctcttgtcctaaatggattttctattaaatatcaggctttttttttctaatgaagtatatataattatgaatcgttgtccaaaggatgtatttgttcatctgccctgaatgatagaccaatgaatgaattaaaaggaactacatttagaaaagcaggataagtatgattttagaaaacttgaaggaagaaaacaagaaagaagggcacttgtagagatgtgaaggggcagaaaacagaggtgaaagggtttcctggacccacgtctgtagtagagaccactactgagttacagttctctaagcccatctgggatcctttggtgacatgaattttgctctagtggtttatgacatcactggaaccccgttggtggaattacaacttcataattcacagttagctcttgtttattttatatttaatcatttgtggagcatactggcagcatactcaggggaactatgtggttatgctcctgcaaatcttgttgttgcataattaagtacgtcagaagtaattcaccaagtgtcataacatcccatagttcacgccttgcagatgctggcattggttatgattgtcctgaaagttatcctggctgcatcaccttctcaatgagttttccttttggaggaacagttaccaaagacagctgggcttcctggtttaaataaaatacaattttctgagtagcaagcatattgcttccatagaaagacaactccagaaccatgtaggagtgacttctataatgtgactgtaaaatgtggttctattcctgttaacccatgggtatgtaaaatgtatcaatgaaacaacaaaggcagtttttaggtgagcgaggagacttcggatttgtctccatatttatttgtgtttaaccttgagactcagaaatgattccacttaacttgtgcctttgggtctcttaatggaagaagggaactaaagggaagaaattaaggtgtattgagtaccataatggatcaggtactgtgctgggtaatgtatactaattatgttgtttaaattttcacaatagtgctgagtgatagatattgccacccccaccttaccaatagggctttgagactcagaggagttggagcaatgtgcctgaagcctcaaagttagttattgacaaaccagaacttgtcttgacccctctgttctactgtattccagtattttctaactccagtggctagaaaattggaaggaagtggttgagttcaatggtttttcagtggcatttattcagtggaacatagaactcttgtaactgtggtacctgactgtgctagaattacaaattaaaactgcagataatcctgcagaaaatgttatctttgcaaaaaaaaaaaccctcttaatagcactagacatttagatgtcagataagcagcaaatctgaagtcaattacagggctcagtgaacataaatgaagaagtgagttggaagatagtactagagaagaaacaggtgagccagagagctttcctgaaggtgaggagttgattttgaccatggtccttccaaaagtatggccttgaacatgccacccagcccttatgagctctaatcacaggaaaaatagaaatatcttcttgacaagtctattgaagattaaatcagatatttatgtaacaaccttaactcacaggtggaaccaagctcctaatttgcatcacctaatattgaattgtaaaacactgacaaaaaggggacaggttcaacatttctgattatgttctctgttgctatggaaatgaatatttatagccaagaatataatcttatttaaaagattcagacagttgtttctaatttggctgtttggaactggaaattcatttgtccaaatgcaatgttttaatttgtgattaggttcctaggaaacctccaaaagattggtggatgggtgatacagttgaactgtagtgtaaatggaagcagctagtatgttgcatcctggaagaaatagatttgtggctcagaatgaggaagaaagggatggcccttctctctttactggtataggaccaaaatttaggcaaaatttagaactagatgaatttaatctctaggcagccttctccaaaccccttctcccctgacctctaaggtctgaattcaatgttccttctgtgtgctcccatgttctcagtcacccttgatagtattatcacactgcatggcttaagaatgccagtaaggttttggtgcctcagtcacatcctgctcactcctctagagttccccgtaaggaagataaacacatagaacagtagctgaagaggaaataaggtactgaattatcatcatctaggcaaacactccataaactctgggcaccccatgcccccatctcctgggatttgttagtataacaaagttggaggcctaggtttaaatgttatgtttgtagaacagacttccatgcccatctctttttctttctctcactcatttttttttcatacatatttggcaaatgtgtcttgagtacctactatgtgccagtcattatgctaggttctgggatgcagcagtgaataaaataaacacgttgctttttctcctgaaccttatattctcctggggaaaaaaggcaataaacaaataaatgaacacacacctagataagtaattcaattgtgattagtaagttttatgaaagaaatgaaacagcctatttgagcaggaatatgaaagaaaagaaggagagctaactatgtagagagcagggtgaaaagccttccaggcagaggaagtgaacagcaagtgcaaaggccctgaggcaggaacaagctttatagccaaggaacagaaagaaggtcaatgtgactggaagatagtaagtgatgggactttgagagatgacaaagtcagagagatatgtaggggctaggtgacagggacttgtaggtcacactgaggaactgggcttatattcaaagtgtgatgacaatgggaagccagggagacattgaaaccggagagttttgtaatgtgatttatgtctttaaaagaacaacccaactgctttatggagaatggatattagaggaagaaggagaagcagttaggaggttattgcaacaggccagatgagagatgatggtgtcttgaactggctgtatgggtgaggatagagcagcagtggtcggcacccagagtgtgactcctacaggggctcaggaggctgacggagccagcggagtttagcaaatgaaagaggaaaagagaggacaatgtcaatgaggctgtgcagcctgccctggaggactgacctaggacattcatctttcttagtctcatcttttctcagtctcatcttttctctgtttctgtacctgggttttctctcaaacttccaagccttaccatggtgggctccctagaagcagctgcttccaggagaaggagtggttggttgtgtgcagtggggtatgaaataggagcaatttattttgattttgttatttgaaatgttagagtctataattcaggtactgcctttaattttcccagaaaggaagggttctgctttaaattctgcaaaagcagctctttgtaatttagcaaaacatcagaaggcagcattgctaaagactgcaattcagatatgtgaagacttgtgtaactgaaatgtcttcagaagtttttagtgtttcctaggtcttagtctcttctttttagtgtgtatgcattaatggagccaaaagtcagaaatcagttaggtcttttctccaagcaaacaatgaaacagtaaccaaaattcaggggagctaaaatcagaaaattatacccaccaccagttttttgattaacaagtatgcattgtattcagcatcatgccaagcactttggaggatattaaagaagtgaatggcatgacctcttgccaatcatccagctggcgagatggatctaaaattgtgcctcacatagttcatattcagcatgattttaacatatctgctcctggggtcatagatcctgttcctcctcttttccctatcactcaatggtccctcgtgctctcaggtggcacctgctcaaaatgttaatagcaacctcaacttcttccagtcttttattctctatgcctatttctcaggcttgtcctctcttttccaagacagacattttatctcagaaacttaatcagatcttttcttgtagtttcttacagatggaactttgtatgaccccgaagtgattccaggctatgagaattttaaacccataagaaacagctagttggaatactatcagaataaactatttgtatagatacatcttgcttttaaagatttggaatcggctgggcgggatggctcatgcctgtaatcccagcattttgggaggccaaggcaagtagatcactagaggttaggagttcaagactagcctggccaacatggtgaaacctcatctgtactaaaaatacaaaaattagctgggtgtggtggtacacgcctgtaatcccagctactcaggaggctgaggcaggagaatcacttgaatccaggaggcggaggttgcagtgagccaagatcatgccactgcattccagcctggacaacagagtgagactccatctcacacacacaaaaaaagatttggaactcagatactttaagcattctgcagtttgtagcaccatgaagaaagttaagaaatgcttcactatctcatttttctcagcatcttgagctttccaacatttttcatgattttaaaaataatttggcaaaggataagttataatcagtataaacctagagttatgccattgattaggtagaccatgcagagaagtttagtacttgaaaagaaaaactagacttcatgtaaactgaagcttggaacaagaaaggcagtcatctgacttccaaattacaatttagaacctaccagttttttaatttcttggcacaggaaatttaatcaatatttttcctgatgctgaaatattggttttggaccaaggcttatttgaggtttatctcttctttgagctttcactaatgtctttattaatgatctgaaataaggaacggagaagaaaattgggtcagagtaagccagttgacaccatttgtgactggacccattatccttgctcacctcctgacgcaggaggacaccaaggactgtgtgaggtgggtgaggccacagcctgggaagtcttgtcaaagggtgattcaagtgtgggctagcagctgactcaggaacaacccggcagtgctctgaaggctgactcgagctaggggatttgttaggccatctgcaagacacatttagagggaaaatgatttgagaatgaaagtgctgtcatccaaacttgaaagtttaaaaagtattcattttgatagatggagactaaaagattttggaatttggagtcagaaaatctagatttcaatcctgcctctatttctgccactcttggcttgtattacctacctgtaaaatgaaaacggtaatgcctgcttgatttctttctttctttctttctttttttttaatcatggagatctgaagagggcacaatgtggaggaaaagttatacatggtttgaagtctaatgaatacctctatgaagctctaatataataagagggtaacaagctgctagggattcagagggtggatttttcatatctagcaagggtatataaggacaggccttgagtgcacaaggcagcatgtgaatgcaacttgagtgtaattgattttttttttacaagtcagactattgagagttaagaacaatataaacactaaacaagcaaattcaattggacatatacctgttcattcccacaagagactgaactgaagggtgaggcttgtgaatttcattggctgtagtcaatattgcttcactctgttatagttaaaatgtagaccgtctgcctccaaggctgtcaatccggcacctttcaccagcattaagctcacttaaaaatgatttaaaacaacattacattaaaaaaaagcctgatagatccttagttaagggtacaaaaaaaaaaaaaaaacaagttgctatttacgtttcagatattttttaaaaatactgtctggtgagtggaaaatggcagctcggaaaaaatgctagcttagaggactaaaaacctaagagggcaagagcaagcagctctgtgcttcataagcgagcttttctttaaaaggagctacagcagcactggggcgtaggggaagcagaagggaaggaagagacgtggggaatagaatttcttgttccaataatcccatagttttcagcaaggtcaaaagtctgagagttgtgtagagccttggggagtgggtctaagaaaaatgtgacctgccaaggtcagcaattctgacactgattcaaattctagccttagggggtagctgtttgatgagaacagagaaggaggtggcatgaatagatgacatttcgcattggtaggagacgggcggctgcagcggcttgtgcagtcgattccatgagagatatttccagaacaaacagagtcaccttttaattgcctgcatatggatttaccacttggtgtattcttttaaaatctatagttgacacctctctctaacttgcacactccagagtttctttatttccttatcagagaatctacactttgagggttcaaaatcatttggaaatgaaacaaaaatgaggaaactatgtaatgtgggagacagaactataataacattggttgagtgccttataaatggttatgccttgcctctctccattagttagaataaacaagaattgactggacgcttctccagtcccatcccaaatgcacgtcattcaagttttcttactaattaagcatcctcccccagccccccaccctcagagtaccacaaggttaaacaaaaagcaaaatttctatgataagaagagctttttacaaaaaggtcatcttgaccatttaggatttctctctctctctcttttttttttaactttacaagtcagaatgttgtgagtgaagaacaaaataaacacgaaacaggcaatttccaaaaccccatttgtgaaggctggtttttaaacgatgagaaaatgtctgcattgcacatttacagtctgttgaaagcatatttggtgaacaagcccattggaggcatttattgaaactaaacaagaactcttggcctacaagtctccttctctagcctcttaaaggcaatctgtttggatgctcagggatgctccccaacttttgtgaattctgtcttttctttcctgccttaagctaacagtagatgacgtttgcttcgacagagcagcaggacacaagggctaagaacatggacttgatatagcgcccttctcccgtcacttaattgttctatgaagtcgccctctgagcctcactttccttttctctaaaatgaggattataatacatcctttatagggtttttgtaagcattaagtaagataatgtataggatatggttagcattgtgcctcgtgtgtagcaagtccctgcttcatggaagttattttatagcatgtgcttgattcttattttacaattgaacagacattgtggagtccgttatcactcagccataaaaactgtgtggatatatccttgaaatatttgtaaacatctggaaacaatttagtctgaggacactttaggtaactaaaaggactcattctcaaaatgaatatatagtctcaggagacaccggggtcaaagagcaagtggccaaatacttctactcaattcaaaaagctctgtggtgagaaaaaggggaaaaagaaaggagaaagagaaggaccgggaaagagaaatagctaatcatcaagaatattttgattgagaagcaatgtgttgcttactctataatttagaagtcaagcatgtaggcatacatttattcacttgctatgtgacctctaaattcattgtcatacttctcaaaagttgctattattattatttttctattaccctaaagatcttgagagatgaaataaatcctggagctcattgttgactttggacccagaaagcagtataaaataagaatgtaaggaaaactaacactccaagtacaaagtgggtccaaaaactgtaatgttatatagtgttaatatatatttctgaaactggactgtactgaggcagaaaattaaggtatctattttttttctatttttcttaaaaattgcttttatttaaccaatccatttgaaaaagtaatagaatttttaaaaatttactcttaaagatagctttgtccggtatgtttcaacagtttctaacttttaatatccttgaaaattaatttcaggtgaatgttcagggttatacagatttatgaaatttatttaccaataaaattttatgtttaaaaggtatgaatattgacttatttaaataaaaacatttaaataaacctcctatagtctgctgactatatcgtttcatagacgaaacattataagaccaaaataataaaactgctatgcttgcaaagtaaaataaatgggcatatttaacatataaaactttactatgttgtactgatttttgcacccatttaattgtgacacttgaagagtttgtctttgttctgggaactgtttacaggaaattcctgactgacatttttttcttcccatatcttaactatatacttgctaatttcagtattgaaacttatttgataattttgtgctgactcaagttcaagtgaaattcatattattctttagctatgcatcttttggtttttagttctgtgacaatataattgttatcaatatacattagaaatcaatagcatattgataatgagatgaaagattaactgagctaaacatagatatttgagactttttcttcaggaattattgatctgaagttgtatttaatctatcagaatatgctcttttctaatccattggttccccatctcagattccctaacttctttgggcagtaatagaggacctttatttttttttctgttatttcaaaaagattaataaaaatgtatgtttactctctataagcaaaagaagaacttaagatttttgacaggattgataataatttagtgagactctttctgtggagctgtgtactgttcttagaacaaagtagggactcattaaagagctgaataagtcaatgaatgaacaatattcctggctatctcaggctaaatgatatcatagtctgacaattttgaatttacttaatgcaaatgacaaaatatagttgatttagtagaaaaggttttaaatcatggaatctatgtgggaaggtagtccatggggctgcaacaattgagaacattcataaagatgtgagtggaaacaagggtgagttttgaggaagatttgtgtgtttaatctttatatgcctgtgaccagatgtctatgccaagaagcacatgtttttgtttttgttttaaactttcagtttatggttccaaggtcctgatacttatcagctttaaaaaaatcgttttcattttttaggtagttttcttgcttttgggcaccaggtggcgatatggagtgaggtggggagtgcatgggatacacaggttgggttgtcataaagaccaagcatctgtagagccgaactgatgagatttaatattccgtctctctctctctctctctctctccctctctctctctctctctctctctctctctctctgtgggtgtgtgtgtgtgcgtgtgtgtgtgtgtgtgagagggagagagatccaaaaagagaaaactttgtaaagatttggttccattttgtctgagaaagactggattggcattcctcatctgtatgaaacacttctcaacagattccatacaatatatcgcttggaaaattcaagagctgccaggtctctagctcttgctagcatttggttagcatttcactgtatataagatccttactcctcccctccccccccattttttcaacatttactgagcacctataatgtcccacgcactgtaataagtattagaaatattgcatcagataaggtctggtccgtgccccctatgagcttatagtttagcagagatagacatatgaaccctaaatcagctgcatgttatggcttctgcgatggagtcaggatcaaggcaggatatagaagggtcacaaggatgaacttgtcagctcagtgggtaaagaaaaacatcatgggagatatgaactataagctgaatagtggcagatgagtagatattcatcacttagaatagacttggagagagaagttataataatcaattttgctcctttgaacccttcaggtgtgtgtggtgcgtatgagaaagtcagttggatcttagcatttatttataataatattcataagcacaatctatagctaacattaccagcctagtttttgaatttgaaaatgtgagaaaataagtgtttggtaaaattcaacttccctgcttcctcctatatatgagaatttgtgtgataagaataattataatataaattagactttaagtattcaaatgtttttattgggtcagggcagattaaatatgtgccacctgaattatgtaccagagaggccctggaactgtgactctgggaaaggtatcagtaaaattaaatttagaagatattcagagagatggatatttcagaaaatgtaagagactacagagagaacagcaagttagctcgatgcagtctttgctgtgagcatcaaaataaggaaatgcatgaactggtcagacatagtccatcagaaaaggcttgattccaaagagaaggtactcgtggttttatctagacagacaaaaagaggcttgagaggataatgtaatgaaaagatgcttgacaaaatttagggatggataatacactaatttgtgtttttgaaagctatcgagagagcaaggtaatgtagcctttcaagtgagggccatattttattcaccactgtttttccagtgccaatcatagacctggaaaatggttgtgcaaaaggtatttgttgaatgaataaatgaaagaaataaagcagatgggttgcatgtttgcaaccaaagagtggattaaaaaatgtttattagccaaccagagagtgaaatataaagtaatgtcttttagaaactgttgatggatttaatcagatcaaacttacataaataatgagaaacagcttgcttttatagagttgccactcaaatggattctgacatccctaagaagaaatttattcccttttccttccctttccttccatttcctttcctttcctttcctttcctttcctttcctttcctttcctttcctttcctttcctttcctttccttccttcttccctccctccctctcttccttccttcctccctccctccttgcctgcctctcttcccccaccttttttagttctttttaatatttttgtttttatttcagatatattgttgtgtcaattgctttctttaatttcactctttcctcttctctctttctttcttttcccttctcttttcaccttttctcccctcctctccttcccgctttctcttctactcttatgtgttgtgacaaagatagtattgaaaataaacaaaatgaagcatagtccaaatggtttaacgtaaaggatgaaaatattaaccctgtgctctgggttgtggtcaacagagttccagcagcaagtttcagagcactatggggccttctgttagggtgaggggaagcagtgttctctaagcctgccttatcagcacatttattcaagaaatatttaatgcacagttattgtgtgcttggtactgtgttaagtgctatgaggaatacaaagctccctgtcctttaggaaacttaagaggtcatatatgggtctagaatctagactctagatatacacataaatataatatcaaatggaaagtcatgccatgagagaggagccaattccataataaagttgtttttatcctggcagaccaaaattgaagttggatctattcaggtttacatttccaggaaaaatatacatttgtattattaataacaattgtccaggatcaggaagccctttctaataactgacataaatccttatggggtaagaacccaatttattttccattgtttcaatacttttgattaaattcttaatttgaagggtttaactcaaaataacagcctacaaaattccaataaatagaattggtgagcctgtcgggatatctttccttaattcactcttgacatattttacaatgtagctaactttctagaatgtagttaagggatcaccttacattattcttaaattgttgtgtgtatttgatgaaaagttaaagctgttttttttttttaaattcaggccactagagttctactattttttaagaaccaggtctgttctagttgaatcttttttttttttttcaagataggaagtaatcatctacaacaagtattggggattaaaatgggtcaaatagagaatcttcatggaaataagtggaagaaaccccttaacgaactaacaaatcctctctctctctctctctctctctctctcacacacacacacacacacacagacacacgtgcacacgcacatgcatctctcacatttttctgcaactgagacttctagaatttttatatcatcaaaaggcttaccttctgcagaaagcccttgaccctgaggtgtcttgggaaattttaggacttggcctaatcctatatatatgccagacaaattttgacagccttattgcttttcatcatgaagtgatcctggaacttttcctaaatattcaggcatgttaacaccagcatcttgattcacttccaacccaaccttcaatttattccacttaggctagtcacagcatttttccccagtccttctgtgacccaagcaattctgggagactgcaatgtgtgctgttaatatttgtagcattctcaggagacagaagctatagaaaagctaaataccatggttttgttattactactaattacagggctctacctcaaaggaatcagggtgagaagagatgaattagcattgataaatgactcgcaaaatagaaaatgctgtagaaaggttctaaatatactataaagagtggagacagcatgcaagtgtgattagggaggtggggtcaaagagagaaacactggaatacgggtgtacttagggtcagtatgaccaaattctagtatgatgtaatttcctgcacataccaatctcagaggcaggctctcaggaaagaggatatttgatatggcagtacagcctttcttatgaagggtaccaggaaagaacaacagttgacttttttgctgggctgtgatcttccactttccctatccaccagcccccactaaaatcaataatcactgttgtaaataatttggaaatgtatgttgttagataaaacttactcagctagactcttaaaagaaaaactattagaaataagaaatttgatagtgtggatagtatgatggaagctgacaatttattatttaaaatttctttggaagttggatcgaaaagatgagaagctcagaccttgaatcagactaaatttacaagaggagacacaagatcgagggacatttattctctaagaaatctgatccgaatggggaaaatgagatgtagcggcaaggcaatgggtctgcatagtatacaactcaggcaaggtttgtgcccacaaagaaaaatggttgggagcaataattccatcttatttatacatattttattactagtttttttttcatgttttcaccacacagagattccatgaagcaaagagaggcttagttttgtaaagaactttgcaattttcctggaggaaagttgtcgccacgaaggactttattaccacatactttggtttccaggtgcaagtgagtccaaaccccaggtgcaaatatatccaaatttcagcaccataaggtttcagtttctcacttgtgttttttttatagtacctgccaacacatgaaacacggtagaaaggtttgatcaattttttaaaatgaatttaggaaaaaatagtaacttacagaaactttgaattcagagttgaaagagagcttataaatgatcaaaccaaacctattctgggagccgaaattccttctccggtattcctggcagacaggatccagccttgcttcaagattttcacacagaacagctgttttcgttgtagagtggaaatgattcttatgaaatttatatgaaaattctgtgaatgtctatgtgtatgtgcatgcaaaatttatatttccatctaggagaggcatattccctatataattgcatttgcttattcaaaagctagtcacacgggttgagaagtatgagggtacttatggggaaaataagacagaattaggatagtactttaaatctgggaaatgtgcccacagtatttaccgctgttttaagaaagcatatttatgcttttagtaccaagcagatcttcttgttgattcaggacttctgctattttacaatgaaagcagattgtaaatgaaactttactgatttccctttttccttttcctgtagtaatcaaatgctctcagccactggatctaatgagtaacagctgtgcttgaagtggccttatagataaaaattaaaagtatgataacatctaaggattttgttgtttttaaaataacggtagacttaagaattaagaggaggctaaaggcatcaatgcttctaatatgtcagtcagcctcttcatgtagtaagttggagaaactgacatagtctaacaatccgatgcattgggagatatgctgtggtgatctgaccttacttgtagttgcaaagacttgcactggaagagtctatctcctcagtgatggtggagatggtttgctaaatgtccatgaaggcctgatttgcaagatatccgatgttgttatgattaaatgcaacaaccataccccatgaactattagagacagaaggagctagagagggtgcccttccaaatctcttactggcaaaatgaggaaactgaagtgatttgcacaagatcagccagctagctgcacaactgtgactggaaactgagcccctacataatgcttattatgtcccaccaatggctttcccatagctgcattatggttgtagacactctaaacgagatgctattttaatactacatacctaaggttcaatcagttggatgtttttctctttttaccaaaacctttttagaacatatttgacactagtgtcatttgtctgttgacatacgcttggtggaaggagtaattgtccaggggtagaaaggctattcttctctgctggggatgtgtgggatcctcagtcacagttgaatagaagagagtattttcttcttcagaatcaagaccacaattttttatgtggccaggcttgagtttttgcaacttaattaaacatatcaattccaatcaattatatttcctattagttcaaacacttctccagtcaacaacaaatctgtaaagagtccctgagtgcctgccctcactctcacacacttttctttgtgtgatcagtatgaacgtgcatcttttccttcaaatatcgtgatccccatccttcttttctcttttctcttcttttcctgggtatgctttttttcccccctctctattctctgagacctttgatggaacctttattgaatgcatagcacatgcttggagcaatttaggatgacttttctaggatcatccagatgtccagtgtggagaaataaaataaaacatgcttttctctacatttcaacataaaggctttgtttggccttttagttttctctatctttagcagtagacatgtccaaagaccagtacagaaaaagagacagaagggatcagcatgtgcctcacacctgcactggtcactcattcaaggtgcaaggtaggcaggagcaaaggagagagtgacacatgaaaagtatccgggccatatggcagtaggacaagccaggcatgcttgtctaggtctatttgtaaaccctgtgggtgttatccccacactgcaagaatagtgataaatacgtcattaaccatgaccagcagagatatgtctatattagagaaaaagaggcaaccctgaatcttaacattatattttacgtcctacattgcctattctctagtgtgcggttctcagagaggaatgtgccacagtattccaatagttatgaaaagataacataaggtgcagccagcagtccagaagagatgtggtcaagatttgtcaaactatttgaagtcgtttataagtaaaaatacctcactcaatgattcttatgaattcaattttccagttaaaaaaagggcaaagaacacattttgccatttgtgctagagattaatatccctttatttacatgcaaattactttaaaaggtaggaaaacctataaaattttaaaggttccacactgggggcttacactaagagtctttgtcaaataaaatgaattctcacaaatctgctttgagctactttctttgcttctaagcacagcctctcttagaggaaggaaacagtaaagttctcacagagaaagaaaacgtttaccactcagtaaaaatccctgggcctcactgtatgaaagctttaatttagctcggctcattcctccatgagttaatttagaacaccaatgaaaggagattatttttggactgagaatctgcctggcacattttttgaacttaatagagctaaataaaactatccaaactcctgtgatttttggaggaggtcatctacaagcgatagccctgtgatagttttcatgaacatagcagaccaaacgtgaaggaacattctctaatctggagagattaggggcctcatacatgaatagagccacttcttaaatacacattaactggaaaagatatggaatgtgaacatgcatgcacacgctctccaggcaggagacagccaggagaaatggaaagcgcagaggcctaggagtaagataagccatgtctttcttagctttggctgtgctggggaactaatttccattgggaaaacagcttcatctctttgagcattagttacttttgtaaaatgggaacaatgatctcccttgaagggttataatattgcatgtgtaaaagttttataaatacataatcttccaagtgtgatatttttgttttgatttattgacttgcctgtattttctattttcttataataatacatgtaagacaagcttatcttaaagaattagagaactatatagaaaggaagataagggaaaaagtcttcattattgcatcattcagaggtttttcttctaatctttgcattattcaaaggcactttcttccaatcttttgctgaacattttcttatatagttaagaatacaccatatttgcagctggaatccttaaaaaaagatatattttatgtatctgtaaatatacatatatttatatatgcatatatatacatatacaaatatctatacacatatatagatatataaatatatacatatataaatatatatacatatatagatatataaatatatacatataaagatatataaatatgtatatataaatatgtagaaatatatctctgtataaatatatagatatacaaatatgtatatctatatatacatatataaatagatctagatctatatataaatcactgtgttcttttgtattattaaaaggcctttatataacataatttttaatactgcatattccacctccccatcatcatcatctttatctttgttagtatcatctccaagatcagtatcatcatcatttgttaaacactatgagccaaatcttatgtaagtggtttacacatattacgctattttactttattctcaagaattattcacatttgtaaatggagacaaatatagccaacaaaaacaaaaatattgaagagaaaaataatcatctgtaagctttgtgcctctgagagaaactccaggaccatttcaaaccaacttaactggcaacaaggtgacagaaacactgattattaccttgtacttttttggaaagttaaagctaaataaggctatatacttatatatgtttcttgaaagagatttcttatcattatataaccacttgagaaaaacactttttaaaaaaattaaaaactgaaaaacaaagcgtctctttatttttcggatcctaaagaatggaatcatttaaagatggggaaatgcttcagctcaatgcaaaaaggcttcttccaagaatacataggcactattcagggtttagaaagttgttttagaatcacagtagaggccttttgcgtattaaaatagactattttttttcctgaccatttagccttgcaaagcagctgagaggagtaacaccgtattatttcttcagctttcagatatctatctagtaatttccattttcatccacagaacacattcagagcagaattggcgtaaagttgttgctgatttgatttggccaatgattcttaagaaatgacggtggcacaactgtcacatctttctgccaaaaccttgtcagtccagcagtctccactagatgaggtgaagggagacgagggctggagataggagagtcagtcctgagaggggaggagggtggctaaggaagtgtcaagggggtctctggagaaggggccccgggctattagctagctgtctaatcctcccctcagcaaggccttttggctgccaagactgttatcctgtgtgcagtgttgatggtctgtgatcctttgtcagagtaattgacggtgaagtctgcacttttgcagctaatgataaatagggcttttaaaggttgtaatttcttgtttaactgatgccagttgcaaatactttgtgctgaggaataattcctctctgccaaataaaatacagtggaagtctgtggtgtgtttttcagcttattgttagtcacagctttcctgacagagcactttctatgcaggagataaatgctcaggccgtccggctgccaatttcagcacataaaggacttttctgtggaaaagacttttctgtttctctagtgaacattaataaggatttttatttattttactttttattttattattttacaaaaccctttcagaggggcaaatgtttacttccttggaatgagaattatttgagtttttaaatgggtctcatttctttctctgtcccattcatgagctctagtttgcacacagctcctctagataaatggcaagaagatggctctctagtctgttcacagaaaactgtattatgggcaatgggattggggaaaggcttccccaagggtctgtgcaccacaagactgaagggaaaattatagtaaaaggggccagaggatggcaaaaatgagagaaatcaggttcctatgggctcaaagaaagattggcttgcttggatgtaaactgagattcatacctttcacaatgaaacaaagcaacacaaaagtgcaccgagaaataccagtgtgcctcaaaagtgcaagtgaatggatttgagaaggagtctcgctctgtcacctaggctggagtgtggtggcgtgatctaggctcactgcaacctccccctcctgggttcaagtgattcccctgcctcagcctgccaagtagctgggattacagacgcctgccaccacgctcgggtaatttctgtatttttagtagagatggggcgaggctggtcttgaactcctgacctcaggtgatctgccagcctcaacctctcaaagtactggaattacaagtgtgagccactgagcccagccaagcggatggatttcaagggttttcatatatatgcttataatcatatttaaatgtattgatggggttacaaacttaaaaatgtcctatggcctcctatggccattttttttaagcaaatgaaacaccatattcaattttatgcatttggaagttatttttttgtgtgaatgagttggttcaagccaaattcattcataggaaataattcctgagcccaggaagtccagtaggtctcaggtgaaatgttggcaggtggaggtgtttctagctagtatagaaccgctgatgagtgtgttactgcaggttctactatagggtggagaacctttaggatatatattcagaccatttggaaagtccgtcagagctcttccatacattaaaaaatgacatgtccttgtgtcttgaattcctgctttacttatctagtaatttagatacacgtgtgtgtcatagattgaaagaaagatgaccaggagaattgaaaacagacctatacaggggagaaagtgggagatgatggacagagatattgtggtcaaagtttagcagtcagagaggccttgagcatcctatccattaaaagtagcagacaggctgtattattagtactgtccttctgaatctgtaaagcattaatgtttgtctcatgcccagccaaaaccaaactccaagttaccaggatgctacctggagacaaaactgcccttatcacccactttgctgctgaaaacccgttactgactgtcctaccctggaggatgcagttcaaagagtcttagcatgttgggaaaggtcctctaccatctggccctactttcccactacggcttcatcttctcttcttaaagctcccaaatgctgggctgagacaacatagggaaatcatgatcatatcacttaccagcactgcattcctgagaagtctatttttctgaactcttgaaattaggacagtgacatagtttttcatagggctgttatgaggaataaatgaggtaaaaatccacttttaggaatgagtaatactgcctttatcaccctgctctgtccattacaaacagtatttttccactggtcaaaatgtgtatttttccatcaaaatctagtgcaattagttcctcttctttatgactcatctattatctcatctattaagttacagttgatccttcctttgcatcacagctttacaatatatatcctccattatcttacataactcatttttgaagttacttgcttatatatctgtttttcttcactaaattttgagctccttgtgggaaagattgacctttcatacttaccagccagtactcatcaccagtagtaagcatatattacattaaatagaaagaaaacacaacataggaactctgaattgtgatttgtcattgcaacttaatttgaattccatggtttaaaggctcatataatccttgggcatgaaatcagtttaacttgtgggcatctgatcattccatttctactcaggccaaatgttttgcttgttttgttcaagaattacaaatttagagtttatgaaattttatttccaaaaactattaagaagtagaagaatttttttaaggaaagattttattcgaaagggttattgcaacagggagaatgcttcaactacaagttttacaaatgtcctaaagtcagacagaaaatatattttattatattattatttttaattgacacattgtaattgtacttgtttatacagtacagcatgatattctgatacatgcatgcaatgtcatgatcaaatcagagtaattattaatagcatatccatcatctgaaacatttatctttttttgtgttgggaacactcaaaatcctcttttctatttgaagatatacataaattattttatagtcacccgatagcactatagaacaacagtccccaacctttttgacaccagggaccggtttcatggaagtcaatttttccatggatgggggaaggcggggggagggggcgagaatggttttggaatgaaacttcctcctcggctcatcaggcattaatttaaattatcataaggaacctgcaacctagatcccgcgcatgcgcagttcacaatagggtttctactcgtataagaatctaatgctaccgctgatttgacaggaggcggagctcaggcagtaatgctcactcacctgcctcacacctcctgctgtgtggccctgttcctatcaggccacggactgttaccggtccatggctctgggggttggagactagaacactagttggaactagaacactagaattactcctcttatctagctgtaattttgtatctgttattaaccaacctctccctgtcctcccctcccctcaccctttcaagcctctaataaccacaattgtactctctacttggaagaacttttaagaagtgggtttgtcggactcctccctatggagttggcagtgctgtacaatgggtgtgtgtgcaggcaaagcagatccatatctctgttaacaaatgtaatttataacaagtaaaaagagaactattcaacttaatttctttagagtgagggtaactagttcccaggattgaggcttttacccgtgttcatgtaagaacgtatcacatgttttccattcttctatcacatgagcaccctctaaagggtaaacgctcaaatttaaaattttagttttatggtacttaaggcaaaaagacaatataatgtgggtctcccataaatggcaatagcagagtgtttttaaaacttggaaagtgttttttaaaacccagaaagctaggttgcagcatttcaataatttacgatgttgggtgaaatggatgggtagatctatgcaattatcttgctctcattggcttcgtgcataattagattaatgctcccactattctgagagggatttataaccatttgatcaagagaagaacagaaatatcttgcaggctggaacttcagtttgcaaagccaaatcaaatgctcagaggcatttctttgaagaaaacatctcttatgaaaatcatagaattgcaatccaatcatatcaagaagtttatctgtctatctaatttaatttctgggttaaaattatacccaatacactgccacgaattcctatccatttcttaaaagttcttccacttcttaatagtttataggaagaaaattttataacctctgaattctttcaggatcattggttctacgaatgtcaagtgtttcagaacttgggctctgtagccaaactaccagatgtcgtccattgtgtgccctgggcctggatgatcagctccctgagccttggtctcctcatctgcaagacctcctagtgtagtgaaatacaaaatggtccatgcagagcacttaacagaggttcttagcaagtagttagtacttaataattgtttgttattcagaaatatttattaagtacttacttggtaaatcatattgacttgacattacattagttcctggaaagtatatagcaaaagtacaaaatattgtctctgtcttcacagagtttataataataatacattatataatagtgttttttttttaagtcatcttacttgaacctcacaacaactctttaaagcatttaggacactttccattggtattttacattttatttcagaacttgggctctgtagccaaactaccagatatcagctgcatgccctgggctcaggcaagatgagtgagtttgctgaaagacagtgagtgacaggtctggctctcaaggctctgtcttctaattaatgtcatttccagtccatgtcagctcttccccctgaatacgtagttgagaccaaaatacatagaaaacaaagaagacatcatgaaaatatacagccatgtcctaaattgtgtgaatcgagcactagctcagagttaaggaaggagaataattaatgtggcctagagtactgggaaaagcaaagcaaaaataaaaattttaattaaaggtaaaactaatcaacttacccactgaccatttttattctgaaatataactaaacattgatttccccaagtgttaaactagataaatataactttgcttagttttgttaaaatttattaaattaacactttttaaaattaaaattgtattgtgtccttttgttatactataaacacatttagaatataaatgaaataacataagtaagtgaggtgttttatgatctttgaaagaaaggcctatataaacgcaacctctcaacgctgggaagttatgaacacaattaagttgctctctcatggaattctgttctttccaactacactgagaataaagtgggggacatagatttctacttatttttctaaagttcaagaatctctaagctgtggttaacttttggcatgagaccacaaaaaacacactccaaatattcatcatattcataggttaagtagggtacacaagatgtaattgatttattggccattggtcactgcagtcatcgtataggcctgaatgcaaacttgccttctcagctgtattgtgttcttaaaggaaccttgagaagcaagatagactttggaaagttggtgtcatacatctttcctgtttcctgtccttagcctccacaaatgatgatcttggagaaactcaacttcatgagagtctttgttggaacaaataaaatggtaaatagattttccccaacagatctgcacctggtgtgtaatagactatacccaaaacatttccaaatcttcaatattagtctttcacactcagtctggagaataaatttttcttctggattctctccttttggaaggggcatcatcttgggatcaaactaacaggcctagattctgttgttactggatgctttgtgccattatttttccagccctgacaagaaactgctcttctagagggacccataaaacttacctagtggctttggtctgaactttgaaatgtacactgcaaagagttccaaaggcacacatgttatttgggtcctagtggaatggtctcaatatataaactctcacaatgtaatgggagaacatccttagtgattcaccttaaatgtaccccattctttttttttgtcaccactttgccactttcctgctccatgtctgcattacgtagcaatttaagacctcatttatatagctcatggttgtgtcaaccagcataatctggcaattcacttcactaggaaccttacatcctctgccttggtttatttaaattttagacattatatatacatatttttggcaggttctcactctgttgcccaggctggagtgcagtggcacaatcatggcctcagtgcagcctcaaccacctgggctcaggtgatcctcccacctcagcctcccaggtagctgggactacaggagcatgctaccacacccagctaatttttgttatttttgtagagacagggtttcgcaatgttgctcaggctggtctcaaactcccaggctcaagtgatttacccgccctggcatcccaaagtgctggaattacaggtgtaagccacctctcctggccctgaaatatctatttaaaatatatattttttgtttactgctaagttcagcaggcagtgatatcatgtgacctattgtctgggagctcctaccagaaactactatgtcaaagtgagctagcagatacagttagtactgtactaggtaatgacagtaagtctcagcagttttagtgggctacgtagagaactcaaacaagtaaaacttttgcattgcaagaagttgttccttctcatgtgagcaattgaatctgcttctagttctcatgtttctagcactgctgttaccagttcaattttgggttctctgggctaagtcacacatatacccacatagacacacacacacacacacacacacacacacacacacacacacacacaaacattttatgagaaattatgccccccacccttaaatgttagattttttaaaaactctggaactttataaatagtttttcaacagttttctttggtctcttgttaagtatttgaatacctgctaaatctgaacattatctttaaaagttatctaaaagaaaataagcattcatgcaatgttgaaataaccctgatatctgcaaatatcattactagtgttatttaaaaatagtcaaagacattgcagatttgaccacaggaatgtatatccatggaattacacagtgtctagttaatccattgttaaatttatagattccaaaaatggaggtaattagcaattaagtatattattctttactatatacctctttgaaggcacagatgtatctattggtcaagtacttgaagaggagtttgtaatttaaaattagaaagagttattaaaaacaatttaatactatgccctttttcaacagcaacagtaatagaaacctagattggcaaagttacattctcaagatcacatgacttttttgggccagagacagagaactcatgttgtctggcttctgatccactgacgttcccccgtaccccattatataaagttgacttctcatacatttctatgaaaaaactttactaacattgaattgctgaaaatgtgggaaagagtataaagttataattgtataaatttggtctggggctatgattaattagagacaagttttgatataaaaaatgggttctctcaggtcaagaagttacctatattcgtatcacttggtgaccacctacacttcatggccagaaaagcttagtgccatttggtcttgggaagacctgagactggtgctcaaaccagaagtctcagcagggcacagtggctcacacctgtaatctcaacactttgggaggctgaggcaggaggattgcatgagaccaggagttcaagactagtcttggcaacatagtgagaccccaaacctagcaaaaaaaagactgctgggcatggtggtgtgcaactgcagtcccagctactggggaggctgaggcaggaggatcacttgagcccagtaaatgaggttggagtgagctgtgattatgccaccgtaccccagcctgggtgacagagtgagaccctgtccttaaaaaaaggaaaaagaaaaagaaaaaaaaaatacctggatgtctctaggaaagaaaattgtaataatccttctagtcaagaagctttctcctcaaactaacagatctgtagtaaaggaataagtttaatgatatcatcagggaaagtatgaccactacaactaaaaagccctagtatggaaataaccaaatagaacaaagtgaaggagcccagcaggggtctgcagaacacagctgaatagcaagaaaggaaaatatttccttttaactctcttgttggccagataaaaaaaaaaattaaaatgtagcttagaatgtccccacctttgcccaaatcagttaccatgcacacatcttctttaattgatttaatgcaaacactgtgtttataaaatctgattttctcaaatcctttcttccatctactcatccaaccagtatatgttttctataagaatctcctgagtctatgaaattttcatgtttattcctaggatgctttattttaaaggtgctgacttctgagtaaattaaccacataattataccctgtgccattttaatcaaatagattaaagaaaagaaataagaaggcttgtcaatgaaacttttaccaattgttggaaatgctcttgcagtggaattaaacactagtatatccagtttgtccttgttcttggttcaacatattactatcaaagtcctttttcaaagtaatttaaaaattggaaaatttttagaaatagggaaaacctgaaaaaagacccaaggttatatgaggaaatatatctgtaattgtcatgtaagtcatattggaaacagatgccaaggaagagaatgacccagatggtgattaaagagtcattgtccttccttaaccttgattatcttccttttctggttatcattttatgtttaatcaatacaactttttcttaggtctttccttcatcctactttcttcctgttatgagttgagcagtgtaaattcttcttgccagatttcagatgatgaggatttggaagtgctggtcacgacatgagtcacagtgacacacagattactcatagatttccactccaggcagacagaatgactattaacaaggacttctttagggctgttcaacaacaggggacatgattcaatggaataagattattccacatgaatttttgggtgttttacccaaatgtaacttttttttttctcatatgaccttagtgcatcggcttccttactagttaaaacagtcgcatatccttggagaggaaatcaccatataattaaggcttaggtgtggttgacaggccgtaatgttcctgtatattggagaatgaattagccaggcttttgcccaagctcctttgccagagaaagggaacagaaaacacggtgactggaaatgactaactagaagaaaatacaacctcaagctaaatatgttttttggaacatagaaataactgtatcaggtcaagccttttgagacttcctttgtcttttctaggagcaagatggtcaataattccatatgtatcatcattatcaaagtcaaacatttactgagcactactaaaaggtttagggctctattctacacactttgttcacctgccttcaaggcttactttctaatcagaataattactgctgcaaagtcattcactgagaaagtgcatgagaaacctgcataacacttgatcctggaatttacatgccttacaaaaatgcagtaagcaggaaattttgtgtgtcaagaccttattacagaaactgatccctgaaagagtggtcaggtttggtggctgagtgtgaatggaccaggttgttcagagtaggcactttcaccaagcagagtctaacatattaatttaataattctaagagaagtacccaaaatatggaagactaatgtcaggtgccgggatagcacagttaacaagtcaggtaaggtgcctaccctcatgaagctatattctagtgtgagacaatcaacataaataattacagactgtcataagtgttataaagcaaatggttaagatgctggatgaagaatagtgagaagactacttctggttgttgatcacagaaggttcctacaaagaactgacaggtcagctgagacttaggaaaggagaaggggccattaatgtaaaagttagtaggtatgggtaaggtctgtgatgtgttattaggcaaagaaagacaaggtcagagaaaagtataaatgaaaaggacaagaaaattatgtttttatcaccattagcagtacaactagagtggagtgattgggtgagaaataatagatcagctgagaaaaggatgctaagcttcaggtatgacaaagagaggcccatgcagtgttttctaaccttgcactctctttggtatatctgtcctccttcctggcccgttcctggctctgatggtcaccaagtgtactggaatattttttttttctactattactttacttgtcaagtgcttttgacttctttctccagatcagttagaaagtaagtatcttgaagtgcagacaacatacaacatttctctctactcagagcatctcatcgcttggcatgtaggtgctcaatagatatttgttcaaatgaatgaataaagtgatagggaggatgctaaagtcaagattgaatgtaaccattgttagtggcatccattttgggattaccctaaaatggttgatataggcagtgtttgcagcaaggctgacgccacttgactcatggttaagaggtcaaggatggcagagaaatgaagtatgtagctattcttatttccttttagtaaatttagaagatagaataactctttatagttattctaaaaaacatcttaggtttcttctttctctagactgtggttagaggtaaactaatgtcttctaaagattcacattgatttcagtctggagtttatccctgcagagtgctgtgggcatggaggaatatgtcaatcattgaagctttcctcaggcctggtaattacattacagcccttatgcaagataaaatccagcctaactttttctcaaaaaagtaaaaaaacacaccaccaacaccatcaccaccaaaagaatataattcagtcatcatgctaaatgagcaattattgaaagttttttattaggctaggcattggaagtgtaaaaactatcctataactccacaatgctgaatttgaaacagatcttagtcccatagcccaacttacaattatgccagttaggacacttgagggctaacatcacaggctttcccagtaactcccctgaattagaatcaaagtctccttatttccaatccaaagccatttccactattgctccataatacatattttacaataaaatataaggaaatgtgtacagctagttgtcacaatttgtatcatttaaaaatatatgtatcacttgtatcttaaagcagttgtcatggactgaatgtttacatcctccccaaattcatatattgaatccgtaacccccagtgtgacactatttggaagtaagacctttgaaaggtaataaggtttagatgaggtcacatgagtgagtcctcatgatggaattagtgtctttataagaagagaccaggaagcttgctctcttttgctctctctgccatatgaggatatagtaagaaggcagttgtttgcaggccaggaagcaggccctcaacaggaacccatataggccagcccctcttcctgaggcttccagcctctgaaacatatttctgttgtctaaactacccagtctatagtattttgttttggcagcctgagctgactaagccaacaacccattttacagatacagaaattgaaagcttcagatgttaaagaatggtattttcctcaaaaaagtcaagctttaagccactatttacacttcgacttttcttattttttaaacaaaatttgaatttttgttctttaaagagaattttatttcatctaaaaagtatttaaaaatatcaagcttcttattttgaccattttagcatgttttcatcttcagatttatttgacatccaagaccagagtaacaccaagaagaactttgatatccttttcagccctcttcatttattctatatagtgttacagaattacctttggttctatctcttactgtgatggaaagctaattctctgttattgtggctttctctgctataagcaccttgtccttttaacacaagataaaaaattataagaaaattcaagtcatacttttgttctcataagttcaaatgccttgtagctgtctttctatctaagcagagaagctctgctccatcactcctgtccttctaagagctgagcttactcattaactatgtacatctccttcattcctgtctgcttccagtcttggttttttagaacctgtgcttaccagatttttctttagaacattaaaaattataaccaaaaagataaggaatcattgaaaaaggtgacatatgatgcttgcctctcatgaaaacactagtttctactggtaatggcaagattgatgttgtctcttttatgaagtgacagcagtctcagtgcaaagggaaaaaaacctcagcagaagaagacaagaggatatgcctcatcctcagctctgtttgtaatcctagtcaaattcctagtcaaataccaggcacttccaaggggaccacacatctggattattgcaagtttagaaagcttctaatatctcagtcagaactcactcttttcccagaactttggtttcttcttatccttttggaatttaccaaaataatcagacatttctttttaaaagagtcactgaataaatagtgagtaatatgactcaactgttgtgtttttaggcatatggcaaccaaattagttaaccaaaagcaaataggctgggaaataattgaattttcataacctgtctttagctcttggctttcttttctttcctgtctttttttctgaagctaatttctagtgagactacttgttaaaggtaccaattgcttatccgtctgagtactagaatctatttgctttctagattttttttccaaaatttgaatttaagaaggcaagttggctttttagaaagccaagaattgaataatagcaaaaaaatgccccaaatggaacttttggggcaaacacctgtgcatgatatatatccttgtgcaattttgagtctaccctatatctcagttcttgctgaattttaaagcttttattcatttttccagtttcctagttctgttatgctctccatcaaacatgaccgagccatataaacgtatttgaatggctttctcactttctctccagttattttgtgatagaaatcttactgaacagctaaataacaacaaagagtgagcagaagagtaaaggtacagcagcaatggcttgaccagcccatttttgagaacacattatggtagcactggtagaagtaaaatccacctcttgtcaaatgcctactatgtgtcagcctatgtgccttttatgcatttattaaattttcaaatgaccccaggatgcaggtgatcctactcccattttatcattttggaaactgaggctcagacaagtgaaacatcttatccaaggccacacagctagtcagtggcaggatctgtatgagaacaaaggttgttcttatttctaagctggtttactttctactccactccacttccaactatgcttccatcccaattatagctagttgggtctgacaaaaagattcttattttccccttttttggcatcctgcaatgaattgaaaaaatgagtaaactggtaattcatccatagaaaaattggaggtagcttacatatctgaagccagaatttcatgtctttatcaaagagagggtactctgttcaataatgcatctcttacagtaagaattctaacatattcatgaatacattattgttattcgtattagtaaattatggattcaggaatacattagtattattattagtagtagtatttcatgtctgattattcacttactgaacattgataagagcttcaattaaatacaaacacaaatgttgtgctctggagttatagcctaaaacagattcatcatcacacggaaaatgcccacataatgcggtggggtggggagatttatcaacatagcctcagaagtaagtacagttccaatatgggactacatggaaaaccttgctttgtgttggatattctcaggggttctgatcaataatcctttaaggaaaatgtcttaagagagttaaagcgcttaaggtgatatggattgtgttaacatttttggcgctatagaaaagtatttgttctatagaggtgaaaagaaatatataacaaagaagctaaaaacagtgcaaatcaccttagagtacctcacattcttgagtgttttctacttgaaaggagggttggctatattgagaaagttaaattttgagctatctacacagaaccactgttgctttacacagagccactgactcatctctttgatcaaaaccatgcaaaataatgtaatttcacacttcttagagcattttgttctccagagaacatatgtcatttcccaaatcacatataagatgttttaattctatttgctaaggcttagtctgatacttgactaaaaatgaaccaagtctataccaagatgacagtaaagacgaccatacaaagtttaggggctttagtgggctatagttcaggtagctgtgctgtgataatgcgcaatagctgcacagttgggtatttgtattggcagagatttgttcgctcttgatacgtgctgggagtcaatgatggaggaccgctgaagggctatgctgttgagacgatgtgtgtgtgctgctaaacttggctttggtcattgtgatgcactaagctcagtctatattgcaacaatcttcccagttaagtgacccatgtgccatttatcaggacacatattagaaagatgctgtcctaatttcagttaatgctaagtgtagccaaagaaactcaaatgaatgccacagctctatttcactgcttttcatgggccttgcaataaaagctaaacggtttttagtggcttttgcaattacacttcctttcaattttccaaaggttacggggcctgaaccacacaaatcccattaaagtaagtagctgttgtgcaatataagttcctttgaaaacattgttcaatgcccataaaatgatcagcgggctgcactttagatccgcttgcctgccatgctttcaaccaaaaggcagatgacaaactttgatgtggtagttggtttctgctactggagctggcattttatcttcttgcatcagattttttcccaaactgatgtgacccaggcataggaaacgcatttttcttcagattttattcctaaaatatgtttttccgtacctttaaattacgtttggctgaccaatgatttggaatctctaaggttcctcccacaggatgcagagcagaagagggtgaggggtgttggagttagctgaagcttgcatggcaagagcaaggccttagtgaatagggatcaccacatgctgtcaggtccccatgcttgaggatggcactttatgccttcttctccaccttccctctagggcaacttcagcagccacatgaggagtccagagtgaacttcatactagagccgaggtcagggctattgttctctttaactcatatttgaatgcacagagggtagcctaccttgggcttacagtcttcttttctcaagaagttcttcatatgtattctaacattgtgatccattagaaacacccatctcttttagtacctctttcttgtgtattttcttggtggtttaagtaattcatgtatcctgcagccgcttttctagtaaaagataaaaatgaaagaataattcctacatttgcagaggaatcagaccacaaggctttttccctctctaaatctggtgactatcctatctgataaagaaacactgcaaaagaatttttcctctgtgggtaaaactatccagagacaaaagacaatgctaacataattacttgctatgtattgttaaaaagaattcagaaattactcagtcctttaaaactttaaataaatcactaaaattctaatattgtgggactgcttctataccatgacattactataactctttcaacttttactgtaatgtaatatgtcaaggaatcctatctcttttctatagaaatacctgaatacattaaggtgacaaaatatttacagagaaaatattgaaccataatttttaaaaagtatttgataatatactaatatatgtatataaatttagagcctgagaaatcaatatgaattggtgctatcagaaaaggtttatagagaaggtaagatttgagatgtgttttaggaacagagagattttaaactgtgtcctaaagtgaaaatcatctcctatgattgtgggagaagatagaagatggggcatactactaagctaaaataaccctgcacttatttaattgatgaagcaaggacttatggatatcattgtaaagaagaatgcaagaacatctggatcaaaatggctttctagatgagaatggttgcattttttaatggctattctggtagaaaggacaacatgtgatattcatcgaccctctttctcagaccctctttataacagctagtatggaaaaatctgtctttcctataaatattttccctggggaatggtttccatttatgtgttggatgctttgttgtttctctcttgcacagcgtgtatgttgtcatctgcacttaagagtggaatggaattgggaatcctggtttcttgctctggctggaggtcccaagtccgcattgtgattttgggcaagtcacgttgttcttctagatctaatttaactcatctgtaaaataagatggttgaattcgacaatttcatgggtttcattagatgccaatattttatgactcatgatcccagcaagactacacctatttataaggctgttttgcttgtttttactaagagcaacaataactacatattttcagtttactcaatcatcaaaaaaattataaaatccataaacactttggatttgaaacattgcaactttgataaaaaatgtatccatgtaggccaggagcagtggctcacgcctgtaatcccagcactttgggaggccgaggcaggtggatcacgaggtcaggagatcgagaccatcccggctaacacggtgaaacctcgtttctactaaaaatacaaaaaattagctgggcgtggtggcaggtgcctgtagtcccagctactcgggaggctgaggcaggagaatggtgtgaacccaggaggcggaggttgcggtgagccaagatcgcgccactgcactccagcctgggcgacagagcgagactccatctcaaaaaaaaaaaaaaaaatgtattcatgtttccgctggttattctacaacttggtgaatccttcccattttagaatgccaaagaatgagatgcattctaatatccagttggatgtcagtatcttcagacagcatgtttcaaaatcaactttcactgtagttgtttttgcaagaaaagatgaccctcttggaattagtaaaaatacactgctttctctcccctgtattcaaccagagccaagaatctgataaatgtgtttatcacaggtccttcagataccctgcatttgtaaacctctacagtgtttatgtttccttttgtactgctgaagatactgtgctgggtcctgttctgcattcttggggaaaaacagggagctcacattttgtgattagtgagcaaagacagaccatccccaggactgctgctcgagctgtctctgttgcccgctcatcgtctctttctattatacttgcactctgaaggacatttgccagagccagactccctggatccctgttatttgtgtcttttctcaccttcaacatgatctgaactagtgttttcatttgttaaaaacaacaagaacattcactgggaaacttttgctggaattgcttcaggtcatcatagctatttattccctgtcataaactataattctccatttcccttactcccacatcaggggagttggtggtttatggtagacagtcagtggaatttgattgaacagtggaatatttcaaagaactactgagattatgtagcaggttgtaatactaagaacaaaacataaaatattcttggtcttgattgcagttggcagtacaagaagaaataggcttttgaaacaacataaaagatttataatttgtggttgcacctaagaaagaattttctttgagagaagaaaacaagtcatgggattggcttaataggggattttctctatatgattaaaaataatggcttagtgtctaattggtctcagttaaaacaaagtacagaagctaaggatttttcttttttttttttgcagacttctgttttgggggcatgaaattcagataattgtgctatcacaagggcttgtattacttagaaagacctgaagtacgagacaaaatgatttggaaaaatgaataggaatgggaggaatgcttccaaatattaaataggaaggagaatgcaagtgcaatgtaactactgaaaggtatttaatcctaggtgtttgaattctagtgctgatcttattgcaaactaattttgctaatagctagtggtataatcagtgatgttggttggaatattttaggcattggtagatctcaaaaattattattaaatttgctccatttccaagatgcagctgatcttacattcttactgagtgtcacagaagtgccaccaaagctgggccctgaggtaaggcaccacaagtgtaaaataccaaagagaaggttgactgtacaaaaccatgaagcagagagaaaggtatggtagcttcttggctggaggaatctggttgagatcatctgacatttttttctacagaaacagtcttctaaggacaagaggagtttcacgttttccctgaaaacaaactcagcaagcatttactatatctgggtgctttaattatcaagaagaaatgtgcagtctctattctaagcttcaagggtattcctggtaaggaagcattgatgaagaaggattctcttagcaaaagacttagaggcctcagttgtcaggcctctggatttaagctacattttgactctgtacacaaatctagatcattccctcaatttgtaataaaaacaatattatagctgaggtaggtgtcatcatgacttgtgctaatagttttgctgagtacattgtgtgtttataatcagagagaatcaggagaatttgcatattagaagagagagccaaaagtactttctaaatagtgaatggccaagctctccttgttctccccatcctcactccaacacttcataattttctttgggctgagcctctttggggaaaagctatggggaatgtaagtcaagttcattagatggagcatgtgacttgggttttggcagcatggtgttgcaaatctctgggacctacacaggctctgcagagctcaggccttagggtgatagtttgattgaggtgtcagcacagctggtattccattcagtttcacatatacatcactcctgactgggctgggtgggggcagcaggagaggagcatactacactctgactgctatggacaacctggacaattatctcaccacgctaccttcaggggaactcagagaaaaccaaggaaggatcttgacaggtaaaaatggagttgtgattcttcaaaggtccctaagatctcagggtcctagaactcaagtttgagtgaaacattttcagggatctttctgaactgtttcctgttcttgggttctcagggagtgagccccaggctaatgttagcttgggttgatggcattgtagcactagtcctgatctaggctgaggcctctgaagcctgcctttgcaacagcatggagccttgagtgaatggtgttagaaattacttgctgcttcaaggagagttcatggtaaaacaaatccctgtaatgtggtttgaacatagtttcctctctataactctatgtatttgttcatgtatatatgttaggagagaaggaaccaggagataattggtctacttgattattaaactatatgagtgagcataatattgtcaaagacaaataaggtacaaaaccatttactcttcttcctttatctctagagaagtccaaagaacatgggcaggggtaagattttccttgacaaacaggcatcaaggatcatgcaagtaatgtctctctgacagttcagatcttgtcccagatttagaggcaacagccaagcattagagttgctgggattcttgacatatgaacttgagagcgctaatggccacatttgcacatgcaaagtggcatttggctataggactttgataaagatgtgagcaaatgaagcaagatctcactatagatataccataaaaaagtcttaactgggactcctacagtgaatttggcttcttttcatcattgtgttctattccagatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggtaactcaagctgtgagaggctggcaccaagtagtaccctcctcagaggcacatctctgaaaactgtttaaaaacacaaattatagcccagcacagtggctcatgcctgcaatctcagcacgttgggaggttgaggcaggcacattgcttgagctcaggagttcgaaaccagcctgggcaacatagtgagacctcatctctaccaaaaatacaaaataaataaataaacagccaggcatgatgctgcgtgcctgtggtcccagcttcttggaaggctgaggtgggagaattgcttgagcctggggggtggaggttgcagtgagctgagatcacgccactgcaccccagcctgggtgacagagtgagaccctgactcaaaaataaataaacaaacaaacaaataaataatacccaagttataggcttcagatgggagctggtacttataagggttacatatggtcagcatgaggatagaatcctgtttccagctgtgtttctttgggcagcaagtatttttttaaataaaattgaatgccttcaggtagggcagaataatccttgctacaggttcctctcccagcacccctttctttctgacacttccagatttatgtgatatacattgtccatctgagtattttactctgcacccttagatttcaatctgatctcgaagtggttaaagagatgaattctctgtcccctacctcagctctcctccccagtcttcaagaaacttgttgtaagtacacatgagtatgagcactgatggagtgggaaatgaatacttatgaactgagttaagagcacacttaagtggatgattttattttccttcagtgtctctgtgaactgaaagaaggtaagagcatgaaaggcaggaaaaagagaatagccattctttctaacattagtgccatgacacaccaactgcaagccagacatctagaacatgatacaacctgcgattaactcataacaatacgtaatactaacactactggagcccttatatgccaagtagtgttctttacataagtaatttatttcatcctcacaccaattcagtgatgtggatagtgttcttcattttgcagatgagaaaactgagacacagagaggtcaaagtattttgcacaacatcacatagctaggaagtgtctgaaataggatttgaatgcagataggcagatccagagttcatgcttttaattaccactccccaccccgcctcccaaaaaaactgaatgaataagagtctcttggctaaatgccttttcaagtagtgctttgttgtgtctctgctgaaagatcttgtcttccatattgccagtagcaagatgctgttttgataaggtgggtaggtccaatctgtcttgtcttccttacaaaattattgtttgtatatctatgttcagtctgagtgttaataatttctttctgcaaatgataaccctcttgaacagccagaacttgagctagacctcagggtagattcctagcccatcgattagggcctgtgtctatggaggaggcacagtacacagggggagaccactgtggagttgatgcagagatcctagtgctcccttcagcctgaagagaaagtgtgaacgctttcccacggggaaacagggacctcaccaagaagtactccccaagagaaaaaagaaaaatgtcagtgacaaaagaagaaagtcgtgggagcctgtggggcccctgagggtagatcaggaggaagtgtgagtgcaggtgcccctttgggctcaagtgagagtgacccatagagacaatactcagttttgctctcccattcgccatccagtgcagattatgcaatttgtcttcccacaccctcttcctcaacactgcttaccgcaaatctctaactctgctgttaaatcctttcctctctcctcaaaaaccccatgtcttttatgccacgcctcagcttgcggtggtgtaatgaatacttttagtccagtaacccacagcacactaatgtgccacttttgctatggtgatctaaattttaaataaggaaaactgcagagggcaatggtggacatttcaaaaaaaaaaaaaggaaagaccaattttggggttgggggactgtcttgcccctatcatgacagggaaataccttttttatatgttggaactattttttatttctcttttcccaccttgctatgatttaatgacttttagagtagtgaacatttcctaagtgagtagggcagagttctcccttcatgacttcattcttcccccatgaaagcctaccttttcccagtctgaaccaatcccttctgattctgggcttctttgcatttatggcatttatcataacatgaaatgtattatattgagttgtatctgggccaacttcccccacaggactgaggaggcctcttggatggaggccatgttttattcatctttgcaacatttatttttttcttcttttcctctttttttcctcatacacttatcaagcacatattatactcttgaacccggttttgttttgctggggatgaataagatactgaccctctccttaaggatgtttggactggggtggagaagatagatgtacaaaccatacacttatgatatcataatatgattcctacatcagtggaatgtacaataattagtgatagaccagaggaaggaatgatccaatctgcctgggggaaaagggagagaatttatgtttattaggcactaattctgggccaattctcaaaactatcctgtaagtagatattgttatctccaactgattaggagacaaaggagcagagaaattaaacaactcacaggacaaatcttgaaagtagtgtagccagtatgacttttaagtcatgttcaatgttaaagttgaactttgaaaaaaatatatgggctttgatacccggacaaagcggggaagaatataataggcaaaggaaatatccggtgtgaatatttttaggtaggaaagggcctaacacatttaggagtccacaggtaattttgagcacagggtaggagctggagctctagagggccagtgtatgaggttagagtgatgtggtttgtggctggattgatggacaaagagctaattcctgaacagccttagttctatggttaagaagtttttattttattctgtgagtaacggggagccagtagatgatataaaacgaggcaataaggtgattgtattaacatttaagatgatagctctaagagcaatgtgaaggcacattagaaacagaagagccaggagtgtgggaagccaagtccagattccaccttggccaatttccacccaggcccttcatgctgcacagctctacagggcactgatcacgtggtaatttatgtgtatgttggcccctcgagctgtacaactgctcactccacaaaaagaattttcttctcccataccttgttatacatttctataattgcacttaaaatacttgttttgtagtttttcaaatttacatgtcttcatttaataggttttgatctgcttaaaagcagagaataagtttctcatctctctctttccagcatttagtactgggcctggaccatagcaggtgctccataaagatttcttgaatgagtaaatgaatgagtagaattccatagcactctagaagagttgtatgatcatgaattggatgtccttgacttcagaaactcagccatttattatttatgtgaatttcaacagattacagtcatacaatgcttaacaatggggatctgttctgagaactgcatttttaggtaattttgtcattgtgcaaacatcatggagtctacttacacaaatctagatggtataactgactgcacacctaggctatagggtatagcttattgctcttaggtcacaagcctgtacagcatattactctactgaatagtgtaggcgattgtaataccatggtaagtatttgcgtatctaatcatatcaaatagcaaaaatttggtattataatttaatgagaccactgtcgtatatgaggtccatcatatgtggtgcatgactgtatttaatctcattgaaattgcttcctcaactgtaaaatagaaataataaaacctaatacgtggaattgtcatgttgactagaaataatgtatgtagtgtgcttatataagttcctagccctggtaacacttaaaaaacaatatcgtttgcccactttttcatgggattgtttgtttttttcttataaatttgtttaagctccttgtagattctggatattagacctttgtcagatggatagattacaaaaatcttctcccattctgtgggttgcctgttcactctgatgatagtttatttttctgtgcagaagctctttaattagatcccatttgtcaatttttgcttttgttgaaattgtttttgacgttttcatcatgaaatctttgcccatgcctatgtcctgaatgatattgcctgtattttcttctagagcttttatagtttggggttttatacttaagtttttaatttatcttgagttaatttttgtatatggtgtaacaaagaggtccagtttcagttttccgcatatggctagccagttctccaagcaccatttattaaatagggaatcctttccccatagcttgtttttgtcaggcttgatgaatatcagatggttgtaaatgtacagtcttttctgagttctctattctgttccattggtctgtgtgtgtgcttttgtactaataccacgctgttttggttactgtagccttgtagaatagtttgaagtcagatagtgtgataccttcagctttgctctttttgttgaggattgtcttggccatacgggctctttttcgttctatataaattttaaagtagatttttctaattctgtgaacaatgtgaatggtaatttgatgggaatagcattagatctataaattactttggatgtatagccatttttgtgatattgattcttcctatccatgagcatagaatgtttttccatttgtttgtgtcctctctgatttccttgagcaatggtttttagttctccttgaagaggtgctttacttctcttcttagctgtattcccaggttttttattctctttgtagcaattgtgaatgggagttcattcatgatttggctctttgcttttctgttgtaggtgtataggaatacttgtgatttttgcatactgattttgcaccctgagactttgctgaagttgcttatcagcttaagaagtttttggggtgagacgatagggttttctagatacaggatcaggtcatctgcaaacagagacagtttgacttatgtagcaaacctgcacatcctgcacacgtatcccagaacttataaaataaaataaaaataaataaaattaaattataggtttattattagttgtagcaaatgctgtcagtgctgtccatttcccttgaaccctacaattaggtgtagtctggtcagcttccaactttcagtgcctgcatttctgtgccagcagtttcttcctagaacttcaggagagtgccctgccttcagcattctagaagtgctggaacattaatagacaatgactgacaggatccagtgtacacacacccagctctatcacctccaagagggataactctgaagtgtgtgttctacgttagtcttagtcttcaggttctctgcaggattgagctaccacagagatagctggtttagtagtacaccctttagtggttgccttttcatctctgttacttccttgctccccaaatggtggtctttgcacctcccaaataaaacatttccttcttaaatctttgttggaacatctacttttgggagatggggaattttcttaaaatataattattatgaaagcagatgaaattttcacattttgaagaattttgaaaaagcttttagaaaagtcattatttctgtggcagaagcctaatgagatttttcttcacttttcttgattacaattgtaacagggattataacccatattttgctgtcccgtgggtaagtcacagatcccatatctggagacctgattactggagaatttcatggtcttgttgtaatagtcttgacctttaagaatggccctcattgagggaaggcggatggcatgtttctattgttctacggagaattccatagccatcttatatcttctttgggaaggcattatatagtaaaatcaagcagaatttcattcatgtaaccccttcttctttgtttttcctctctttccttatgccttcttgcctcctaacaatcctccaggtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacaggtgaatgactggcccactctcccttgctccacttccacatgtttctcagcggtcggtcatgtttcaagctgcttgtgcagctcaccgacatttcttactgggttaatctcttcagagacattcaacttgctgacatccccacattttcccaggagattataagctgccccagcagcagggtttggggcagaagtgagaggggcaggctatctcaccaatctcctcttggactcaggaactcttgcaaaggtttcaaagatgaggaagaatctaaaagaaaagatcattaagctgtgcccagtgttcctcttgcaacaattctggaacaaaactttaccctgtttccaaatttaagctaaattcgttgtattatgcaaatgtagggacgtaacttgtaaaactccaagtatagggccaaaggcaaactttgcagtaaaactggctttgaattaaaaaaaggaagaaggaaggaaggaagaaagaaaggaaagaaggaaggaaggagagagacgagagggactatgacagagagaggaggaaagaaaagccaagttcattctgatcactttcatggccaaggttctttgttagtaggtgtgaatttcttataatgccaaatgccttcctaatctattgctaattcttgtctacttgtctgaagttttctctggggatcagtttgtgtgtatttgtgtgtgtgcgtgtgtgtgtgtgtctgtgtgtgtttcttttaaataaaaaaggaatgtataatttacactaaacttttatattaaaaagttgaacatttttaaagaaacaaatatcagagtactatttcaatctcataaagaggcttttaacctcccattattatgctgttcagaaaatataggctgccagaagggaagctgagacacaaattcctaacccattggattagtctagagtgactttctttgaaaatatacctgagtactctgagaaaccaggccaagcctacgtgttctccctggctgatttcagtggaggaagaactattcaaaaattcatttattatgcttttgtttacctttttattgtcaaggttaattattggtttaaggagaggttttaaatgaaatataggagattatgtctcagatgaagttgaatttctgacatgaaatgctacatttttgaaatgcaagtgtttttcaaaggttcttagctttaatcaaagcaaaaagcctcatctaaaagtttctttctgttccaaatcagttcctttagagaaacatggtaaatgcacttggaaatttgttttaatcccctgttataaaattagcctgaattctttttgtcttagcacatagagaccctacatctaggaaagtcttattctgggccctattgcactcagatgtggtgtgccttactgatcttgaaacattagttatatctgtgtgccctattttaaatttaaactcctctcctataagatttactacaaatacattttttgaagaccactgtaaaatcacatattctctaatattttaaataaatgaaaggctgctttatttctcttataaacattggtataagagaaatttggtgtgttcatgaacacgctaaatggcttggaaaatgggtgtggttcaaagcctgatgcttcaagatctctggtttgaatttggtcacaaccaggaagtattgcccctttttctgtctgggtcctccataggaacttttcataccagccataaacaatccagatggctgccacgtggtccttaccagtgagaggcgtcacacagcacacactgcatgaatggggatgaaatcattcctgaattaatatagggttatattacttggacctcagccatttgagcctcagtgtctgcatcatatgtgtttagtatatggacatctaactgaaattattaacgtggcaatttatgcgtgccttttttggaaatattctattttaatggaaagaattatgtagaaatactggatacatttttaaaaacatccataattcaccatcttgacataactagtatattcatttttgtgattagagttcaatgttttatatagatgtagctttagtgtatatattattttgtattctgctcttttcacttaaagtcatatgacctagtacattttactcatttcttggtatgcttttatatcatttctctcttagaaattggatttgtaaaaattaatttagaaaatcataaaatctgttcatattctgtatgaagaataaattaatcttcagatataagcagaaaagtgatgttaaaacaataatttaatcaataataatgttttttgatccaatgttgactgaagtgtttatattttggttgatttctaaaagtagcaaaaagctattctgttatttggagaattttctgctatgtttagaaccaaactatgttatgatttcacactttgaagcttgataggaaatattgttaaggaaataaaaaagaaaaacaagtgatccaaagcaaaggaaatgatagacttttgtgttatgaaaaattaactcactgttcttgttggtactattatgtcaagttagttatctcacatgtgacactcattaaaaggcatttctcttggttaattcttggaacactgttgtgtgatagctctgtcttgctgtgcttccaaagaagagactaaacacttgcccaaatttaagtcttcagcaaggagaattagaactaatgcttgtgttccctgttttcatccaacatgttaagccacacgactatattttcattcaaattaaaccttgcattgtattgaaagtagtaaaaaaagtataagattggaaaactatctaaaatcccctttttatgcaagagatatctcagatcagtgaggcatgcctgcagctgaagtccacactctgtggggacctcatcccattggactgatagacgtggcttggtcatacaagccagagacagtgagcgacagttttgccagaaaggatattttgctgacttccacagttatcccctgaaaaaagaaaggagaaaaccaaggcataaaagcagttatttgcatatggtcagaattttgggttggaaaatagccaacatacttttttctgggtgtcttttacatccagagtcatggatgtgtaatttattgttcaaactgggacattttttagagtgaaaggggagcattattaataattatactaggacaacaggtataagccaggattgtccctagcaaactgggacatatagtctgctctaattatagcttgtcatgacctcactcattcccttgagcatgttagaggtgatgacattaggcaggcaactgagtcaccagagggacaaagcattccctatcacggacactgttgtcctggcaggtgccttctttacatccgtggccagttaaaggaagcttgtttttggcacacacacccattgcttaactcagaactatttttcttaggcaacttgtaagagtgaaagcacacacaagcaccagaattattcagactcactaatcttgcagtgctttgcttcgtgcttcgtgggtagcagtgatcaaccaagtcctgaacttttgactgttatttgagatgaagtagccaagaaacattttctcagagacatcctttcctaggtgaagtggatagtgaatggcctggttttgcattatttacctgaagtgccatttccagagggagggctgggcttaaaagaaagctagtgatgagtgaaagagaggtcagctatccttgtccacagcttccctccccatccttctcctcccctcatttgatcgtggtcatggtgctgcctgacatctgctgaacgcatttggcttatttctccctttcacactttcaaaaatagatcctcgtccctcccaagatgttgtttacacgaggggcttcataacggattctaacggaagacactgaaaaggtaacttgtcagagggggaagagggtggctgcttggggtagggtttaagtgggaattcagagtgtttaagaaagtgggggttgcagttctagaaatttcagcagtgaagtcctcaagtgaggaatattattggtaaccagagctgcaagaaagcatgtccactaaatgaagcatagtgtgatactaatctagagcagggctcttcagagattgctgtgcacaggaaacatctgggatcgcgtgactgtgcaaactctgattcactaattccaggttggagcttggattgtgtatctctaacttgcttctaggtgatgctgatgctgttgacacttggtacacattttgaatagcgagactttgtaggttacaggacggggttcggaagaactacgttcttgtcctggcttctgctgctcctcaggccagtcagatcattgctctcttatgcagctttgtatctaacatgaagctagcaataatctccctattgcttatttcacaggggtgtttggaacctatcgataagcagtgtgcgcttcaaaaaaagtcttgcaacaatagaaagatacaagaggctttatatataaaagtatttctaaaatgaaaagttaaacatagcagaaagatcactgaacatacagtacaaacggaaagcttaccaatgaaatgtgcaagtgtgttcactttaagagataaatatacgtattagaaaatcaacttctgaatttcaaaacagaagttagaaatagaagttagttatttaaatcacaaaagatccctttccaaagaatttaccagatctctttttaaaagtaaatttccctaggaaaactggtattacattttatcaggtgaagcaagtatgcctccgttgttcttgcactgacaaaagaacaaacccgagactttctgcaacttctatgcatcacagtcttgaacaccgtaacccctacagtctttgaaaaaatcctgagctggtgaaacccaaggatttcaggaaaactcatagacttctcggctgacagatttgtctttagggtgaaattgtaaacatcttgtcatcatttgttcaaagggccaaatagaaaacaaagagttgaaaatagagtcaggtattatttttttcccaagctatcaattgttttgtgatttgtgggacttaacactataggtgtttagaaagcagaggggcagttgtccatacgtttcctggctttaaaatcgtagtacgaatagtattttccatacttcctcaatgtttgacagtcattttaacacatttttttttcctcacaactttcagggtaggttgaaatgataaaaaatgatttgtcccagtgaaaacagtactccacctctgctagtggttagcattctgctctctatggctgtgttgcatctgttaggaatctccaaacaagtaaatggaaacatttgaagctgatttaaatgtgtcagctctgtgtaagtctcagggcagattagctgaatcaacagatggggtgcaagcatttattattaatctctaatttctcaatgcactttattcagtaatgtggtttcttggtcactgacacaaagaacttaactaaaactaactaaaaatggggctttagccaaagcctaaaaactcagtcccagaacttatgtctgtaccccacttccaagaataagtgggttttacttagaaggcaagaccaacaggcaggatctctggttgttgttaagcaggcttctggttgttgtcatgtgcttaatctgtacaaatcacttagcttcaatctcaccattttacccgagcaagcttaatcctgtataggaaggactggtcattttacatgttccgaatggccctataaattggttgaaaacagttaattaccctctttggacttttaagaaaacatttcagggttctctttcttttcctaaagcagaacgtcagaagtctccgtgacatggaaagcagatggtcacaaacaatttcatattggcagccactcaaggctctcttgcatctgttgacactttaggaggcaggtcctctgcatcttacttctaatgccatttttgaagaatgactaagatactcttagagtactcactcactaattctgtcttttctgacttgtaatacaagttttgcttttcactggtatatccaaggactgctcactgcttgcctgtatggcacccttagctcaaattgagaagctagatccatgtcaaactactggaaaacagacttgcaattatttagtatgtgtacaaaatattattggaatccctatttgtaggattacatattctaaacatttgttaagaggctgtgaaataagatggctttggttcttttatcctacttcttgcggctataggatgctgaaacaagttaaatcaattttgaaagtttatacatttcctaagcatttatcaagggaaaatattatcacctatcaagctcctagggaattgctaaattcattcattaaaaacaactacttgttaatccactaatttgagggatacctataaggcattgtcacagacttgcctctggtggtgttcttatacaatgccaccatataatcagacgagggcactgttctttactgtggaaaagcaggctgccgtttatgtgaaaaatgtgccagtgaatatccaatctcctgtgtaatagatgatctgaattcccattaatttgtttttgagatagaaagtgcattaacattcatctcatttgggatattacagtcttgcctacattcaagagagaaactcagtatttccaagaaatgtgttaccctgctaagtcctcagactagaatatcaggtggtaaagctagttgactctgaaatcactacagcaaaaacggttatgcaatagacaacttgtaatcgttattataggagacatttctgggaaatagcaatagcatcttcagtaaactaaaataatctccccaaggttctaatctccctttttggctaaagagatggaatacagctttgattatctaagaaagggcacatttctgttacataagactttgcttgtccagaatctcaaaaaacacatcatctttcagaaaattagaccaagtacttaaaagcacaatattctatgacaatctacaatttgggatgagaaaatttttctttatactctctcataagttttagctttctgttttcagaagccattcaaatttgttctcaatacttagcaaataatacagacaactcctaattccagcttctcttctatgtgtttacaatttcactaattgtgcatcatctttagggcttaattctctcacagaaacctgattaagaaaggttgacttggttgattttataataatctatgacttaggtacatttcccaaatccaatagtctttttttctcagatacttagatcttcggattcttggtataccctagaaattttttgaatataggttttgtgggtttacatacatttatggtaaggtcttgaatggaactgtgaactaaatgataatacatatatgggctttgaaaataaatgacatttcttggtatattctaaaacaaacttgtcccactttagtgtatcgttctggtcatttatctcacttctaacttaaacctaccttaactgggaactcttctgcttctatcccttggtaggcagtggttgaagtgatagtctaaactgtactaataacttgttcagtttttattgtgaaatatattttttgatggatccaagtatacacagtcaccagctcctgcttttgtcatgtcctactgactttgccctttctattaagatagtaaaattggcagtaaggaccagttcctatgaataaaagcatattggtaagatttttttttttttttttagaaatcattgctcacagcagaatgacagaaaccaatgacatcgagcaggaatcaatttaatcacactatatatagatatttcttagttatctgtctattcattgaacacatggtactagatatggtgtcatttctacctgaggaaacagttgtgaacaaggcagatgtggtgtctgatctatggagcttatagttgaaacagtgatagatactaaacaaattattaactaaacttgaatcaagtgctaaaagcaaaagtttagtgtgttataaaagaacgtagcctggtctagagggttgagatcatctatcatgaaatgatgagtaagagttaagcaggcaaaactgaaatagaagaaggtaggatccttttgaaacctttctgagtctcctgtgtcagaacacatacatgtatgtgtgcacacacacacacacagtcacccatacacttaaccagggctataaagattttaaattaaagatgtatatttctggaaagacctagtgatctgggactcattatatttcttaacttaattttcttgagttaattattagtaactgagctgaaataggttattatgagttttgactccgtggtgtcccaaataagtatcaatgatatattctatttgtggagtagctttacttttctctctttctgatcttgtcacttgatccccagaaccacaaagtcttatgtggctgacaaaattccattggaatgcaggcaacagaagagcacatgtcattccatttataagtctatctcattccagccctgagttgaaagggattttgctaatcttagaagcaactaaaaacatttttattgaagtaaaatatgtatacttttaactatttagtagaaagactaatttgctattaagtctatgaaaccatttctttttcctttaacagagattcatggatgcaattaacagaaacccaccaatgataaatttctgcctagtggtgttcttaggtcctaattgtaatctatgacaatgaaaaacaagtttagatttttctcagcaatgaagacagtgagaaacagttacctctgaaatcaagaatgctgaaaatggagactttgatagtttatctaggagatttaaacattttcaaaataactgacccaaaaggcagtgtatgctattcaagttctcttgaggaggttttaaaatcaaggccagtggcttagtaacctcttgattcagcaagcttggtgctatcaaccagtaaattaagaatggcagagaacatatgttaggttgtttaactggttctccaggcacattatttattatggtatttattatctaaaatgtgttagaattaaggtcagttatctagagtgaaggagcaaaattccctttagtttattttcaaatgcttgtttctattccccactgctcccacaggctggggaggtaggcaggacaagagattaaatactgttttaataagtcagctgatgaaacacctgctattcaacttgagcaactttcttctctcaccccagaaataaatcattactcactgtatccaccacaacaaatacctcttcctccctttcctcactctacaccactttctcctgctcttcaaaacatgaccactcttccctaagtaccttagacgaatggaaagctggggctgtaagggaccctagaggtcatctagtccaagccattgcccctgcctgcccccatgctgagagtacatccatctggggcacagacttgcagctttgtgaaactaatgcctgttattctccctgctctctcctttgtccctacagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataagacacctatcctgctctgttatttcttcatctgctggggggaaaaagtaaattacaaacaaacaaacaaagcagaactaaaatattgggaccatggcagagaaaagcaggagaggagcaaaatgaaaattagttaacaaatgttcctcctccctctgggataccaccaccacttgtttctgtgtgtgtttattttgtttttctttcattcatgctttgcttaatgtactccaggcttcttcagataggttcagcccacccacccccatgattgtatgaagttttaaaaaaaactacagcagccaaagaaactatatatatatatatatatatatatatccagaatgattgcctctactgtcctcattgacttgtttgaaccttagtgccttaccctgtcctcttcccagttctctttatagaagctctaggagctttcgaaaagccaaagtctttctgaagaatctgtgctggacagacataattccctttctcattgtctccatctttgttggtcatggtaaggtttttccatcagcctctgaaaaaatagttgtgcacaacatctgctcactggactgtctgatccaatgtaattggctgcgtctggctaattctaagcactaaagtctacatctaagctatagatttaagcttgaagctacagattatatcactatcaccaccacccctcaccctatgcaatcaatcaatcaatcatcttaagttaaagatatttgttgtctttgaatgatttgctgtcacagactatttggtagaagaaatatttttcacctgagagaggaagagaaatttctctagtaacacaaagagtgagttctaaaaggcatgcccacatctctttcgtgccttaaggatagtgagatgcacacttatatatatactgtatatatttatatatttatatatatatttcatatatatatataatattgcaagcttaagtttgcaatttcccaaacaatacaaaaagcaaattacacaccctcaccactgttcttatctctatagtgatgaaacattaattagggatcttgctgcttttctttttctacacgaagttttcattaaagccacagaataattgatagggcagctgtttgagaacaggtcccattttcacattagggctttaaatgaattagaaactatttgaggctataaaaatgtccttgagtttggagcctgagctctggtgaaatgctgatacatctgatctatcatgggaattgcagttagagagagtaaggaataccatttagtcatctatccgttcttcacttagcaggaatatgaaagaaaggcacatgtttaagaggaatacctaaaggtttttctaaattccaacatttaaaaggcaattgtgggctatttttattttttaatattttgaaataaagtttagtgtctagggctgggagccaggactgatcttccatttctttttctttgttcccagccatgcttttgtaacttgccaggtggacttgaccaactacattaccatgctgtgcctcagtttacccatttgtaaaatgggattaataatacttacctacctcacaggggtgttgtgaggctctattcatttgctcctttattctttcctgtattctctgtatgtccagcactttgtagccatgggaggaaagggactataaaagtgtacaatgttaatggaatgatacggtacctgaaagccttgttttctagtaagaaaatgctaccttgctgtacatacttataaccttgtatttggaaatgagaaataggtttatattttcagatctctcaaaaatcacatcatttgaccaaagaataatttaagacacatagaacagatttttttaatttatattttcatcctgaccagcttagttctaataatttttagttgtgagtgattaaaaaactttggatcaattttggtcaaacatgccaactttgtagtctgagtgacaggcaaggatttttgggtttaagatgcacttttagcacacatttgtatttcccttggcatatcagattgagctaatggtgatgttatttcaatctaacagccaccaatctgaaattgtatttcaaatgttgattctgtagttctttaaataataatgaagctcatcttatacattttgctttcaccaattgattccttcttcttttagcccactattaaaacatttcttactgaatggttcatgtaggcttgctgaacagcacgcattacttgcttcctgaagagttcccccattcatccatttgtcccattagttgctgtggattatcaagttttgaaggaactgtacatcccaacagactgaaacattctaagtgaaatgagtataatccaagtaactggtgaactttggaggtttggagcttgaagagaatggctaagaagatttgaattatagggagggaacagaaatcatacatgaaaaggttttactgagaaggggaaaaccttagatagagggacatgtgaaacaaaatcatttgaaattttgattcagacatccatttccagtggcaaacagcaaagcctgaacccataaacccaaatgataggtgaagttgggtggttttatccaatgtctcaagcaagcaatgtctgggaatatcatagagtaacaagtgctggtcagccaaagaaacattcactgctggtgaaccaataccataagcatgtattatctaagcacttgatcaagaaatatacatgttgtacaagctctcaattttgttcatttattatcaaatttttaaaatacaagtttggtatgtgatttggaaaagatgccttctggatcttaagccagttgtcagtggaggtcctcagggctgcaaatgtcaagacataaccctgttcctcaccatcatgataccagatacaggtgaatacataggaactatctgcctgtgtcctcaatctcccttcaaacaagatgctgatttgtagggtacttggcaggttaaattaaaccagaagaggtgacttaataaaaaagggaatgacatttagggtataaagatctcataagaaatgtaatatgtaaattatatcttgctttatgttgtaaaatatacattgtttgcgctagaatagaaatgatttcttttcaataaaaagaaagaaggactctaccatgtcttttgttatatacatttaagcctgctgattcttttctctttgaacttcaaaaacacagatctgctagaatctgagattacatgcagaagagtgaaggtaagaagggcttatagacaagataactttatctgagtgtgatattattttccataaaacaggaaaataatctatttttcctcagaaacaaagacaatggtaggaagaagaggggacacttactattataatagatgagaatagagtggaacttttatgagagtttagcattttcaaaatcaatatctttaacattcacaatactggacaccatatggaaaagacttcatataagcatggctgtttcttctggagtaaagaaatagaaaaataaaatttcttaagcatccattgtgcatagcatgggtgtgtggtcatggggaggacagaaaaacta

SEQ ID NO: 14620 - DNA, 78649 bp, Human; identical to SEQ ID NO: 14619

SEQ ID NO: 14621 - DNA, 5900 bp, Human
gccagtattttaaaatagtgttattgtaattttacacgcttttgtgatggagtgctgttttgttatataattttgacttggattctttccatttgcatttgtttatgtaatttcaggaggaatactgaacatctaagtcccggatgatactaataaactaataattgcagaggttttttttaaaacaaaaaaccaaacaagagtcacctttgctccagttcccagcaagttcctcctctccatctgagaccatctcagcctggactttattgttcatatcactatcagcatttttgtcaaagccattcaacaagtctctaggaagttccaaagtttcctacattttcctttcttcttctgagccctccaaactgttctaacctctgacgtttccacagttccaaagtcacttctacattttttgatatcttttcaccagctccccactctactggtaccaatttactgtattgattttcatgctgctgataaagacataccagagacctggcaatttacaaaggaaagaggtttaatggagaactcacagttccttgtggctggggaagcctcacaatcatggtggaagataaagaagagcaaatcacatcttacgtgcatggcagcaagcagagagagagcttgtgcagggaagctccgccttataaaaccatcagatctcatgagacttattcactatcaggagaacagcatgggaaagacctgcccccatggttcaattacctcccactgagtccctcccacaacatgtggaaattcaagatgagatttggatggcgacacagccaaaccatatcagaggacttttaaggtcgtgaatgtgaatgcaaattttattttccacttgttttggtcaatgtctccatttgtgttgttttctgtgtataattctctgtgaattcctcatcatccttacctctgacaggggagggagaaaggagaagggaaacatagattttcatatgtttcttggagaggaaacagagaaaaaaaggaaaaaaaaaggacaaaaaggatatattattcatttgtccctgtcctactaccttcctcctgtctccagcctctgaaatgggagaggaagggggcattgtagaataacaatattcaaagatttttctattctcaagaatatctagaaaagatttctttcacatagcaaggttctcttgtgtatgggccactgcacgtgtccattcctataaaagaatagtcaagaagagagtgggagctgggagcagtggctcatgcctgtaatcccagcactttgggaggccaaggcaggaggattgcttgagcccaggtgtttgagactgcatggccaacatggtgagaccccatcgctaaaaaatataaaaagctagctgggtgtggtggtgtgcacctgtgttcccagctacttgggaggctgaggtgggagaatcacctgagcttaggaagtccaggctgcagtgagccatgatcatgccactgcactccagcctgggcaacaaagtgagaccctgtctcaaaaacaaacaaacagacaaaaaaccaaacaggagactggggaagggggttggtggttctcagtgtccatgtgggcaggcatttggcccaagctgaaaatgtggcttgatattttttaggttccctaagatacttggatataagtattgcaaactaaaattttatacttgtgaatctttacacaaagtatcctcccccacctccagatttacttgaagtggggagtgagtatagggagaaaataaatacagccaggtgtcattaatattgccagtttagtatctcatctacagagcccagggctaggctggagagataagagaaaataggtaggaaatactttctgactactaactgatgttttgtgtcttaccttgaattgaatgtgtttcagaaggtcaaagtggtttgcatacattttgagatattccaggaattgagaatttggcacatagtttggataatcttctgggaatggaaagtctgagtaacaagacatctccttgcagctgttggaaaccacagacttgtagagactggctctgccttcttcaacatgttcctgtacaaacagtgcacacacatgaacattcattgcatgctcataaataagcctgggaagaactcaccggtccagatgcacacagtatcattgccaagcacaggagaatatagaaatacatgagaatcaggaagtagtatttatttgaatgatggacaattgctaggtaatttggttttatggggtattctggaaatgattatggagaagatggttcagagtatgaaggatcttgtatccaaagttaaggaatttggattttacaggaaggttatgccaatctactgaacgttctaaatatagaagtgattcatatcacttctaaattttggaaagataactctcgttctacaaaaggtgaattagagggagctgggaaggaaggaagggggcgctagccaggagcctaatacacaaatccacttgattgctaatgagggcatgagcagaggcaatgatagctggaacccagaagggtgagatttgtgagatggcggtaaggtagaacacataggattgcaaaaccaattagatttaggggttgagagaggaagcagtcaaaggtttccagattggacaactgtgtgtggcaaagcactaacaaatttcccaccctcagtttttactcaaataactagcaaataccaatatctcataagactactgcaaagttgaatgataaacagttttagtaatgtctttaatatacattgcctctgtcttttggggagtagtatggaggattattctaatttcagtggcaaggttcttgtattttaacattatttaccatcttgcatatgtatagttcatttttcctgtgaaataaaaattatttaatttatgtgaacaagtagaaacatgaacataaatctcacatatggagagggctttctctgtttctgcaaaggatgtgaattgatatcatatatagattcctgtatctgtctgaaatacacagcaatcacagataacaaaattataaacatatctctgtggtttaaattaatgttatttatctcattgactgataagagttgattacaacctgcttgtctgtggcccacctgtcacacagactcagctaaaatgcttgcgaaagatgactatttaaatcttgatattttattcagctggaatatctaatgcagtgttattcaaacatagtctgcagagcaatactgatatgaatggtttgttactagtctgttacaggataaatacagaaatcaagagtaagcatttagaaacttttatagcaataatttgacattgctcaatatgtaagcatgtggacaccattttgttgaacaggatataaatcagtcttgtttttgtctaacttgtgtgatgagtttgagttgtgtactagtcatatgccataggactgtattatcatgtgcgatgttttaaggttattttgaaaactgttatccaaaagtgcataaaatctggaatcattttctttcattgaaagattatttatatttaatcttacagtataagttatttgaactggctacggataaaagactgaagatacattaaaaaaatgtagcactatcagcttcattttggatagcagttaaaaaaaatacactgaacttgctgagactggtttaaaaatctcttcctcatttcaatcaacatacctctgtgagcctcctttctctactttgactgctgttaagcaatgtttagaaatagtttagatacacattatcccctgcaaagagcattgccatccattcaaaccagattaggtaaattgacaaccaggaagcaagattaattgtcatattaaaaaccttaaatagtaatataaaaaatgtgtatttaaaatgtgtctacgagtgtttaacatggagaactgcaatttcatacaaaatatttgtgtggcaaaaagttacaaaggtaatgatgactctctgtgtcaattgcctatgtacccactttcaaagaacaatgtgttcattttttgtaattgttttcctttatatctatgttgtttaatgacacttactgaaattaattttataatttctgactctataaatttcaaatttacattttgtattttttgtttgtgtcattttcatttttctaagcattctttttttttttctttttcttttttatttttctttttttgagacggagcctcgctctgtcgcccaggctagcgtgcagtggcttaatctctgctcactgcaagctctgcctcccgggttcatgccattctcctgcctcagcctcccgagtagctgggactacaggcacccgccaccacgcttggctaatttttttgtatttttagtagagacggggtttcaccgtgttagccaggatggtctcaatctcctgacctcatgatccgcctgccttggcctcccaaagtgctgggattacaagcatgagccacctcgcccggccggattcttttttattatatttgacaacagtctacaattaattggaaaaaaacttgattgttcttcactgtttgagaagcacagctctgtagctcagcgccttttaattttgttaggaattgcctgggtagtctaacaaacatgtggatgctgactctgtaagtcagggtgagcctgagattgtgcatttcttttgtttttgtttttttttgagatggagtctcgctctgtcgcccaggaaggagtgaagtcacccgatcttggctcactgcaagctccgcctcctgggttcacgactttctcctgcctcggcctcccgagtagttgggactacaggcgccggccaccacgccctgctaattttattttattttttgtatttttagtagagacggggtttcaccatgttagccaggatggtctccatctcctgacctcgtgatccgcccttctcggcctcccaaattgctgagattacaggcgtgagccactgcccctgtccgagattgtgcatttataagaagctcctatgcagacgctgctggcccatggaccatattttgagtgagagtgctttaggatgcccaataggatgtatagatgccacataaacacttttgaatttaccagtggccccattaaaaaagtaaaaagaaacaagtgaaattaattttaagagtatattttatttaactcaatatacccaaaatataatttttctctctatatataaatataaatttaatatatatataaatgtgtgtgtgtgtgtgtatatatatatacacacacacaaattaaaaattttaaagcattttgtaatggcatatttaaatatcagcaattcattggaactggataagccagggaaccatttattttatgagaacttaaggccaatgaactaacaaaaatagagggaaaaataacccttctgtttctcaaaacgtaggaagataattttcaaggcagaaagatgaagcgcttccaggaaacactgaagcctgttgtgaaataatgtatcacagatgttaacatatgagaaactgtagcttacagaggaaacttagcccttaggataaaatctaagaccaatacttactcttgtctctctttccttctattgattgtttctcctggaaatagaaaaggtctggagtatttagcatatatacagggagtatgagtccctgccccttctgaatggtattggtgggacctggcccctcacctccagtgttcgcctcactgtgcaatctgccccagtgattcccaggccctgccagccttcaatacccacactgcaccctcccacccgtgctgcagacactctgggaattgtacctggtggggggtccaccagttgccttgaactc

SEQ ID NO: 14622 - DNA, 52314 bp, Human
  misc_feature (1)...(52314): n = A,T,C or G
acattgttttaatgtgtttactaactacagctttccttcaatgtgtgatgcatacttactgcttgtttttaagaccaaaattaacctcttccagaagggtgattattagcttagctggaaaaaaaagacaggattcatttaaacaaagtctttggccaggtctgtaatagcaaggtgtagaagagaggcaatcagcaacaatgacttaatactcactttccacaaacctttctagcatgtcccatgggtaactttaaagagagcaacagtctctgccttcaccgtatcgaaaattaaataggaaacctaaagaaaagcatcaacacacatgaataaaatgccagcaatttggaaacatagacaaatgcagccaacatggcctttatttgtggcacacatgctccttttttttttgagatggagtcccactgtgtcacccaggctggaatgcagtggcacgatctctactcactgcaacctctgcctcccgggttctagcgattcttctgccttagcctcctgagtagctgggattacaggcacctgccaccaagcccagctaatttttgtatttttagcagagatggggttatgccattttggccaggctggtctcgaactcctgacctcaggtgatcagcccgcctcagactcccgaagtgctgggattacaggcatgagccactgcacccggccagcacacatgctttcaaagataagaatattgctctaattctttacctgtttggaagagatagagtctaataaagaagaatgtagtacaaaaaaaatcataggattgatctattacaatacagaggaataatgagaggctttccacattagaagaatcaacagtttcatacataactttgtacatgggacatgtactattctaaagagctcgctggaaaaatcaaattctatgatcacaatgttcaggtaccagcgtcctggtaaattttacttatctaccctttcctaaaatagaatcttgccacagaattgctttatggcattaaaaaaaaaatacagtggctcaaagaccagcgttgccccatccaacctggttgtttttagatattgtcaccagtaaattcttagagtcatcctatagagctctagcaggttatttaaataaatgcatagtcattatatcatttttgtcaataatattcaatattaattcctataagcactctttctattaatcattttatcttttcttcaataaattcactatgttattcatggtactttatcagttggtgaattaattaggtttcttctgaattaatcaggtttcttctgtaattagatttttccagagattacatcaggtaatgcccatgggttataaaaacaatccttttgccacactcctatgttagtgggggatctgccactgggcttatctcaactgggcttgcctaggctttcagccctagcgtggatcacaggcctcagatgggtttgggttttcatttcagcacccaggctgagaaaacaataatttcctgagactggctccacttgtggcaaagggcagatatcccaggagcactgggggtaactttacgtgtctctcaaggcatcagtttggtacaagcacataatcatttctggtcactatttcgttagccaaaggaattatcacttggccaagccctaagtcaatggggtaaggaaacagactacacccacagggaagctatggaaggtaggggagagaagggaaaattagggactcataatacaatctaccccatgtatgtaagtaaagagagagagaataaaacctagtatctcataataacttataaacactatgctaagaaaatcatgattgcaaaagaggtcaggatgtggaaatttaaactggttaataaggatgactcaggctcatctgatccaggccagggaagccccatgactgttcagttatttctttcaggcactgatagggacgcttccatgactcagttacatagcacaccctcctggccttcatttggtttagtattctggcaatgttttaccaaacagcagcttttcttctgggtttagctccagctctccctcacatattgacttttaccaaaccctttatttttactcacttaacctgggtcaggtgctcccaatagtcaagctctcaccataagcatctggcaccgagaacctgacaaccatgactacagagtgtttcctgcctttaaattatccagtttcttatggaggatagtgcttattctcaaaataggaaagtcataaatcagcaaaaatgttattaatctagactacttaagcaatatacttaaaaatatatgatctgattttaaatactacatttttatttaaaacaaagagtgagtggcctggcgcggtgcctcatgcgtgtaatcccagcactttgggaggccgaggcaggcagatcacggggtcaggagatcaagaccatcctggctagcaaggtgaaaccccatctctactaaaaatacaaaaaattagccaggcatggtggcagacacctgtagtcccagctacatggaaggctggcaggagaacggcatgaacccaggaggcagagcttgcagtgagcagagatcgcgccgtgaacctgggaggccgagcttgcagtgagcagagatagcaccactgcactccagcctaggcgacagaacaagactctgtctcaaaaaaaaaaaaaaaaaaaaaaaatgagtataagctgttgagcttcctaaataccaaataagtcatgaaatatagtagaataagatagtttatgttttattgtagcctttgtcactaagatttacaattacttttcacatgacatacatccctatatttgataccttggtaacctcactcaaatgatggcaaatatgagctttaagggttttgtatagtcctattcaactgatattaagtatttgagacattatgaaattatctttttttttttgagatggaatttcattattgtcacccaggctggagtgcgatggcacgatctaggctcactacaacctccacctcccgggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccattgaggactaaaggttactgcttagcatgatgtaggggttctatatttaatacattatttgttgaattagtatataatcctaattcataaattattgtacaaatggctctctagtttcaaatgaaaatatattgaaaacagtataatggtctgtattaggttctccagagaaacaggactaataagatatatacatgtatatatagagggagattaaaaggaattacctcatggaattatgaagaactcgagggcaggtcagcaagctggaggcccaggtgagctgatggtttagttccaatctcagtcagaaggcctgagaaccaggagagtctatggtaaagctctagtccaaaggccagcagactagagactcggaaagaactgatgtatcagttggagtgtgaaagcaggaagaaagcctgtgtcccagtttagaaggcagtcagaggggaagacttctctctcattcagggaaggtcatgaggctgcccatatcatacagggctatcatcttgaattcaaaaaccaccctcacagaaacacctagaataatgtgtaatcaactctctaagcatccgatggcccggtcaagttgacacataaactaccactcacagtgtccgatttctgaggctgatgaaataatacagatgagtgataacgatggcagtagaaaggaaagatctgcaaagaatgaaaagatattaaggaggtagagagaaatggagagagtggcattgtagagtaaacatattctatgtatccagatcatctgtttatttgaagtttgagaagggatatgtacgagaacaactgtagttgcaaagttaaagcatccctccctccaaagcactcccactgtggtgttgccaagggagagtatggatttgtttgcatgattctggctttatatgtgtatggatttgtttgactatggaactggggtgggaatgacgagaaaaagtaggtgaaagaaagctagaagatttctagccaaaaccaataagaacccttctcttgtttgctgcggcttcttggagacagtgctgcactgtcaaggcagctcacaaacacacggttgtgagcaaaatattaataacaaccttgaaaaatcacgcagttaagtcttctgccttcaagaacatacttaagtccttttagaaataagattctgtttattttctctttcttcagaaaggaacattcctcttgctaattcattatcagaaacattcgattgcctctaaagtattgtcacacaagatattagtgcttaataaaaagtctcttaaagtaactaggtgctccaataatgcaattattattgctactattaatgctgttgaatggttctttgctctaccttcaaaagatatcagttgtgtgattggacttgctaattgtcctccttagacctcagttctttcagttgtaaaattcaagtttggataagaagatcattatggagacttctagttttaattttgtacccatgatttttaatagctttaatactagattttttttcccctccacttaggctatgctttgtcttaaaaggtaccatgctgccctcatgtggtcagacttgaaataacacataaacgattactaaaactggtaagtgcatttttaaattttgttttaatgaataatgaatgaaatcctacatttgagcttaaaattcacaaacagtcaatactcaaatcaatttgaatcatctatttacaaaagtgccaagcattaactcactcatagtgatgtaaaattttgatgtagaaataatattacaaacatgaataccaatattagttaattgtaatgagcactaccatgtgctaggcaccataaatattttacatatcttatctcatttgatttttctaagataggttttttttatctataatttgtcagatgaagaaattaaaccacttttggggaatgggcgaagacaccacaataaataaaatggtaaggccatcatcaaactcaagttgtgtgactccatagcccaaactctttcatcactagcttcccactcaaccattttatatttataagagctcgttcctggacacattcacaaggaaatgcacatagaaaacttgaaatgtgatgaggtaacatatgtgaaaactgcattaacataacgtctgatacagaattagctcacagaatgttcacgtgttttttaataatgtacgatactcattcatttaataattaatattcacctcgttggtcaggctggtctcaaactcctgacctcaggtgatccacccgccgcagcctctcaaagtgttaggattacaggcatgagccaccgcacccagccctatattcactcttaatcatggcatgaataaagagataaaacatgtagccataacaaatgagtaccagttttctaggcagttctaactttatcacttgtgagggtgaataggtctgtctgaagttttgtaattcaggaaaactttttcaagtttataactttatgtatgacttcctgggacggatgaacaatggctgtgttttaaattccataaaggaaaataaatgtagtaagtctagttttaaaagtgagaggggcttatccactcaacaaggcaccctaaaatatcagaaggaggtggatggtaggaggcaggacaccgtgtcaacccctggctctccaagtgccagctctgtgattttaggagcatgttcatcttactaggaaacttctcatctgcaaattaaagaggcgggctacaggatttggacatgctctgctagcctccacattccatttttctagtaatcctaaaagtcttaggttctgagccactttctttccttgggctgctttgttgaattataccacagtcactccctggctgtgtggattaagcctcagaaagcccccatgggaggaggacttgtgcttggttaggctttgtttaacttactttcctatttcttttttttttttttaatgtttttttttttattatactttaagttttagggtacatgtgcacattgtgcaggttagttacatatgtatacatgtgccatgctggtgcgnnnnnnnnnnnnnnnnnnnntccatggcagaaatcacacttccctctctgctatctatattacctctcttttccattccaaacccccaaaccttatttcccgaaacatctccaaccttagaaacatcaccttagacaaaaattctctaagttttctggatcagcgagatatctaaaaagagattatggctagggaggaattactgtatttataaaacctaaacaagtaaagtcattaaaaaattgccatattcctccagtattaatgatagctacttctaatatgatataattattaatgcaatgttgatgttagcaaagaaaatcattaagaagcagaatagacaggaaagggcgatgatcctcaaatataaaattatttttgtccaaggacttatcaatgaagagagtaaagtctaataatgttgatcctaaatcttaccacaaaaggaaactttatcgccaattataactgccattatgaatgaacacctatgatccaagcattctgtattcattgtctctgaccttcagaacaccaccagaactagaaattatcatttccaatttacaggtaatgaaatagaagctaaagaaggataactaacattcctaaggtcacaaaagccagtaaacaaacaagaagaagaatccgtgttaattggaattcaagaatgtgttgtatctactatattatgtcatttgacattacctggggtcttagctggaagattaccttagagaccatgagggggaccaatatgatatttaaaatgaagatcaaataaaaatcatttaaaccaaatagttcttcaaagcaatgaaacaaaatttgtcttttttttttttttttttttttgacaaggtctcactctgttgcccaggctggagtgcaggggtgcaatcttggctttctgcagccttgatctcctgggctcaagagttgcttccacctcagcctccggagtagctggaactagaggtgtgcaccactatgcccgaaacaaaatttttttagagctaactgcctctttggctgtctttctcatatgctgcctgagctacagggttttctataattgttagttggaaggcaggatttacaattaggacgagtcaccttattttatatgaattccatctaaagacagttttctctaggtgtatgtcttccctgtgagtcttgcgttctcttgcatccttcctttgggataatgtgatttttgctcaggcaatagaagtcaaaaggtgtgtaattcttgcagtctccatctaacttgagggaaatggagggctgttaaagcagaatggagcattagcattaatgacatgcattagtgttaatgacacattaaagataccggagttattttcttagagcatgaaaatgacaaattttggctctttaacatttttacatgagtaggagagcgagtttttggagcctacaaaatagtagtcatgtcaaaagtgttgttttgcctactgatcccagatttttcagaagtacttaagactgtggaatagtttaagtctatgaggggagaactgatgcgattttgctctgagtagttaataatggttctaagataaacccattagcgctgtctccacagtgtgtgtaatgggactgagctaaagcacgcgtcggctcacatttattcaaatgtcagcagaatagaaatggattgaggtttccatagaaactgctcttgagttcaggtgtttcttggggctttttgttccattaactgtttggagaaagaggtatacatcatggcttttcatttatgctatttactttgtcgttaggagttggctggtggagttaccacgtcttcctttgttttatgggatttttgccaacccctcttacaacctttccccttcagctgagaaacgggaatgagcaatttctacgacctgacaaatcctgcctgttagcagtggctgttcagacagcatttcttcaatttcagccagaaaggaagtttgaacatctcttacctagaaatttatgtaactcattttcttattcaagatttacattatccctatggaatgtcaccattataagaagttaagaacaaagcaatgactatgaacataattaacaaccacaataaaaaagaggatttcctggcattaggaaaatattctggtgtaaaatctaagattaaagataatcaactttttcaactcacacacaagccaattagtttcctggagaaataatgtcccttcccataatatagaaaaaaaaattaaaaagggggaaaaaaagcctgaacaattcaactcagagggactacaatgactcacgtccattaccgaatgccacgcttgcctgtaagttaaactagaacataaaaagctcacagtgtactaccaaaggtatgttaataaagaagagccaatataaaatagaaatagtaatgacaaatagcaagataggccttggacttcccgagagcaggctggtgcagaagaaaacacaggcatgagctctgaagtctgacagctcaatttacatctcaccatggccacttactacttaggatcttgaataagtccctaatcgctatacatgtcagttccctcatgtgtaaagtgagaacaataatttctaccttgctgggttgttgtaaggattagcagtaatagacatggttccttcttatcagtgtattaaatatctgaaaccctgcaatcatgaggttgtggggatgcaaaattcttcatatcgtgaaaaactcactaaatacctaatctcttatacaattagtattcattccaatattttccccagattaaccctagcatttttctcagtttatgtttcaaattatttaataatctctagctgattatatgaggtttgcaatatctcatgcaattagtacttaacttttctctgcctaagttttctcatctataaaacagaaacgatcataatactaccttctgcaagggggaattaaggttaatatttgcaaaatgtttagcacagtggtaaatcataataaacacattaatgtgttgtgtttcaagtaaaaataaaaacaaggctgggtgcggtggctcacacctgtaatcctaacactttgggaggctgaggcgggcagatcacctgaggtcagttgtttgagaccagccttgccaacatggtgaaacttcgtctctactaaaaatacaaaaaattagctgggcgtggtggcacttgcctgtaatcccagctacctgggaggctgaggctgcaatgagccgagatcgtgccactgcactccagcctgagcaagagagatactccatctcaaaacaaaacaaaacaaacaaacaaacaaacaaaaaaaaggtaaaaaaaaaaaaaacaaagaaacaaaataattccgtagcaaagtcactgaaacatgaagtagcatgattaaaaatggaagaaaacccagaaggtgcataacgggataaaaacaacagtaaatattgatttgtgtatcataaaggttaagaggtatttgtgaaaatggttagctctggagtattttcacacataaagaaatgactgcatttgttactgggcttataacattcaacatgaggctgtggtagcgggcctccaagatggcacctgatgaccccaccttatgtcagctccacctcccacatcttaccagactggctctgtgtaaccaatggcagaagagatgatatgtttcaagataaggttataaaaagacactgctgctcccacctcagtcattccctggtccactgtctcaatttctctattcactcattctgcaggaacaaagagctggcaggaaaagcccagccttctgataaggttctgaggattttgtccaaaggcctaagaggagctgaggactcttgctaacagccacatgagcttgaaattgaatcctttaaacttgggaaaccttcagaagattgcagccatatgcaacagcttgtctgcgtcctcatgagacactctgagctggaaccacccagataagctgctccctcctggtccacagaaactgtttaagataagaaaaattcgtatttttaagatgctaagtttgagggttatattttacatggcaatagatatctaatacagagttgagggaagttccatgtgctattttgcaaatttgatgaaaaaaacacatctctacatatacatgtaatttgtagtgtttattctaagaattagcagatacttgccaccttcacttttcaagccacttttcaaaaactttgttttactacttaatagatgattctgatctcccttttaactgacccaaaattcttcacaatctgtgcgcttcttacttatctcatattctactctcccccatccttttttttttcctttactccatccatgctgacgtcttttatgtttctggaacgtgccaagcaaacttccatctcaaggcctttgtgttgacagttctttctgtcttagcttctctttccctggatatctgaatatccatgtggctcactttcttctccttcaaatctttgctcaaaactctcctcatcagtgaggacagtattgaacagcttatttaaaatagcagtaccacccctcacactgatgatgctccttatctggatttattgtcctttaacacatgtacaagttgagcatctctaatccaaacacccaaaatactccaaaatctaaaacttattgagtactgacatcatgccacacctagaaaatttcacacctgacttcatgtggtgggtcatagtcaaaatgcattcaaagccttgttttatgcataaaattacctaaaatagtcagtaagattaccttcagtcagtagcataagtgaaacacaaatgaattttgtgtttagacttgggtctcatccccaagagatctcattatgtatatgcaaatattccaaaatctggggggaaaaaatctgaaatctgaaacacttccagacccaggcattgtggataagggatcctcaacctgtagtaattttattgcgtctctccccctcactgaaataccagcttcaacagggtggggcttttcatctcttcagtcacttatgcacttccatccatgatgtgtcctgatgacctagaacaatgcctgacacttaggaagtactcaataaaatatttgttgatgtaaatcaattgaaatatcagtcccatagggatggggattttcatccctttagtcacttatccacttacttgatatatcctcattacctagaagaatgcctgacacttagcaggtactcaataaatacttgatgtgagctcctgaaatgagtttagttcaaggggcttttttacaataccaattatcctaaagtaaagatgactgcctatatttaaatttcctgactccgtaggttgtcaataaacagggactatgatctgaaagcaaagttcagtttaaaaagaaaagtatgtgcttgtatgagtcacaaaaaagggctaagtacaaaagaactgctgaggtaaacatgaacatcgttctgtgaacttatgatttaaataaaatctttatcaccacacttgccaagagcaatatatcttatcatgaacgtacataaaaaactcttgtgtctttcctcttaatactcggaacattatttttatttttattacgaagtttgcattggagaatattgtaactcactgcacctaggtaaaaactaaagacataaatctgatgttagttctaaaaatctacaagggtaatgatatgaatttcacagacatggaagccttgttcagaatagattataatagaaaggctcggtagagccaggttcatgagtgtgtgacctgtgcagaagtgggtgcttagaaggcccatggcttgggttaatgctctgctgttgccgtcttgaaattcttcacaatttatgaacaagggaacttcattttcagtttacacggaaccctgcaaattatgtacttggctctatcttcctttgcaaacggagaaacaggcttcaagagttttgaaactgccataatagatccaaaaactgtgtatgcttttcacatctgtacaattttgttacgtatttataaacatctgctgaatggatgactctatgtattggcccacatcacttcagaactaggtcttgaacttagggattgtggcaagaaggaaaaaggcagcttccggtggctcacagggcaggccaggtggctcacacctgtgagcattttgggaggccaaggcgggtggatcactagagtccaggagttcgagaccggcctgggcaatatggcaagatcctatctctactaaaaatacaaaaatagcctggggtggtggcacgcgcctgtagtcccaggtactccggaggctgaggcaggaggcacttgaacctgaaggtcgaggctgcagtgagacctgatctcaacacacacaaaagaatgactctcaggcttctttttttctaatggatggaagtgaaacctcgaaagcacatggtcaagtgcctgactcttccaaaacaaaaacaaaaacaaaaaaactagcctcagcaaggaggtccgtagcctccagctgaccggattttcagtcacagaacaccggggacctaaaaaagggtcaatctcagcatcgtgcactcaacccagctccttccgcccctcgagcccaggctgggaggagccgaggaaccgaaagagaaaacaggccgcgcgggcggcagaggagccgggcgccgcaatggacgtgcgggcgctgccgtggctgccgtggctgctgtggctgctgtgccggggcggcggcgatgcggactcccgcgcccccttcaccccgacctggccgcggagccgcgagcgtgaagccgccgccttccgggtaccgagcgcgcgcctccccgggatctgtccctgctccctcacttcctgtcccgggtctgggctgcggaagagggcccccgagagctgaccctgctcgtgggcacccgtggctctgcgatgcgtctggggccctgagctgcgggtgcaaaagccagcttctctctcccctctccttgtgccatggtgtcactcccccatgcctttgctaaccaaaagacttgattttccagaagagatttgtcgctatggatttttgggacgcacccaaataaatccatagatacgtccaaagtgtccttggtgggaagaagcacccccttttagcaatcccctcgatcgttgccactggcttccaaagctcttctatttctcttttatgagaaccagaaacagggagcagcctgttggtggaagaaacctgtcgtgtttttttttcccgaggagggcgctagtgatcagaagttagaaacaaagagcctgtctttagccagattaaagaatcctgatggtttatgattctccttaaactaacgcaccaccttaaaagttcttcctgccttggcggagactgagttgaagaaaagagaagcatttaatttccttttcatattattatacgaaatataatataatttataatttataatatttataataaatacttagatttgagtctagcatgaaaactctggaagggaccagttagctgagcacaaataatgattttcctgaaaccaaggaaactgcaagggatgccgatttagtgttcgcctcactatgttctagatagctgatactatttaacacatttttaaattcatgaaagatgccattgtcatgatttaatttattggaaaagaaaattctttcattctgaatcaaacataagtctgagttgagtaatattgctcaaggaagtgtatcttttttcctggtgtttgttggaatttctcacaggatttcatagctgtgctcttttcccccgactctcctggaaagctccaatgtttaggaaggccagccttccctgattctgtccactcttacgttttgtccaaaccgagatgtgtactgttatctccactttattattcttgagttcagttctagctttcaaaaccagaagtcctcttactctttcaagaacaaaattctggcctgtattctacccctatcctcaacttacgttcgttttcctggtaaaccaaaccccttaggggaaaagtcagtttcacctttattggtaacgtattcattggctaaataaataaacacactgtcaggctcctaaaaataatatttcaggacaaagctcaaagggctagacttataaatatatttttaacatttatttagattttagataatttataaatatatatgtgtataatttatgtagtgactcatactggtcctgtaaagaggccataccctgatgaatgtctagaaaatgtaacttttctcaggagaaatacaaagaaacaggttgaaagatggaaagttggaagtggaggaggatcgaattatgaagactcttagtacattttaaaaacctcgggttaagaaatactgaaaaaattttcaaagcaattgctgcctgtaagaatttgcttcatgagatggatacccaaaaaagagaacattgaggcttcaacgcacagttgctggaaactgaacacctctcggtgcttagttggactttatccaagaatgctttaaaaccgattttctaccttagtggtccccaatcttttggcactagggaccggattcatggaagacattttttccatggacgggaggagggaagtgggggagatggatggatttgggatgaaagtctttcatctaagatcatcaggaattagttagattagttagctggagattgctgttcggacttgggatagagagctggacagtgggaaaggtggaaagggccttgcctccttggtaaccgtgaaacttcatgttgaaatcaagttaattcattggtgaattgatgattcaggggtttgcagctgaagatctggttcaagaaagtccttgattaattagtaatgtctttcatggtcatgggtttagagaatggtgaaggttttaaaatttgttttaatcttagccttagatagttttgtaagtttcccaggaatgcacgttaaatgaaagttaggttagcccatgactttcccacaaaatattatagtattgttcagtgaaaactagactccactatggtttattatgggatgcctcacaagacacctgactttggatggcaccccttatctctgcactttcactcctttagaaacttccagtgctcaggaagctcttaactattggatttagcctactctcctttgtgccaaaacctagctatgccctcatatttactgatgctcattattttaccacagaacatttggtattcttatccttttgggaggcacagacccaatattggatccaataaaatttgcttgatacactcactttagaataatatctatgccaaagtacatgtgattttacataaaatttccaaagctttaccttaagaccagttgccgtaatgacacaggttatattattataagattatttatatatttaggaatatttatttatgtgtaaatagatggccatagcatctttataacaagtgatcctaactaatgagccacttatatgtgcttgccgtaatcagccccttgaaatctggaattaggtcctccaaataggctttatccaagaaagctttaaaacctattttctacctcagtggtccccaaactttttggcaccagggattggtttcatggaagacaatttttccacggactggggtgtgggggtggggtgaggaggatgcggatgatttcagaatgaagctgttccaccccagatcatcaagcattagattcacataaggactgtgcaaactagatcccttacatgcaccgttcccagtagggtttgtgctcctatgataatctaatgctgctgccgatctgacagaaggtggagatcaggtggtgatgcatgctcgcaggcccctcaccacctgctgtgcagcctggtcgttaacaggccacagaacagtactggtccatggcccagggttttgagactcctgttctaccttatataaagatgataacacgaatttgatgttagataaggttgttcagcagactttttctgatgaatctcacttaaagcatacatggactaaatggaaatatatcataaacttaaaatcataggttataatttattcatcttcccatacatttatccaatactttatttaatttctactgtgtctaaagaactggtctgggttttctgagggatacagtggagaataagacgcgtgctgtcctgtaagaaatgtacacaaaaaatgaatatcgttatgtttaagcattgtatcctgtaaataaacattttcctgtaaataaaaagaatgtaaagacttatacactggagaaatagattctcccaagtagttcacaaaagtatgtatttttaattcaatctttttgtgtacatgctcacacaaatactgactacacatttcttatcatacatagtaaacatatatctgcaatatgtttacacacacttcagtacactgtatagaaaatactttgtctaagaaacttttcaaaagctgtactttataaaagtgtatccttaaaaagcttttattgttctaatccaaggctcctcaacagtggcactattgacatttgagaatggatagtgatttgttgtgggggaccttcctcttcattgtagggtgagtagcagcatgcatgggctctatgcaccagatgccagtggcatcccaccagtatgacaatccccagtatgacaaatgagggacaaaattatcctcagttgagaatcactgatctaaagtttacaactcctaagtcttccaagaaattctcagtgatgctctttgtatacaaatattttaccttttttgctcatcctcagctttactgcaatttccagaaacgaaagcactcctaaggagaacattttaaatctatgtgtacaatttacgatttatcctatgaaacttcaaaatctgcaaatgaaagttgttaaaagtctgagtaatggaactgcaagacaaacaatgagtttaaagtgccgaagataaagtgagcttccaaagtaccttaggtgtctctgttaatttcaatataaaacttatcccatggatacatgggattcattgtaagggaatacacacatcattgcgtatattgataaaggcaaataaatcatcattagtggaaggaaacctagatatcaatggggaaaaataatagatgttcactgccttttcagctgataaaacagacatgaagtcccttaaagtttataacgcttcagtagatttcttgcaggctaaataactatacccctccaccaaatactagttgtgtgatcttaggcaaatcatgtatctgtttctcagatttattcttctgtgaagaggggtaatgttagcaattacctttatacagggctaagttaattcatgtaaaacacttagaatgaatacttgcattcaatttaacaatcccttcaaccctttgtatttagtgcattcagtggctgagaactttccttgtagagaaatgaaaactcaacagtttgctcataaaagattcgcttactcctttagaaacagttgagtacatgcaagaagaaaatacatgatttcatttactcttacttagtggcagtctgtgagaaagatttcacagatttttcccctcagggaagtagattaaggaaacatctgagaacccctcaagccaccctccgtgggtttctactctttgattgttttgaacatgaccattttcctcttaacttaccctagccggagcattatctaagactgtggttacccacagctggaaaggtaagagggccaagatgcctgagatagctggaagggctttctgatcctgtaagaaaaatgttgatttctgaggaattttaaaactgcagcctaacctcctcatgagactggttcaggtctcttgtcaatagagttatcctgttttatgatcagactgaacccatcctctgtttgttgtttggccttgctgggatgtttcatgactactctgcagttcttatcaacctcctttagcatactcatgaagcatcctagctaggctaacaggcgggaaattagaatatggaagacactgcttagaaacatattacatttaaatcacagttcaaatatgtgatcacctccagtacacatgtgcacacacacacacacacacaaaggcagctttaagagattctacctcttagaaggatggctgctagaagtcataataaggatagctttagggacagagtcttacagggacagggtcctaggtatgaatttgagaggttatacctataataaatagagacttagtatgcacaagacgtactaatgcccaagggacatgtttttcctagttttataatcaggataatttcttcaatctcttgggttctgagttacccttctgttcaggaatctggtatctccctttgtaactcattcaattaaacacatttaacaacaacaacaaaaaaaaaggtgaaggtagttatttttcaccaaatctgttcaccaaggctgttctgatttatcagctctaatttttctcatgtaagatctaatttttaaacatctgcacttttcaaaagtatcaatgagaagtttcctatgtattcatcaaaactttacgtctttcctctcataaatgaagttaaggttcaggtcttttctttaatattttatatgactttagagatggctactctaaatttgctccctatcatatcctctgttgagaacatgtgcccactgatcctttacctaacggaggttgttggatgtaatgagcagcaagggcctcatacagacttcagtttgtgatgcgtctatgaaatctttaatagccagaatcaagagagaccggaaaagtcacttaaaagaattgataattcaagaaatgaaatacagggctttttaaattttaaatgatgtgaaacccatgttagtgaacttgataagtgtatagcaaacaagacaataaataaataagagaatagatattcttggatatactgatagtattattttaccatgaaagcaacagattgctttcaatagataatattgatcctcatttctaatgacatgagaaatacttgctccaagtgaatctgaaagtatggtctttgagcgccatttctataatccaaatactctgtttaaaggaaaaggaagatagaggatgagagtattttaactgagcatttattttgccagtctctgtaataagtgttttccaattattattttatttcatccttacattcttccagatcagtattactccatttgttgatggaaataaagctcagagaggttgattatatagccaaaaattgcacagcaatggtaagacatttcaaattgttgcaaagttaaaaagaggccaggcgcagtggctcatgcctgtgatcccagcactctgagaggctgaggcgggcagatcacgaggtcaggagattgagaccatcctggctaacacggtgaaacctcatctctactaaaaaaaatacaaaaaaaattagccaggcattgtggcgggtgcccgtagtcccagctactcgggaggctgaggcaggagaatggggtgaacccgggaggcggagcttgcagtgagctgagatcacgccactgcactcgcctgggcgacagagcgagaatccgcctcaaaataataataataattattattatgctgtgttcagaagcctccaaggaagtacttttaatgttattaatggttttgcaaaatcaaaacaagtgggtagagattagtggtagggagaggacgaagcagagcacttagtggtttagagtattttgctgttggcaggaagtcaacaatttgtataaagattgagtagccctgacatgggctatggagagctgtgaaatgacaggagtcattacaccagaatagcaaatggaattcttttagaagttggctcctggttgaacaagtggaagacagcaacattttcagaagtcctgcagacactagtgccgctgacataaagaacagtgtatcaagtggtaacaaatagaaaatatatgtggagatatttgtcttttcaaacacatggcacaagaccaaaaccaagtaactgttattggaatcatcattgaaaattagggacataaatatttaaaataaataaataatacattcatttatttcattattaaattggtgttattataactacttcacaaccggaacacctaaactttggatggtgaaatgacacttataaggcaacacaaaaattaagagaagtacatgggaactccctgccaacgatgtataagtttgtttcatctggcatttgccaacttgagtggcaatatattgtttctctcgtagatgtcacaaatgatctagtgagataaacttgcattagctctccaactaaatagagtatgtggctcaactactgcctcccctcccagacacacgtgtagaacccacacgtacagcattgcctacactcaagagtctaaaatccattcctagaattagattttcttaattaaacaatttgtgtaattttaaggatcttgaaagggcgtaccagtctatacctcatgtgcgtgcgtatgtgtgtgtgtgcgcatttggtgtggtgtggtgtgtgtgtggtatattccttttttgttctgttaatatggtgtatcgtactgatgattgattttgaaattttaaaccaacctagcatttctaaataaacttcacttggtcacaatatattgtccttaacatatattgttagatttgatttgctattttgttaaggattttgtgtctacagcgtatttatgagggatactggtatgtagttctattttatttagatacatttttctggtttagaatcagggtaacactggtcttatttaagttgcagcgtattcccttcttcttgattttctcaaaggataatattggtattacttctttcttcattgtataaagttcaccaaaaagccacctgggcctgaagttttctttgtgagtcagttttcacttacaaatttaatgcctttagctgataaaaggctgctcaagttttctatttctcctttcatctttggcaatctgtgccttgcaaaaagtttgtccattttgtacagtttgccaatttattgtcataaagttgtcaaaatattattcttctaatgcctgaagcatctgtaatcatggctcttctttcattcctaatattggtaaattggttattcatgtcttctcattcttttcttattttttatttatttatttatttttttgagttggaggctcgctctgtcgtccaggctggagtgcagtgctgtgatctcggctcactgcaacctccgccttccaggttcaagcgattctcctgcctcagccccctgagtagctgggattataggcgcccaccaccacgcccggctaatttttgtatttttagtagagacaggctttcaccatgttggcgaggctggtctcgaactcctgacctcagatgatccaccgacctcggcctcccaaagtgctgggatgacaggtgtgagccactgctcccaggcttttttttttttttttttttaatcaatcacaggagcaattcctgtgaactaatagggagaggtccaggtagagctatctgattgcaatgtaattctgaccctgagtgaaggaaaaaaggaaggaagactggggaagagtcccatgctgtctcacagtccaaggaaagtttggtttggcaaggccatcagggagtcattaatcaaaaaccagctgtcaggggagtcccatttgtctcccaaatagcaagccttagcactaagtcatgagctaggtgcagcccgtaagaactgtggcttcccttggtgtgatcatggagatttcaactagcagcagctaaactccctatagaaagaaggctgggaggcacattctcatggctgccacattctctcctgtgcattcttaacatcctacattttcagtgccttcctgactactccagctcacaaagatggccaggcagtacttattgaatgaatgaatcctctgaattccttagcagttaatagtctctggcttatatttgtcatttgccatatacagaattaccttgtattctagttctatttttacatttatatatccaggttatattgaaagccttgcttcatcaagattattttaaagtacctcaaaaactttattaatttgttgattagcaatcttcctaggtatgcacaaaaggaaaaaaaataagattatgacaacttccagcaataatttacttaaaaataaacagcttaaagttattaagggcatgatatggaaaatgtcacttatctatttattcaacaacaaacacttatcaaggatctattgtgtgtcagccatgtgctaagtgagtgtctcaccataaggaataagacatataagcagtcatcattttgcttataggtttttgatacagacacacaataaacacataagtacatagacaaatatgtagaagcgctagggttggaaaggtaccaaatgatagccccctgaaattttatttattctatgtaattggttagtattacgaaattgaagcatgtttatatataaaagataagcttaagataaattgtcacaaaattcaaagttgagaaatcagtaaataatggtcacatttcccctccagatagagaaaccaggctatcttcttcaaatatttccagaattgcatctgtcacagagcctttgtaccctacatgagatagagatatctataaagctttaatagaatcagattgatttattaatttatttacccagtctgtttttcatgcttcattacttagttccgggaaacacaaaggtgaagaggacatattccatattcataattgtttaaccacatgagtgaatgtctaaaggtgacaatttgcttctagtatctagtgtttatttgcagtctatttcttttttcccactatgtcaatactttaacagctgtatatggaatgcttgcaacaaacctggtgatggggaattataaatgaataaaatacacttttctcagcctcaaaaaatgtctgcaattagataataattctaatagaaaatatttatgaatctcctatggatatcttatacaactttacattgtagtctgaaggaaatcaagctttaactttataattgaaaaatttctccaagttagttatacacagtttactttggaaaactgacatagtggatatgaaatagtttttgtttttcttctaggaaagtcttaatagacatcgatacttgaattctttatttcccagtgaaaactccaccgccttctatggaataaatcagttttcctatttgtttcctgaagagtttaaaggtatagtccgatgttgctatttaggtggtttcctgattttaatttgcttgcttaacttttgataaatatttcattgtaaatctaatatattgagtaatagttaacatttattaagtgtctactaaatgtcaggcatgtaccatgtgctcacataagaaaataaattcatggccagtctcttctaattactgcttaagaaatgaatgttataattatgcacatttccatgtggctataaaggataattgtctaatcacttctgcagttttctagtgctttttctcttcaggacacacatggttccatgggttatgatagaacaaatgatgtcaattatacttatttttattattgacctggttctatcaaacaaatcattttatgtgtcaactccagccttattgtaggaattctcttttgtagtttttaatgaatgcattttatgttatagaaaagcacaagagaaaatctaaaatagcaggtctactagaaggctactgtttcttctttaaaagttcctcccaaagaatctcaaggatataatataatataatattggttgtcttttagtataatattggttgtctccctataatataatattgattgtctttatatataacaaatatatatgatatatataatataatatattgtaatataatattggttgtattttcattttatgtttctactcagccatttatttaagaagcaaaccttccaagtttcccagatactcagcagaagtacatatgtccatccccaatgtgtctttgccgttaagatttgactggagggacaagcaggttgtgacacaagtgagaaaccagcagatggtacgttgaaatccctcttcttttctaatcatctaagcattgaaaggcagctttgaggtcaagtttaatcaaagttgtaatggaaacatcatttctctaggaaaatcacatctcagtcatccaaaaatgacaatgaaaagagaatctctggaggaatgagagtcaaatgtcaaagccctgacttttatttctgaagataaaccttccttgctgtgtactcttactaattgccattgccaccaacacaataactcagggatacttcccagtagctgtaataacagctcagggatacttcccagtagctgtatcacagataccaagctttctgtacaatagcagatgagaggctggagaaggtaaacatgagcactaaaggcttaaatggttcaagaaaaaaaaagtgaaaaagtaaaatgaaaatggatacatttaccaacagtgtggccgaatctcctgggttctcaagcctcatcttgcaagctctgtcagaaaatctgcccccgtcttcacaggatcatatacctttgaatctgtgggccttaaaagtatagttagtagtcagttcagccataacgtgacgcatacattccagaaaatcaccacctatgcagaattgagcagtagcatgacagggattatgggagaaatgaggttaggttacactacctacgagcttagtcaatgacatatgttttaaaagacagaaaactaatagacacagtagcacagttttacacatgtttactgattaagaaatatgtaagtactgcaataaatatagcaatttaccttgaaaagagactcaaagtgtgctgaggacatgggagttggcagggcagcagcttgtgagttattctgaagtggtggaaggaggtgcctttgaactaggaaggaaagtggtaagagcagatgtgggtgggtatgacctataatgcatgtagtgaacccacctagctggcagacgtttgaggggtgtgtgcatactttgctgaccttccctacccgtctacactcccaactgttggcatagggaatgcctgccaaacaggcaaagtcaaacccctaaccagaggggatagtctcagtttgtctgcagtggaaacctcaacagatcattcagccttcccttttatggaaagtgttttggtgccagctgtttcgcagtcaatgtgtagttagaatgatttttgcttctcagagtctatatttatttttgtacattaagttttaccaccaaatcatttgctttattattggatttgtaataacatgtcaattagacataaatctaatcctttcaaaaattgtccacagtgtattgaagagggaacttttaattagagatctttaattaaaggaatgtatgagagactttttttttttttaagcaggaactgcccttgtggcttgactaaagctggctataggggtgatgtcagcagcctgttaccttttctcttttttttttttgagacggagtctcactctgtcacccaggctggagtgcagtgatgcgatctcggctcactgcaacctccacctcccaggttcaagagattctcctgcctcagcctccttagtagctgggattacaggtgcgcaccaccatgcctggctaatttttgtatttttagtagaaacggggtttcaccatgttggtcaggctggtcttgaactcctgacctcatgatccgcctgccttggcctcccaaagtgctgggattacaggcatgagctgccctgtgttcacctttgtcaaagtttggagaccctgctgtatggtcacttagtgagtgtttttactatgccataggcactagagatagagatataacctttaaaaaagcacttaaagccataaagttgctcaaaacttaactctgcaaagatatccaattgtcattccttttttttttttggtctaactctgccacacatggccctccagttatgttagtttcatccagtctcaaatcctactctcttctgccttttctgtggatccttcttccttttacgtgatcctacgatccctaatttcattccctctgtctcctctctttctttcaggactagttcttttattcttttgttctagtttgttaagtaaaagcaaattaagagatccactatcagcatgattggcagccaatactggagtaatgactaatatggatttatatccttaggacatttcatgtacatccactataagcatacttaatcgggcatctttatagcctaaagagtaattcattaatatttattaattctcttatctccatcaaataattagcacaacatgcatctttcccctcctcacccttaggatggaagtggtgtatgaccatggaagcagagtgtccttaaaaaagcaagggggatggaaggttggggcgggagtcggcacacactctccagaagaaaagccacttacaaagagaagtcacatattcagtgaactgaatggtcttttagaagatcatcagttagcccaagtatttcctcggtctctaaaaattcacttttatcttgcattgccaaatttagaatagtaataatgctgacaacatgaactaataattaaatgatgctcaaaagagacttttggttttctctttttttcagtttaaaaatctagaggataggcgtatttattttgtaggtttccagaatctggaagccttacttgatttgataacttgttacatttagagatgttggtaagttgatttaaaccctggaaataccacccctttttctgtttttaaacagtgtggaggatgctgggccttcagcgtggtgggggcagtggaatctgcttatgcaataaaggggaagcccctggaagacctaagtgtccagcaggtcattgactgttcgtataataattatggctgcaatggaggctctactctcaatgctttgaactggttaaacaaggtgactagtctctcaacctcttaaactctttatttccttttttgcttgtttactgtgtgttcaaaattcaaacagtttgttcacatatattaaataatgtttccacgttcggaaatgtagatgatcaaagcatgaagtaattaatcagaatatttaaaaatgaatcacttgtaggcaaagcagttgtcaagaaatcaaaaggggaaaaatctgaagtctgtcttcagagaaatatttatatttatttcttaacatttcttaatatatacatgcttttttgcagatctgaatatctcataatatcccggaaagatgagaatatattttttttattttcatagaatttctgaatgttaaggttaaaaggaacattagagactaattttttagctcttttttgttgttgttgtttttgagacagagtctcactctgtcacccaggctggagtacagtggcacaatcttggctcactgcaacctccacctcccgggttcaagtgtttctgctgcttcagcctccggagtagctgggaactataggtgcccaccaccacacttggctaatttttttgttttttttgttttttgttttttgtttttgtttttttagtaaagacatggtttcaccatattggccaggctgatctcgatctcctgaccttgtgatccacccgcctcagcctcccaaagtgctgggattacagacatgagccaccacacccagcctgtagctctttttatagatgaagaaatgaagcctgagaagtgagatcattttgtcaagtcagtagctgagccggagttgtaccttcagtccccagcctctcacagtagggctttgctcagtataccccagtgtccctcagcgttcttagcacttgccctgacagtgtcccagatccgatatcaactgcatgaaatttgccaatgagggtgctattagtttctgtagaacgtcatcaaaccagagttccccaaacctgaattctcttccattatccattggttgcatttttaatcacgtattccaggacctgctctgtacacactgtagacgacaatgaattatgagtctcctccctttcattagcctagcattcaaaaagggagggttttgtacagataactatgaagtatttgacatatgctatatgaatggcataaaagtgaagtgatagaaagaatgcttggcctaaccgttgcctgtgtataaaccactggatggaatctgaaagacttggcagaaccagaagcactgggaggaaagtgagctgccctatagcaccgtcaggagaaagatgacaagactgttactagatccatggaggatctacaaaaggatgctgtaagataaagagaagtaagggagaaggaaagatattgactccaaatgtctagactatccagaacaagcacctaaagatttaatttataatattaaaaacccaaagtataggctgggcacaatgcctcacacctgtaatcccagtattttgggaagccaaggcaggtggatttcttgagtccaggagtttaagaccagcctgggcaacagagtgagaccccatctttacaaaaaatacaaaaaattagcctggcgtggtggctcatacctgtagtcacagctactggggagacggaggtgggatgatcactggtgcccaggaggtggagattgcagtgagacgagatcgagccactgcactccagcctgagcaaccaaacaaaactctgtctcaaaaaagaaaaagaaaaaaaaaagaacgcaaagtatatccacatgatgaaggtgtgtgaaattgaacctgttttgacacagtgaagtaagttctatttgatttataaaacaattgacagtaaacatgttcagtgattgttttcttttagatgcaagtaaaactggtgaaagattcagaatatccttttaaagcacaaaatggtctgtgccattacttttctggttcacattctggattttcaatcaaaggttattctgcatatgacttcaggtaaagatcttattgtattatgtttttctttatacatttttaatttatgatctattgactggttaataatttgtttgaaggcatcactgcatactcttaatccttgtaaaacatactttttactagaaagagtagcaattacaatgaaatgttgtaaatgttgtttcttaattataatctacttattttcccaagtgtcattacgatagaaatgaaaaattttaattctgtgtaaggtacaatttatatgtatatttatttgttatattttatattttattatacttacaaattattagtgcataatttatatttatatataccaccttcatcttatcaaatttaggtgttatattaccattagcatatttcaatcttaatggtgagtccatccagaattgctttgtacagactgtgcagctaatatcacgtaggctacatatcaggaagcatattttgaacaccttctatgttctttgcatttttcaagacatcagccatttgaaaaatataacacaaaacttcagattagagaaaagagggaagcatatactactgaagataaattatgtagcatacactataagcatgatgggaatgtagggatagataaagacaggctgaggaaaaggacttgtgttggaactgaagggcaggataactttggatagttttggggaaaacaatcattaaaaatgctttaaaaacacatgaaaaacacagagctggctggagactcatcatgaccatttgatagagtgcaaaataggtgttcatgggtgaaaaggacaaagggagacccaaccaactcctggcttcattaagaaaatatatgatgggaactttgcagtcttttgaaacagagaaaacaggaactaaattaaatttggataaggtaacagaatcccctatgacttagtggtcctgaatataaaataatcccttgatccagatggtatctacccatgggatctgaaagaaatcaagggtgaaattgcgtccttgaacaaaatgtacccgtttaaatgagcataagtgtgccagagaactgtcaggttgtcaacacagctctggtctgcaacaagggtcctcagggtgacaccaggaaccatacaccagacagccttaattccacagctggcagaccatgtaggatttataataaaatgtgcagggtcactgagtaccgtggtcaacatctcatttggggataaaggtaatgtgctttctaaaatcagaaagtatgccctataaactctgacttccttgagagtataagggaaggatgtgtacaagaaaaaactagatttacaaaatatcattaaaagggattaagggaatcccttatcatggtaggaaattgaaaaaaaaattaagaagaagcaaaagaataataggcattagtctgaattaagggaaagagagaatgcaggagttgttggcattgggcctttgattaggaaggaagaggtcccaatcaaaatctcttgtttatattgaagattaaactctaacagtgcaatgctaaactgatagcatttgactgcaagaagatctttctttgatttatttattcattcaaatatttactgacttttttttaagttctggggatttggcagagaacaaaacagacaaaaaccttgccctcattagtaattgagacagacagtcacaaaaaataaaaatacatgtggcatgttggctgtaataattaacaaagagaacaaatgaaaacagtgggaggaagagaaacgatctggtagtagggggagtgtacaatttgagaaagggttgcctggcagggcctcactcactgaaaaggttatgttcaagtgaagacttggagaagtgcgtggacttaaccacgcagatatgtgggggaacatggttccaagcagagaggctgtaaatgcaaagatcgtgaggcaaaaacatgtctggcatgttagaacaatgatgaagccactgtggctgtagtgtggagaagaaagacaagactagtaggagatgaggtcatactgtccctgtattagtctgctttcgtgctgctgataaagacatacccaagactggaaagaaaaagaggtttaattggacttacagttccacatggctgaggaggcttcagaatcacggcaggaggtaaaaggcactacttacgtggcggcagcaagagaaaatgaggaagaagcaaaagcgtaacccccgataaacccatcagatcttgtgagacttattcactatcacaagaatagcatgggaaagaccagcccccatgaattcaattacctccccctgggtccctccacaacatgtgggaattctgggagatacaattcaagttgagacttcggtggggacacacccaaaccatatcattccatccctggcccctccaaatctcatgtcttcacatttcaaaaccaatcatgccttgccaacagtcccccaaagtcttaactcatttcagcattaacccgaaagtccacagtccaaagtctcatctgagagaaggcaactcccttccgcctatgagcctgtaaaatcaaaagcaagctaattacttcctagatgcagtagggatacaggtattgggtaaatacggccattccaaatgggagaaattggccaaaacaaaggagttagagggcccatggaactccaaaatccagcaggcagtcaaattttaaagttccagagtgatctcctttgactccagatctcacatccaagtcatgctgatgcaagatgtgggttctaatggtcttgagcacctctgcctctgtgctttgcagggtacagcctccctcctggctgctttcacggtctggcattgagtgtctgtggcttttccaggtgcatagtgcaagctgtcagtggatctaccattctggggtctggaggacagtggccctcttctcgcagctcctgtgggactctgtgtggagcctccaaccccacatttttcttctgcactgcgctagcagaggttttccatgagggccctgctcctgcagcaaacttttgcctgggcatccaggcatctccatacatcttctgaaatctaggtggaggttccccaatctcaattcttgtcttctatgtacccgcaggctcaaccccaaatggaagctgccaaggccacagcctgagctctatgttggcccctttgagccatggctggagcatctgagacacagggcactaagtccctaggctgcacacagcacaaggaccctgggcctatcccacaaaaccactttttccttctgggcctccgagcctgtgatgggaggggctgccgtgaaggtgtctgacataacctgaagacattttccccatggtgttggggattaacattaggctccttgctacttacgcaaatttctgcagctggcttcaatgtctcctcaaaaaatgggtttttcttttctactgcatcatcaggctgcaaattttctgaacttttatgctctgttttcccttttaaaatggaatgcttttaacagcacccaagtcaccttttgaatgctttgctgcttagaaatttcttccgccagataccctaaatcatctctctcaagttcaaagttccacaaatctctagggcagtggcaaaatgctgccagtctggttgctaaaacataacaagagtcacctttgctccatttcccacaagtttctcatctccatctgaaaccacctcagcctggacctaattattgttcatatcactattggcattttggtgaaagccattcgacaagtctctaggaagttccaaactttcccacattttcctttcttcttctgagcccttgaaactgttccaactgtctgcctattacccagttccaaagtcacttccacattttcaggtatcttttcagcagtgccccaatctactagtaccaatttactatgagtccattttcatgctgctgataaagacatacccgagactgggaagagaaaggtttaattggacttacagttccacatggctagggaggcctcagaatcatggcgggaggagaaaggcacttcttacatggtggcggcaagagaaattgaggaagaaggagaagtggaaacccctgataaaatcatcagatctcatgagacttattcactatcacaagaatagcactggaaagactggcccccatgattcaattacctccccctgggttcctcccacaacacatgggaattctgggagatacaattcaatttgagacttggatggggacacagccaaaccatctcagtcaccaagcagtggccttagagcagggtgttaggagaatggccttggagatgagagatgaggggtatgtatagattaatacccctcacagagggtaaagccctacacagttttttattggagaggagataagagagaagagagtctaggaggattcccggccttttgatctgaatgactgaaaaatagaattaccattaatgaaacttgaaagtctaagacaggaacagatttagaaggaaacagtaagagttcagttggaacacctaggaagtgatcccaggaaagactggtaatggggtggggaaatgagagaaccggggcagcagggtttcttgattaaaccagttagtgctgtggctaacctcatgcttagtcctgctggggaactctggcagccagggtaaaatgtacacttcagtgccatcccatccaagttggtgattgtcgtcttccctgattcattagttgagggtgcatctggggatggaaatggggactgggcttgctttcctggctctaggaggaaaagggctcagggaaagaactgcaggatctcattgttgcaagttgggtgagtgtgcattgcagtggtgacagccttaggatgtgtgaaggtcttccaaagcatttgctataactgggcacaagacctggtcctttgtacttcaataatattatttccatgtatggtggatgcctgagactcagggagagccatatagctagtaaactgtggagtcggattagaactcatatctgttcaactccaaagcttgtgcttttactcccaacactattggtaacgtcatgtggtcttaggttttcagccaaacgctccttaaaacattgtacagaacctgaaagcatctaagaagggaaaaaaataatctaaaatataaaaacataacctaattttaaagcaaaatgaccattcccacccagggttcttcatgaatttttgtttatcagaccccagaaatttcaggactcaaactagaatatgagaatgactatgtaaataaacaaaaactgtaggaacctactacatataacagtagtcagaaaaattcagacacagtataacacactgaattctagggaagatgagatgaaaatccacattatgaagcgtcagtaacaggtcagacttgccttcatcgccgcatcttgatgacaataaaatttaggaaaattatttgaactattattattattccattcattataataataatgaataataattataattcattaatcaatgattaataataattataataataattcgttataataataacgaattattatttccaaaactgtaggttttggaaattattaatctgtgaaatgaatagtaagctcatggaatcaatgtttgataataaagccattataacaatgtacatgttgatagtagttctatattgggttaataatggaaattaaaatgctgtctggagcattatttgaactctctaaaagctgacatctttctgaaagacaaatgatagcaatgccactcaattctggggccaaatggaacatttgcctctgcttatgactgaggcttgtccttctatttcttacttctaatctttgatatcttttttcagctctggcccaaatcagggattattactaaattgtttctttgattctgcaatgtcagttaccctttgcattctaaaaatattccttcttcttgatctttctgcttttctcctggtatccctgaaactggatctttgatgagatgaacttccagtaatcctttgttttcttcaattgatggagacggctgtgttctggttgatagaaagattattatatatatcatgtttaaatcatgaactatgctaagaattttgatacaataagatatactttatacactaaatcctatggggaacacaattagttattagataagttagaaatgagggaaataaataatccttattgtaaacttggagtaaaacttatgtgctgggcatgctacataatttatgtcttgcaaaattgtatgccataattttatccttgtattgattctgcatggtaggttgaatggctgcagtgtatagttggaatttgaacccaggtgtgggacaattaaaaacctataacctatcatgatgccttttaaaaattttacaattttgcctgtctcaggataatcttagttaatatgaactgttttacagtagcaaaaattagaaatatctacttatagatctcaaaaagcagatattcatgttaatagttaacatgaataaatgtataaaatgaatatatagtttctatttcaatcaattccattattatgcagtcaactttttgctcctctgtggacaaaatattccctctctagaaactggtctccagctggtcgtcatgaaagattatttacttacttattagtggattattaccactaatccacccatggcttgctatagcagtaaactatcaaatgttatcttaatagtttgaactattaggaacttggtttcagtatccttcacccacaaagctgacctttgaaaagtgtaaataatgatttgatcactcacttgtaagatcaatgaaggacaaatgttgtataatatgagactttatgtccatgtgtgaaaacaataattgtgtattttgcagtcttcacagttgaacacctagttctccgggcatcctaacatttcttctctttttaaaatatttgcttaacattgcttctattgtataattatattagccacttttgagtagcccttccctataatttctatatttgacaatgactaacatgagttagtctcttgattctcatggtgtggcagagatggcaaggtatcgccaaatatctagtctttccactttccttaataaaagaagccctatgtcttaactaattttccagccagctacagaactcattccccatcttcctttaagctagacttagccatatgactgagttctggccaatgagatccgtgaagatatatgtggaagtgttgcgggttatttctgggaagtcttctcaacagagatgtatcacttctgctttctacttcctgctgtcttaaatatgtgttaaatggctggagtcccagcaaccatcttggaccatgaatggaccctgaaaatggaaacctttgaatagcaggacaatgatagagaaagagcttgggttcctgatatcctgaaaccctatcccagccatagactaccagtctctcagacttagcttccattgtttaggtcctttgtaactgcaaccaaacctactcagaatcatacacagattatatagatcattgttatttttaccttaaaaactaaattttctaaccaaatatttcctcttttggtagtgaccaagaagatgaaatggcaaaagcacttcttacctttggccctttggtagtcatagtagatgcagtgagctggcaagattatctgggaggcattatacagcatcactgctctagtggagaagcaaatcatgcagttctcataactgggtttgataaaacaggtaagtgctgataagactcagttgactgctttccagcatggacactgagtgcaaaatgatcaccatactgtagaacattgaaatttggttctgctatgattaagtcctcataagaccttcacaacttctcaacaatcttataggagtaaatgtgccgagaccagctcagttgtggagaacctaacccagcggcgctagaggaattaaagacacacacacagaaatatagagtgtggagtgggaaatcaggggtctcacagccttcagagctgagagccccgaacagagctttacccacatatttattgacagcaagccagggataagcattgtttctatagattatagattgactaaaagtattccttatgggaaataaagggatgggccgaaataaagggataggtctgactagttgtctgcagcaggagcatgtccttaaggcacaagattgctgatgttattgtttgtggcttaagaacgcctttaagcagttttctgcccagggttcggccaggtgttccttgccctaattccggtaaacccacaaccttccagcgtgggcgtcatggccatcacgaacatgtcacagtgctgcagagattttgcttatggccagttttgggaccagtttatggccggatttggggggcctgttcccaatgtaaatgtcttgtcagattccacctgtcaatttttgagtggatatcctgttaaaatgatgataatttttgttgatataaaactgtatcgggaacatttagaataattgttgggaaaaggtaagtgcatattattttatcatacgtatctaaaagttcttttttctttttctgattccttggaaattagtgtttgttttcattttatgcagtccctgtataaagggaagtgaattcaaacatatatttctactgattggagagtgtccgtaagtactgctcaggtttacttagttaaaataaagtagtttaagttaccattaaattacatttttaatcttcttctcagagctactatccttagcaagaatccaacttaaaataaagaaacttaaacattcataacaaatttgagttttcaggatttgttactatttatgtttcactgtaggaagcactccatattggattgtgcggaattcctggggaagttcttggggagtagatggttatgcccatgtcaaaatgggaagtaatgtttgtggtaagtcatgagtttgtgtttaaaacctcaatataaatattaaggagattatttgaatattttagagttacaatctactcaaaccactttagcagtaataatttttgtcctttaaccaaatgataaaaaaaaaaagtgttttgcaagaggaactgttaaacatattagtatttgaaaaaggaagagggaccttagtaaaaaatatatattacatatatatctcaaaacataagataaagtaataatttaccaaggttaattgctttaaaaatgagataaacacacagcttaggagactggactcctgcagaaatgtcttcttgttccaaatttacatttcataactataaatttttcttaatttctgtattataatatctgctcaatgattatcaagagtttttctttgttttaaaatatacgaaaactaagcattagtattgtttgtgatttaatatgccccttgccacctacaaaattctagcaaaacacccactagaattgagaggcttaggcaaataccaaacatgcttttttattgagtgacaacttttttttttttgagatagagtctcgctctgtctcccaggctggagtgcagtggcatgatctcggctcactgcaagctccgcctcccgggttcacactcttctcctgcctcagcctcctgagtagctgggactacagactcccgccaccacacctggctgattttttgtttttgtatttttagtagagacgaggtttcaccgtgttagccaggatggtctcaatctcctgacctcgtgatctgccctccttggcctcccaaagtgctgggattacaggcgtgagccaccacgcccagcctgaaacacaactttttaaatgaaccaccaaccaaactaaaatagctagttaagaattttaaccgtgttataaaactatattcaaacctatattctaaaacttttggtctaaaaatcaacatattttctgaatcaagctagacccaaactaagttacatattagagcaatcatgtcatttcttattataatttgttccaacatatatacaatttttttaaatgcagaatctttcagattatgagactgattaaatagttacagaaaaatttgaaagtttatgttcaatgactattaaccaatcattccataaggcagaatccatgagagttcatgagtgatctgttctatcaccctgatgagacagtttttataagttattcattgaaaaaagtcaacatcacagaaatatattggccagaatactagcaaccccatcaggcctccacttttcagcatcactggggactcgtacatctttggaacttgcagataaatgactgatgctaatcattaacccttgctgctgaacatatattatgtccgactgcagcagtggtggatcctggatttgggctgaggggtgactgctttcaaatctcttacaggagtgttaaaataacataattcaaatattggttcataattgcctcaattataactacgtccctcaccacaacctttctccatccctcagctactaagggtgagtggagataatttctgctctctacctgctttcataatgtaaatctttaagggcatgcctggttggtaatcatacagggattcaaattcttcctgaaagtgagtattccctgaaagttacaatgatgtcatattactcttatgagcaatggcataaggcagatagtatttcatagctgcaagagatttcgaagatacggttagttataataaaaaccagtcttcagataggctatttattgcttttgccatgatgttgcaatctgtgttctcgtgtgtaaagaaagcatagcacactcgtgatttattaaagttttacccacattcaaattttagaatttgagttatgaaattgtatttaaaataatttcttaagttattttgcctctaagaaataatgtattagtttaatacagcttccagatgcattcatttattcagttaacaggtagtttttgttgtggatttttaaaatctttaaaattattttagtttcttcaaacaaaaatattaggcatacttctaatatgcctaatctcttctaatatctgcttttgatgataccatgtttacattgacaagctgtgataagcattacattattttctcagtagatactctttctgaacccaaatgaaaaattgctttaatttacaatttcaaaagcatctaaagaggaaatagactaataattctttttttccccttaggtattgcagattccgtttcttctatatttgtgtgacatgttgggcagatcaagagacagctacaaaaatgaaggttttcataatgcaatgtaacatagtacttcaaagtattattcaacttcaagtttcagcaactacctacaaaagattctaaggcctagtagtatttaaactaagtttcagaatgttcccttcttgtagagagatggacaaccaaagtcagtgggacaaactccagcacagaagcctgcgaggaagcctatggaatagtttcctgtcctgagacgaaattcagattaggagatattttaggcccctgcaactggggaaggctactgtttgtttttgtttgcttattatttatttgtttgtttattgtgagatatttcaggtgggatcaaagaggtcataagaatttattttcttttgtggggtgtaactactagctttagattacccctatacacaagaatggccaacctaaaattatgtgtgtcttgtacagttagttatattagcagccctctgagatggcgtatctatcggaaggatttcaaacaccaattgctttacctgaacaaatggtgcttaccctttgaacagcagagtgaccacgtagaaggaaggaaaagggcaaaatcgcttcagttaaactgaaattaaatgaacaataaggcaactatataagtaacttctagtagcattgcctgagagacaaattattgtttgataattttcattgtgaataggaatccaatagatcatattgcttactttgttctttttatactatagaataatattttgttctctagtatatcaaaataccaaaatattatctcatattttctccctctttctcttactcttaccaagttttcctggtggcttggcttccctgactaaagaattaagtctcatttttactttccatttctattttcttaccacttggttggctccctttgtctctgtacctttaccaacattaggatctcacctctttcttcctcccttaattcataagcaccactcctatcaaagtcccatctcttaaccctgggtatcaaacaaactgtgagttttccagaatctgtttcccagttttcccctcagctttcctggtctcccatctgaactgcttctttgtgcacctcttgttctttctcttggctcccagtcttgattcctgtgatcactcttgcatcactaattgcacaagtgatttcaggtgcaattctgattagcctgcgtccacacagtgatcgatgatcctatgtgcctagaaaggacactgtgtgctgctcatgacctgcaacaggaaaaaagccatttcttgttagcagtgtaagaaccttagagcaaaggagttgaccttctgattgaatataagcacaaccatattaaatgaatcaatacaagaaaattatttctgatactatgtatgtacatatttcttctctaaaatgtatcattcttttctaatgtatatgatctaacaaaaatgaaacatgaaatgcagtagcaaccactaaaaaaaaaaattcaaggacatctaactttttctctcacttttgccctttgtttatccttccctgtgattagataaacaaaataaaaaacaaaatgctgtatttctcttcttacgccagtcagaaccaatccgaaaagaatgtgtgttgactcaggtttggagttatttcaggaagacagatattgaccttttaattgataaatattcttattatcctggaatgccagaaaagaactatgtcctgcttgtctagtttgtattcgctgactttctatgtgatatagatgcatttgtaatactctttttcaagtgctaaaggatttctaaaatttcaaactgattaatatgtttctgctgttctggattttgatgacatttacaataaaacaacctacatttgactttggtttaaaaagaacctcttcttaagtgtatggcttacattttgtcaacacggtattaatgtgctttatatttacagttttctcagctctaaattaatatatccagcttttggttttctccataggcactttaacctcagtgtttccgaaactccattcgtcatcctccctaacttctcccaccacccccaacaaaaatttcctttacctctaagagcctctattttggttaacagaatcaacattatggaatcacccaatcaataaaattaagacaaatcctaaacatttaagcaggtcatctgcaccttggtaacccatcaatgaattacctacctcctgtggctactgtcatttcttagttgcatgttctttagtgtcatttatctccattattcagtagcctactcattattctctatgtcccttagtccagacccaaagtctggtgattcagattgatgttcttatagtccatctactgtatttcccctgcatttacatttctcaaagacgttatcagtttctctgttcacaaccgttcaagggctcccaatgccttatgataccatgtgagctcttttaagtgagttttcacgaagaagcccctctctaccttttcaaccgtgattgctgctgtgctgcatagtttgatcactcttatgctgtgatccagccataacaaactacttgaagtcaaagcaacaaaatcctcacctaataattagaagtcataatgaaagtcatcaacgtgtttctggatgtggtttcacaaagatctcaaagtgaatactaaattagcccaccttacagtgattttctagcccatttaaaagttataaagtgggtcatcagcactagaagcaagtgtgactggggagggtgggaacttgcagtctaaattattttgatatttacatgaagaatgactgatatatcctttgataaaactcttgcaacttctagcttagtcacaccaagaaatataggtgtaaagaactaaatataaccatatagtctatgatatggtttagctatgatatggtttagctgtctcttaacccaaatctcaccttgaattgtaataatccccacatgtcaagggcagggccaggtggagataattgaatcatgagggtggtttctcccatactgttctcatggtagtgaataagtctcacaagatctgatggttttataaatgggagttcccctgcacaagcactcttgcctgccaccatgtaagacatgactttgcttctcctttgctttccaccatgattgtgaagcctccacaaccatgtggaactgtgagtccattaaacctctttcctttatgacttacccagtctcaggtatgtctttattagcagcataacagcagactaatgcaacaggctaagaagggagttacagtattggccagggtgattgacctggactatgaagacgaaatcagtctactactccacaatggaggtaaggaagagtaggcatggaacacaggagaacccttagggtgtctcttagtattgccatgccctgtgattaatgtcaatgggaaactacaacggcacaatcctggcaggactacaaatggcccagatacttcaggaatgaaggtttgggtcactccagcaggtacaaagccacaacctgctgaggtgcttgctgaaggcaaagagaataaggaatgggggtagtggaataaggtagtcatcaatagcagcttcagccatgtgaccagttgcagaaatgaggactgtaattgtcatgagtatttcctctttattttgttgagaacatgtttgcacatatatatacttgtactaagaaaatatattcattttatttcctttatttttcctttatcatgtgatgtaagatttgttgacttcatatcagcatttaagtgttaactttaggtaatagcatttggattggggattggtgcacttccagttgtacaaaggatagctgtattgtgttaggtgtaattatgaccttattattggcttcagttgaagattatgtgtgatttcaggagatgtggatgggttcaagttgacaaagttgtgatggttaatattgagtgccaacttgattggattgaaggatgcaaagtattgttcctggatgtgtttgtgagggtgtttccaaaggagattaacatttgagtcagtggactgggagaggcagacccaccctcagcctgggtgggccctgtctaatcagctgccagtgtgaaaggaggcatggagagaacagacctgctgagtcttctggcctccatctttctcccatgctggaggcttcctgccctggaataacagactccaagttcttcaacttttggactcttggacttatatcagtgatttgccatgggctctggggccttcggccacagactgaaggctacaatattggcttccctccttttgaggtgttgggacttggactggcttcctggcttgcagacctattgtgggacttcaccttgtaattttgtaagtcaatactctttaataaactccccttcatatatacatcgatcctgttagttttgtccctttggagaatcctgactaatacagtctattaaaataatgataaacgttgacaaataacatttacaccaatattctaaggcactttggtgacagaatatctattaacacatgtttttcctgggaaatagcaaagcttataaaataagtacttttatccccagatggataggaaactaggcttcaactggtgatagtaccagatagttaataaatggcagagccagaatttgccctcgagcttgttgatttcaaagctagtgccttttagccaccatgccatttgcctctgtattatatcagcctagccaccatcagatactgtgtatacacacatacatgagcacacaacagtcatggagacaaaaacaattatatgtaattctgagacaaactagatgatataatccttataagaccttataagaaaaaacttgcaaatgaaaccaaagaatagttcaattccatcaagaactcactgcttgctagtgataatcactctaggtcaaggttgacatacattttagatttcttaaataatattatgtacttcctcccataacaaaaatttaagttttcccaataacctggccaagctagaaaaagaagactaaaactcatgtctgatctaaactcttagcttagttaatgtcttattagaaatgaactgggtcactgtccagtctgtgtactttcttctggaaagcacatcttctttgaggggactgttccttgcttttacctcagttctgcatgcattagagttcactccacctcccagaccacaggcatgggagctgggggaaagagaagctttgccctgtgtgagtctgatggtgctggaaactgggacccagcctgagacagaagctgttctactgcaggaaagaataaagccaacacctacagagaagagatgagacaaaaaagatctcagaagagtgttccaggaatatagcactccaggaactggacccagtccttgtggcatcagagttttcaggctcctctttcaaggctttttggacagtgttcatttgaattctgcaagctagtaattcttcagtatatcccctctagacaaacttcagatagatttctgtctttggtcattaagattcctaacaaatacaatcaatatttcaaaaacaatacagggagaaagattaatactttattattttaaaaattttgtttgaaagcctttgtacagaataatataatgtactgcataaaatatttgaaatagatgaagtttacaagtttataaagatgaaacaatgagatagtgattacattaagtggttacattaagtctcaggggaaactgaatttttaataggaaaacaccctatgtacaatgttactatttaaatgtattctttctcatcttaatgcttagtcttgtcacaaacaagaggtaatcaaattgtttctagaattaaatcagagcatcgtggtgctgaacaatatatgcatacatatattcaaactgtatttatgaaaatccatagaaaataaaaaataggctgtgaaaccagtattcttcatagattttgcagacgattttaatctgattcatcactgctgaagtaggagctatcacagtattctgctgtatatagaaatttgtgaatggttgggttcatcttcggtatccagtgtcggggaatcaggtatgttgaaagattaaataaatctacaaataccttgtacctatcactggaaaaacatacatgaagatgtgttacattggttgacatgaaatatttaaatttttcaattagaaaatttatttctcagatattttccatagttagtattcaatattataatatatattgcatgttgtatatatcatatattaaattaggtattatgtagtattagtattgattgtctgctttttattccattttcaaagtttatgcccataaaacagtattatgtgttttagaacagggtgtttcctattaaaaccgagagtcttattgctgacaccttcataaagataaagatgtgttctcatttcctacttctgaaggatgctatgcaaggtaatacatttaaagcaaacagtcttagatgctcatttggaaatatttccaactgaaaagatgccaaataactgccctgaagggtttaataaattgaaatgccatcttagactcataataaatgtccatgaagtagttttaacactaaaattgcttttgtgtggttagtcaacaattttaactgttgcagttttatggaggaagaacatttgcctttgaagttaaataaatctgggttcaaattctggttctatcacctacaattcaaggacctttgacaagttgtttaaacttcaatgccccagtttctaactctataaaatgaaaactttagtccttccttttggtcaggtctttttaaaactgagataacaacacactagagatgccatttgtgttcattattcccaccacccactgatgtgtgtgctcatttggtataggcagttatcaactgttttgtgcttacagaattcatttccagggacagtgaaaatgtctaaaaatgatgaaaatttaaacctgtgtatttcagaaaccaaccaatctggtaataacagtagggacgaaagcaatgtgctgtaaagatttgaggtggggctaaatgcaaatgtctaatttattcttgaattgattcttctttttcaagggaccacagaagtttttcagtttcccgatgtatccatttgtccatttatctatgatattgtgaatatcaaaataagaatgtacatcccttagaaacctctctagcatattttaagtcctcaataaatgttgatctctttccttgtaaacactttaaaaggggcactctctggagtagatggaaatagttttataatataaaatagtcatatcagaaaacaagacgctactttaactgtgtcatttatctagccaggaagacattagtagaattaatgataaatgttttagtctggtcaaaacttgagccacaatgagttgaagacttttctgcctggatgtaagcactgttaatccctttgtgtcctcacatatcatgcagccattgataccatatcccttttcatacaggatcaaaacagtgaaagttcataattaaagattttataaaattaccaccaaaagtctgaactggaatattctaactacaaacgtgttgttagtagttcagacaggagcaaataaaatggctttttttagataacaaatgtataggtggagaaacaaattgttggtgactgccaccaggaagaaaggagaatttccccacctacctcacagttgatcgcaggtagtgatagcctgaggaaccaccggtgccagctttgctgcccagcattctgtgcaccatgcacacatggttatctaggcaaacatacaaatttactccatggatatttttccaccattagttccacaatgttctaacaatgaggggttggtaatgataattgcttctgagaaaatgttgacaactaacacttggccatatggaaggctcatacatgagagccagatgagactgtgaggttgcctagcgctccacttgcttcaggctacatgcatttcactccatccttcactgcatttagcccatggatacaatagaagagaccaggatcataatatgactcatgagtccatgccacctttgcctttatggggtccttcatttaaaaaaataaaaaaactattaaaattaaaaatttaaaactgcattggcataatggcaaataaattactcttatgtaataaaacttttatgacctaaagtttaatttttcctttagattttaaaataaaacattttcgtgagcccccaaaagtattgtgggccttaggtactgtgcctagtgtgtatatgaataagttggccctgggagagagtgatggccaagctgatttgtataaaagaatgcacccacacacaaaggagggggaaagagagaaagtgggcaggagggcacacagaagaccaagataaagagcacaggaacagcatgtggggaagcaacatggggtgagtgggaaggacttacatctccatttggtcatcagtgaatctatgtccataagagaagtcagcaactgaaaaggcacctggaacctaggctcttccctaaaggaaaaaaagaagaaaaagaagaatatattcaagtaaatcgagtgtgttaggaggagcatgagtttgacaatcagttggccctggaaacaaatgtcagctttgcctgtgaggagctgtggcagctttggcttattctctcagtctcagtttctccatctcaaagatgaaataatactactcaacttgcagtgtttgtttgaagcctagaaaagtccatgtaatatacatgaagtaatcacctagagtcacacctaacattggttcttattaaaagcgagacaggtgcactattacagatttcccagccgaaaataatcaaacacttctaggcaaagatattaaaacacaaaaggaaaaaccactttttatttcttttcatctatttgtttttttgttttgttttttttgttgttgttttgttttgttttgtttttttacatctatttcttcacctttctcggcatattttctagttaggacacatatgcctaattggcatacatttacttgagtttaggaaaaaagtcaaaagattttgtttatgttgccattttgaagaaagacttgagaagattttaaaaattaaatacacagaagcatgacagcctgtaaatataggtatttttttactagtgtgatgtttattgttctgacacatttaattcatgaaccctgaggatgggaccttcatacaatagagtaggagtgagtcaatatttcaggaatacttcaaactttttagacaatgaagctaattttacttgaaattgctgaataagtggtacagtttgcaagttattttcacttcatgcattttttattttcttaaacaggaataatcttagagcattgtttaatgatagaacacatttcatgagtgagtctctgagagagtaaactggccatttaggacacttagtgttacatagtgctttttagaattcagttaaaaaggatatttgaggccgggcgcggtggctcacgcttgtaatcccagcactttgggaggccgaggcgggccgatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagagtggcgtgaacccgggaggcggagcttgcagtgagccgagattgcaccactgcactcccgcctgggccacagagcgagactccgtc

SEQ ID NO: 14623 - DNA, 12476 bp, Human
  misc_feature (1)...(12476): n = A,T,C or G
tggagtgcagtggcgcgatctcggctcactgcaacctctgcctcccagattcaagcaattctcctgcctcagcctcctgagtagatgggactacaggcgcctaccactacgcccagctaatttttgtatttttaatagagacggggtttcaccatattggccaggctggtctcaaactcctgaccttgtgatctgcctgcctcagcctccccaaagtgctgggatttacaggcatgagccactgtgcccagccctggctgaaattttttaaaggaaatagttatcccatgcatttgccagctttgtgtagtttatttatttatttattcttatttatttttttgagacggagtctcgctccgtcaccaaggctggagtgcagtggcatgatctcggctcactgcaacctctgcctcctgggttcaagtgattctcctgtctcagtctcccaagtagctgggattacaggcatgtgctaccatgcatggctaatttttgtatttttagtagagacaaggtttcaccatgttgcccaggctggtctcgaactcctgacctcagttgatccacctgcctcggcctcccaaaatgctgggattacaggcgtgagcctggccgctttgtgtagtttaaaaatcactttcaactcaacccctttctgaagtcgttattactattatccccattaaacagaagccctcagaaaagctaattttgattctgccatttgccctaatccgtgttcccttaggcaagtcctttcaaaagtctaaacttcagtttcctcctctataacatgtgtatgccaattaagtgaaatctctgccaggccacaagccatgacacaatggaaaggtaggtggactttggggtcaggcacacctacaaattccagctgctccacttagtagctgtgttatccagggaaggacatgttctgacactggctgacgcctaactgtgtgcacacatagacaattatttcattgaatctttaagcccctgagtaaagttaatctttactataatctccgttttggaaactaagccaagacatggcgaggctgagtaatttatccttggtcaccaactctaaaagagctggatttgcgcccagcatgtggatttcagcgtcttcctggtaaatcgccaccctcagttgccacctgaacagtaactctccacgaaatggatgagaattgaatccgtaactggagggaaccaggcgtctggctttggaatgcagaccgcctctggccgactgccagaggtgggaggcctgaagtttgggctccttgccgccctaccctttccaccacaacgctgctatcaagcctaaactccagcaaaataggctttaggaaaggcacgaaattaactcattttacacatagagatacacactgggacgattttggcttttcaagctaactcagaaaatggagatacaggccgggcgcggtggctcacgcctgtaatcccagcactttgggaggccgaggcgggcggatcatgaggtcaggagatcgagaccatcctggccaacatggtgaaaccccgtctctactaaaaacacaaaaaattagtcggacgtggtggcaggcgcctgtagtcccagctactcgggaggctgaggcaggagaatcgcttgaaccctggaggctgaggttgcagtgagctgaaatcgcgccactgcactccagcctgggcgacagagcgagacttcgcctcaaaaaaaaaaaaagaaaagaaattggagacaggacggcactcctcctaccacggccactatacaaccgaaggcacctcctcccgcctccctccaggtggcgctgtaggaccggcccaccttccacagcgcagacgcctcagtttggcctccctcggaggccatgcagcgaagaaacgtgacttcatggctagaggggcatttcccaggagccgcccatgccgccgcgtgaccttcacacttccgcttccggttctttattccggaagttgctctcagaggcagcgtgcgggtgtgctctttgtgaaattccaccatggcgtaccgtggccagggtcagaaagtgcagaaggttatggtgcagcccatcgtatcctacgcaggatgtcaggactaggaggttcgggtcagaatacggggtgcgaaggcgcaggctgagggcaggcctgggatagtggagtacggatccacatcccatgagcccccggggctaccaagactggaagaaagcgcgggtagttgaaccgtgatggtggggaggtggtcttggggggacccctgccgtggggaatgcaggaatggacgcggcaaaaggagggaagagaacttcaggtgcggagtgaaaacgggagttaacggttttgggaaactccagggggatgaaagtggaatggatgttctttagtctttagaagacccgtaacgaatgcccagctgggcacttgttgtttgcgtaagcaccagacctcgcgtttagtaaacaaaggtgagacgggaatagcgtcgtccggttgtttcaggaagcagagtctatgctgcttttgtattttttccttagccactgtggtgcagaacctcatcttcagatacttacaaaatgtacgtaagttgcttgtttcgtaactactttttaaataagaggtgaactgatttagttttttgtgttaacctgagcgatcgctgtgttctagaatttaaaaatagatgtaactggagattggagggtaattgaggggaaggagtacttagaaagcactaatgtgatgaagtggtgtgtatccatgccacttcccaacatgcaaagaattgtatccattactttgcaagatcaaaaatactttttaattccaaaaagtattattagcagacttgaccatggtatttgggcatcagtagttttgttagtagtgattatggctagaacattggaacctctcccctttaggatgaaacattggaagaaaaacccagccaacttaaaccatgtcaagaggtggtgtgtttaatacctgtgggaaaacttaaagacgaaaaaaggaagagagaaggggtagcttcagaggagtttagtggcagctgctttcctttgagggaaattttagcaacttaaattttatagtgtgataacacaactgaaaaacattaatttcaggtgataataattcttaaccacctgaattgagggctcctgtcctagttgttaggtgtgtgacatgagaaggctttgttttggaactggattttgctgcaggagataagcccttggtcattagaaattactgctttgtgctatgctgtcaaaaactttcactcttaatagattgagaccagaagcagtaagaaatattgagtcccaaaatcacaggaaaattattagcttatacagttccaatatagaacttattaaatgaaaattctttttgaggttattattattggtgaataattcttagatatgggctaattagttaaaacttttgacttacattcattacaatttttttaggagccatatttctcttgtcgtttgaccaaaatggttaggttttgtatacttcaattttttggggggcggggggcggggagatcttgcttaatgttgcgcaggcttatattgaacacctggccacaaagcgaattattccgctttggcatcccaaagtatgggaacggtgtgaatcgaggcacctggcctgtttttcttttcttttttttgagacggagtctcactgtgcccaggctggagtgcagtggcgcgatctcagctcactgcaacctctgcctcccgggttcaagcgattctcctgcttcagcgtcccgagtagctgggacaacaggcgtgcgccaccacgcccagctaattttttttgtatttttagtagagatggggtttcaccatgttaacgaggatggtctctatctcttgaccttgtgatccacctccctcggcctccgaaagtgctgggattacaggcgtgagccaccgcgcccggccctatttttctttttttaacgtttccacttttatgattatttcagagatcgcggattcaggtgtggctctatgagcaagtgaatatgcggatagaaggctgtatcattgtgagtatccaggcgatttcatctcatagcagttcggtcgtagaaaaagacttaacagaaagtgtctagccagaacagtgtataaaaagtcaaagatccaacctaaggaaagtttttcaggtgctgctgtttagccttttttcattgttgatagataaggattgggtagtttttaatagggaaaataacttttaattcattttctttcctctgtctatgttgagaagaaaatttgtatttgatttttgagaaagggctttgttctgttgcttaggctggagtgcagtggcacaatcatggctcgttgcagcctcaacctcccgggctcaagtagtcctcctgcctcagcctcccaagtagctaggatcagaagcgtgcaccatcacagcctgctaaatttttattttttatagagatgaggtctcactgtgttgcccaggctggtctcaaactcctaggctcaagtgattctcccacctcagcctctcaaagtcttgggattacaggcatgagccacaacgcctggctgaaaattaacttttaaaaattattcgaaaaaaaaatattgagcgacaatgttagtatggagaggggggacaaaataaatgaaattagggagggtggggttatttgttgtgggttaggtgatacctgaatagagagctcagtggggttagttaaataaggcttctgggatagcaggctaccctaaattttttttttttaagttggggtccggctctgtcacccaggtgctctcagctcactgcaatcttgaactccttggctcaagtgatttttccacctcagcctctagtagctgggaactataggcatacaccaccatgtccagctaatttttaaatattttgctgggcaaggtggctcacgcctgtaatcctagcacttagggaggccgagcatgatgaatcactttagctccagagttcgagaccagcctgggcaacatgatgaaaccctgtttctaccaaaaatacaaaaagtagccaggcatggtggtgcgccctgtagttccagctacttggggggagctgaggcagaagaattgcttgaacccaggaggtccagctgcagtaagccgaggttgcaccactgcactctagcctggaagacaaagtgagatcctttctcaaaaaaaaaaaaaaactttgggtggaaggtggggtggggcttgagaagagtgaatctttgaagttagttggagtttttatctgcataggtatactcatttaaaatggtttgaatgtgattttctttgaagataacagtttgtttatttttctagggttttgatgagtatatgaaccttgtattagatgatgcagaagagattcattctaaaacaaagtcaagaaaacaactgggtaaggatagaagtggtcttacagaattctagaaatattttattcacttgcagaattcagtgacctgcaactcagttcatgtttgaatttattttgcatttgagaagttattattcagagtagtagtacacttttgaaatcatcctctactactcactcctcaccacactccattttggcttctccacccagagagctctcaccaagggaaccaaagactagtggtattaaatctaatgatcagtactaatcctcattttattaaactctcaacagcatttggcactgttggctgctccctccttaaagcgctttgttcccgtgtctgagtggcaggaaaaacccaagtagatttttctgtttcctcagttgacaataattaacacagaagacttctgtgaccagatgtatgggcatatttccccacacaccaagcaagcaatcagttcggcagtggacatcagctcggagtcgtcaagttcagttcagttctaacactatctacctgagatagcgtcagttcccagaggttgagggctcaatccccaagattgccttccatgcccctcagtcctccaccagatgctaattgtcagctccagattgttttacctgtgcttcttactgactggctataaactgggtcccatgacccctccgttggtttgattaatttgctagagcagctcacagaactcggggaaacacttgtatttactggtctgttataaaggatattacaaaaagtacagatgaagagatgcgtagggcaaggcatataggaagggatgcgaagcttttgtgccctctgcaagctcaccactctgggaacctccacatgttgagctatcagaaccccattgttttcagtttttatgtaagcttcattatgtaggcatgactgattaaattggccgttggtgatcagcttaaccttcagctcctttcctcctccccgggtgggagggtggggctgaaagtccgacatcactaatgccttggtcctttcagtgagcagctcccatgctgaaacgttgtaggggctgctggccatcagtcaatcattagcatacaaaaaggcaacatcttagagattctaaggattttaggagttgtatgggattgaagaccaagtaaatattttgcagtatcacaccttggctctacgatattatacttgggtttttatttttcacttctggctatttttcagacttatatattcattcttgggacccaatcactaaatgagttgctccaggcttggttctaggccctcctgtcattcagtattgtctgcctaggcactggagtacagcttcagttaccatctataaatactgactcccaaatttgtttgtctgggcctattcaccatttctacttgaatgtttcaaaggcttcttaaagtcagcatatcagaaagcaaactcaattccaactcacactgtttagagctattgtattattatttcctgccttattgaatggcaccagtttccagttcagcttactaattgatttctctgcagctacctccagtttgctttccaggcctcactcatcttttaaaaacaccagtctgaacatgtgtcatccctttgcttgaaatactgcaatgacttcctgttgctgttaggataaaaaaaaatctaatgattctgcaaatctaatgatcttcatgatctagtcttatctccctctgctcatctcgtatcactgcctcactttctgagctttagcaacacttgtcttatttcagttctttgaatctgcagatttgcccaaccattaatctttgtatatgatattccttgtgtctgtagagctcagatcaaatatcacttcaagacagcggtcccctaggccaggtgcagtggctcacacctgtaatcccagcactttgggaggccgaggcgggtggattacgaggtcaggaattcaagaccatcctggctaacacggtgaaaccctgtctttcctgaaaaaaaaaaaaaaaaacaaaaaaattagctgggcatggtggcgggtgcctgtagttccagctactcgggaggctgaggcaggagaatggcgcgaacctgggaggcggagcttgcagtgagctgagatcacgccactgcgctccagcctgggcgacacagcgagactctgtctcaaaaaaaaaaaaaaaaacagtggtccccaaccattttggcaccagggaccggttttgtggaagacaatttttctgtggactggggtgtgggggatggctttcggatgattcaggcacattacatttatagtgcactttattattattacattgtaatatataatgaaataattatacaactcaccatcatgtagaatcagtgggagccctgagcctgttttcccacaactagacagtcccatctgggggtgatgggagacagtgacagatcatcaggcattaggttctcataaggagtgcgcaacctagatccctctttgcccggttcacaataggttttgcgctcctatgagaatctaaggcttccactgatatgacaggaggcagagcccaggcgggaatactagtgatggggagtggctgtaaatacagatgaagctccgccacctcgcccactgctcacctcttgctgtgtgacccagtttctaacagggaccaggactggtactggtctgtggcccaggggttaggaagccctgctctaaaaagttcaaagtttaatttggttttgctggggatgggggaaggcgggattatgtgctccctgagtttgtagtaaaacctttattattgaaattattttattagtgtctctcctgttatcagatgcttcaccgtaagtgtatgagtcatgccttttttgatcccagtgtgctcagtacctaactcaatgcctggcacataatagaaactaaaaaatatttgaacaatgaatggtatttctttcttttgtttttggagacagagtctctgtcgctcaggctggagtgtaatgacgtgattttggctcactgcaacctctgcctcccaggttcaagcaattctcctgccttagactcccaagtagctgggactacaggcgtgtaccaccacgcctggctgattttttgtgttttagtagagacggggtttcactgtgttgcccaggctggtctctaacttctgagctcaggcaatccacctgcctcggcctcccaaatgctgggattacatgtgtgagccactaagcctggcaatgaatggtatttcttaacccagttaatgaatggtcttaggattcacggtttcatcaagacacactgaatcatttctgttaacatcccattcacttgaggtttatttaggcattttgtctttatttgttaaatgctcactaatacttttatcagtggtgggtttcaggtgtctctctttcagaccctcaggattctcttcaacctgaactagatatatggaaagtagattctgagaagcagtatggtgtttcgctggctgcttcctgcttagactatttttatgaaagcctgggttttttagatttattgttatttatttatttatttttttggagacggagtctcactctgtctcccaggcttgagtgccatggcacaatctcagctcactgcaacctccacctcctgggttcaagcgattctcctgcctcagcctcccaagtaactgggattacaggtgcatgccaccacacctggctaattttttgtattttagtagaagacggggtgtcaccgtgttgtccaggctggtctcgaatcctaagctcaggcattccacccaccttggcctcccaaagtgctgggattataggtgtgagccaccatacccagccgggttttttagatttaaagatgtcttgccaggacgggcaagcttagccttactgaggtcatattattcataaattatttaccaactgttgaattcccatggtagtatttatcctgtagaatagaatgttattaatacctgcagaagcctgggaaagtagaacagtttaattactgttggagttgatcaacgtgtctcaaaccgttctaccagtgaacaccagtgttcctgaagatgtttataaatttctcagaaaagtattgtcttaaataaccttaggaaattttgggtaaaacaggtttgtttattgtaggatggagtctttttttttttttggttccttttttttttttttggagatgaattttgctcttgttgcccaggctggagtgcaatggtgccatcttggctcactgcaacctccgcctcccggattcaagcaattctcctgcctcagcctcccaagtagctgggattacaggcacgcgccaccaggctctgctaattttgtatttttagtagagatagggtggagtctttaatatactaacagctttaagaatggagttataatatgctgtatttcccaaacttgacatacgactcatttccaaacttttattacaaattcagcattgggaaatgttgtatgaggcctattgagttgacttagtccatagaaatgatatttgtcatgaaatgtcatctacctatgttagtctcttgaaaagataaatgtattctaatggagccagaaagcctttcactatatggacacttgaaaatgttcacatatttttataagaaagcattttcaaaatattgttcaaaaactggatacaaaattctgagagtaaaacatctgagtgtgtggctattaatagctttttgttgtttttgtgttgcaggtcggatcatgctaaaaggagataatattactctgctacaaagtgtctccaactagaaatgatcaatgaagtgagaaattgttgagaaggatacagtttgtttttagatgtcctttgtccaatgtgaacatttattcatattgttttgattaccctcgtgttactacaagatggcaataaatactatgggattgtttgtattaaaaaatttacattgcttcttactattcagcagtagaaactttttacacagtaacaccattcgttgctggtatttagttttctgaagggtcgcagttgccttgagcacttggtattcgcagagcttggacctgtagattttgaggcagattaggaattctgcctgatgggtaagcttccagtattgggaggtggagaaggggagggttcagaaaaataaataagagttattgcactaacaaaagtcttcatcacttgtagttctggatgctggaataccagagtttctaacctaaatacgttgggtacattatttaatggggtcagtattgctcaacactctcattgagtcactgtgaggtctttgtgaattttatcgctaagatcagaatgtgagaagtatttggatatagggaaagaatgaagtgcctttcaagtacattaaaaatcagttaagagtttacaggaaagagactgagattggtaatctgaaaaggaccacaagcatagctggtaggcaaattgttaggcagaataatggtatgttggagaaatacacctgtctcttattcttatctcttaagaattttggttcttcccccagtgattgctggttgaattcttatatggacaggtttcccttcccccagtatcgcacatggttctagttagaatcctgttagatagtgagcatctgctgttagctagacactgttgaatcaatacagtgaaacagacaggtaagcaggtggttttaatgcctcattctaagtgctatttaaattggatcttgaaagatgaataaggcctgccttaagttctgctaaaggcaatgttgttattaaggacgggtgaggaaggaccaagaagtctggctcctgcttttctacatgcctgtgaaggagacttttcatgaaactgaataaaagaaatcctttccgagatagaggagatttgtaggtgaatgcagaagtgtatccagctttgaaccatgcattccatctatattcctcctgtctgaactcatgctacttttgattatgttttgaaataaagggctgnnnnnnnnnnnnnnnnnnnnttatgttttgaaataaagggctgcattagttcttttaacatttgagtttgaaattaattaaactgatcccaacatgcaaagaaaacattgggcagcagagggagttacagccctgagactgcttcagccctgctggtgagaagattgaattgaagctttttcagagcagagcaaagacctccctgcagctttcttggcaccagaatagctgggaagaaggataaaagcccagaggagtataatctctaagaaaacctgctggctgccttttccatttccctgtgtggcctttctgacctggctgccctgtggaagcagagctgtgcctgctgtggcttattctgaatggatcaagacatggaaggttctatttttgacagagcaaatgatgatagtgagaattaaggtacagtgaactcttacaattgagctctgtatttagaaatctctgcttgctttcctgctctactggagcctgtggtgtttgctttttaagttgtacttttccaccatctctagattgtttcttccaaccagaatttacgagaggcgttgctctctgcctcgttaaggttactaaaacatcctgctgggaagctgctcttgttggcagccctgggttatgtcagcttttctggaatggctgttggttgctgagggggtcttgatagacacccctaaccctcatagcattcttgaagtagggggtgggaggaatagagaatcaggctctgaaagaaaagtggtgatgtgggcctgctgttcaattagtagcaggtaggcagaaggaaaagtttgaaaatcataggatattgtgctttggggtgccagctcttgccatatcacacttgtcaacagtttcaggattagagagtgtccctctaatttggattaaggcattatgggctgggaagtgtcatggtggggtaagcctaatagcatc

SEQ ID NO: 14624 - DNA, 147382 bp, Human
  misc_feature (1)...(147382): n = A,T,C or G
gtaagttatatctcattttttattttttatcgatttattgtaattttaattaatttctatatattatttttattattcaattttttaaaggttaaatacatttttatttagaagacctgctttatatacagtgtggagtacttataacatactaataaaattctaaggcataaaattaagagatattttagtctatagtttataagcttaataatagattacagctattctcacttcatggtttaggactacatcaaaaagagggaaaggttataatttgaaatgacagcaatataggatccaagagccatagaagccactttgctcatcatcatttttaaaatggggaaattgaggccaatgtgattaagaagcaagcataagataatccagtcagcaatgaagctgcaagcacaagaaggcagcctgatagactcatggcattttggaatactagcagttctctttttagtactgtaagctccaatctccctcttcctggaaacagttccttgttctcaatctttctttatttgtttaaaccagtaaagacatgcaacttggtggggcttttctgagtccgcagagggaattgtcagagcaggtttccaggaatgagcttggaaaaagcaccatgaagaacataaatttcacacgggaagtccagtcatccatctcgccatcaattctctcccttcaaacttttaatatctaacctcatctttctttccctgtggcccgcgtgttcagtagagcgtggtggcttactttctttaggcagtgatttttcgaaacccccggccaaaacgcgatggggaaacagatttctaagtaagtctctgggaaagaatctgcatctctgtggcattcctacactagcttcatcttctaatcactttcctctaatagcctttccttaaaccagagtctcttgctttcaatctgcataaagcaagggcttctaggaaaccaagtctacatgactctacaacgggagggattgcagtgaaagctgcgagaaagacccgtgcgctctgtaactaggcgagtcagcatcacagcccaatggaatatactctaaagatgggattttcatgcaaaatatttaaaagattccatcttgatctcttgtgcggcttaagcatttaaagatataacttggggttctccctggatcctggctacatcccatgaagcccaagtgcacaattttggaatatttcctccacggtgctttgcttgcttgtttgctttcggctgggtcaggtgaggaggatgacagggcttctgtattgctaaatgggttttcacaggagatggaagataaaaatcaaaattatttgtaacgtaagacagcagggcctggtgagaggacgcttcgccgccaacaattagcaattcggcttctacacagcagccggagatcagctttgctgcatttggtccaggttggagcatctccgcagcagctgcaacagccgcacgaaggtagctccgggcggggagcgaggcgctgtcctcggtgctgaaaggccgaggcgcgcggtgggcgcgacagccccggagacccgaggtctcgcggagggacagcggctacgggccccgagctgtgctttctcagcgccgcgcacgcgacgcgtccacggtggtgcggggtgccgggcgccgtgcgggggagggggcgcgcgctcccgcctcctgccgcgagtcgcgcacgcgcgcccgggactgcctgcccctctctgtgacttgcctgtgtgtgtgcgtgtgtgtatgtgtgtgtgtgtgtgtgcgcgcgcgcgtgagtgagagaggagagagggagaagagagcgcgagagagggtgagtgtgtgtgagtgcatgggagggtgctgaatattccgagacactgggaccacagcggcagctccgctgaaaactgcattcagccagtcctccggacttctggagcggggacagggcgcagggcatcagcagccaccagcaggacctgggaaatagggattcttctgcctccacttcaggttttagcagcttggtgctaaattgctgtctcaaaatgcagaggatctaatttgcagaggaaaacagccaaagaaggaagaggaggaaaaggaaaaaaaaaggggtatattgtggatgctctacttttcttggaaatgcaaaagattatgcatatttctgtcctcctttctcctgttttatggggactgatttttggtgtctcttctaacagcatacagataggtaggtaccctttgtgctatgcttttgaattgtgcataatttggtggtaatctttgttcacagtgtacaaattaattcatgtcatgtagacttatgtcataccttgactgcattccagatttaaactacctagaatatacatgtttttcttaggatgaagcaaaaggaaaagactatgcctttgatacaatagaagaaaaggtcctctcatttcggatccccaaattttattaattctgccttagcgacattttccagtttgctcagattttcttggggtctgaatgcaaagcttgtgattacatggaaaggtgaaggtttctggccacctacctcgccttcagactctcatctgggtcttgaccccttggctagcttttggatattccacccccgctgtccgagtccgtaggtgtgtttattcggcctattcgcgtgaataagagactcttggatttttgggcgctagcgcgcgcccctcctttccctcccggggcactgacactgttctcttgcttgctgtttgttctttgcaggggggctatttcctaggggcgccgatcaagaatacagtgcatttcgagtagggatggttcagttttccacttcggagttcagactgacaccccacatcgacaatttggaggtggcaaacagcttcgcagtcactaatgcttgtaagtaatgaatattcatgcctttcgggtgctgcacgcggaaggccagcgagtgtgagtgtgtgtgtgcgtttctggggtggtgtgtgtgcgtttctgtgtgtcagtgtgtgggtgtgagtgactgcacacgcgcgtgcgtgtgaccgtgtagagagaaggtggctgtaatctcagggacccccgctggctggagagggctgaagagagagggaaaggacgtcaagagtgtgcgcattagggagccggggtgagggttggagccagggagggcggctttcttgggttcaaggggttttcgctcatcttgagtgcttcaggagaagccctcccacctcgctccccatcgagcgcctgttggcaccctgcccacagagaacacgttgttccccagggcgcgcagtcgggctgttggacaaatcccacgagggactgccggagcccagtggcctcctgccccagtagctgccgctctcgcccgctgcccccagtttagatccgcagcaccggctgggctcaccctgcggccctcgcgagctccacgttctcctctttgggacaagttgttgaaatggttccggagttgggatcggggctgttacataacgcccacccgaggggcgaggagcggggctgacgcaggctcaggccggccgggtggcgtgggggtggggcggggaggcggtggaaagggggagcgctgtcaatttctcctgctcagttgcgcttccgcttaagttggagggggcgaggccgccaggggcgccgcggtcagcttgccagcccggcgcgctttgttctcaggtagctgggctccagcagaggcagccggggaaaaggactgggaagccgtgggatctggccgagtttgaaaatctggagaagtcgctgatcagccattttagtctttgcaatgctccatattaaccctctcactccgcgcagtgctccgggactcgctgggaagctctgtgatgggttcagataaagtactagaaaccaaacaattagggatctaaaaggattggtgtggaggccagagggctccggtccccgcgctcgctcccccgcgcaggcgtgggcaggcagtcgcggccactgtgccttcctgccctcttcccagcagctgccatcatttcctgccgactgccctgcggtgattctttcctgccctaatattcgcagtcgttatttcatagataacaatttgggggagatctgcggatggctcacttcccactttggctacagagcttggggaaaattaccacaggaaaagcccaactgcagttttcccacgtcacacaaacaactggttgccatccctcctccccattttaagctttagtcatatattccgtgatttagcttgattatcatattgggcccatcatcaactcttgcaactactgtcacccggacgaatgaagaaacaattttcttagactgatagaataggggcattgtgtggtaatttaggatttaattgtttataatggatctatttaagaaggtttcactgctatatattttcttcaaatgttggtgccaagtaagaaaagaaagaagggcgggtgtgggggtacagaacgaaagagagaagaggagaattaaagtggatttgcagctttgaaaaacgtccgtaatagaatatctcagaaaattttagtacatgacatacaaagaaatcaacttaattaaaatttgaagacttctatatttgacctatttacctaacagatttagactattcatttgatatcagtaagttccaatttttcctgaattacaagtttgtcatgcaactgttctgagtatctaactgtgtgtaattgtatacttatgtgaaaatgctttgaaaagtaatgactcctaaggaacggctgtgggtataggaaggacataggttttgaatgtgaagtgaaagtattgacagctgtactttttgaaaacagtcaatgattgccaagttcactcattggtgaaaataatgagaagaactttctgcaaaaataacatatgtccattgacaaaatgaatattccttgatttcaacaaatgctaaactactgtattggggctttataaagataaaagactgtgattaggttattaggtttagatactcattctcaatatttttgaatttttaaatagaaatttttctgaaataaaatatatagccagaatatgtgtatatattaaacacatatgtaaattcatatatttgcagggtgaacacattcatgtaatcaacatgtggacttcttttaaaaaattaccacacaatttaatttgtccatagttctgagaagctggaataatcaagtcttcatttgcacagttttttcccctcctcaggaagtgaagctaaaataaatatgttcacatttccagagactaaaattacccctgcatggattattatagtaggatagtaaaacaaattattttcaggaactgaacacattttaaagatgacaacatgataattcaaaagcatgacatttgcaactcccatgttataagtaatcttactgtttgctaaaaagaactaggggggtactgtgacagaagagaggctcattggatagaaatttctggggctgacattaactcattgactgggcaaatcgcttaacatgtttgtgactccgtttttttattctctgagacatttcaaaatttagagattgcaaaatgaaatagagaatttgtatccttttttgtttgtttgtttttgtgctatggacaatagaagatgtaaaattagtttaactcttttgagacagaatgagagagagggaaagggaaagatgcttatgtaaactacaatcacaaagtcaagaaatggatgaaaatctctagtgttaaatttgtcagcatgggtcttgatcgtttaaatcctgcttaagatttttctccaatgcctatcctttgttttcttgcctttttattcagggaagtctgtgattctttcctttataaagtggaagcaacagcattaaatacattgacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaacttcaaaagggaaaatttattagtttactaatttaattttattcctgagatggaggaaattatttggaaatgttgaagtggacgttgatatgaggatccagggagatccactgaatgggttaaggttatacaaagaaaatgaagtcattctattctgaactgggtaaaatgattgtgtgcatcttactgagctcccacatccttccctttcacaatcacagtgggataatgaaagtacctattttgttccatttgtttccatgggtacctgaggcagtaagacagattttcagtttctttcattttttctccatcattccctttttcttttcctctctcccctcactcattttttcctttcctccctccctgtcttcttagctgaaaagagaactaagattttttttcctgaaggttgttcaaacgtaagccttcattattaaaaatacaaagcataaaagcagaaaaaaatctgagattagtatctgatgtgtagaacagttgaaaccagggatgggtcctaggaatccaatcattcattcaataaatgtttagtgagtgccttcaaggtgtcagagaataaatgactgctttttttcatgttaactttttttttttttttctagccttttccctctaggctcttttgaatagttttcaaaaccttgtaggccttcatgcctttagtgtgcattggtagctgtggtcttgtctaggaactttagtatgaggatatgagggtattccagtagttcttaaacacaagcggtttaatacagcaactaaaaaaatctgcctttttgtgaaaatagtaactttcatattaatatatatatacaccacgtattgtatgtagttaactgagaaaatcaatagcaaattttaggaaaatactaagtatttttacattataaaagattttagtaaactttgatgctatgctaattggtaaagcttgcttaaaataaaactgtgtaaaagggctataaacatgagtacttgattctacagggtttgaaaattaaaagtattaaatattgaatttactccccagaaccttccctttctatttcttttgaagactgaattttacaaatagttattagtctagttaaagatgatttaatagttttatatttcaattccatacaacaaaataaattataaaaatattaaattgaaggaaacagcaaataaaaatctactttttctccaagccagcagatggagatgttggagaaaatattgttgtttcataaaactgttgcgcacaccgaatgccttttaaaacattgtaaagaaatttatttagataaattgaaaaaaataaatgacatctaatttgaagaaaattattcaaaatgctgtcttaaaaataactttcattgccttttaaaaataggttgccctatattttatgttttagaagataaagactgttagaatagattgtaaatgctcttagaggagagagaattctaaaattatattttttcaacatttttaatctcgattccccagctatcatttttgagctgtatttattattaaattttagtcacaaattactgagatttttgtatctgtgttcataaaattaattgatgtttgctaagactttattgcacttggatgaatggacttctgtgtgtatgtatttatagttacaattatagagtgtaaatagttacagattggctacgcgatcctgttttgtcatgtttgttgaggtatttactaacacctagagttactgactttaatatatgcaaaactttcataaaactagactcaagttggactttcttaagcaatgatgacaaaccatgaacacatgtgccagggacacaataccgtaaaagctggtgttgtaaatattcagttatattcaattgcagattttgaggaaatgcctctttgtatgtcagaataattaatctgttattgaagtattttcagttaaaatttcatacttcacttatcactgaagaatttcaagaaaatgagtgcgtattaagtagaaatcaaagaatggcattggttgaaatattctattttgagatgagagaaactaagtattgaaataaaaattaccttatgaaactatagaggcttaaattagtaaaaatttattcttatgctatgctatttctgtttgaaagtcttgcaaacttcaacctgctggctcaagaaggatggggtattttcatttcacatcaagcctttaaagtgctagggacattgtactgagacattatgacaagtggatgctgattcatgcccagatctcaagttttctcataatctcttccaataacacttagcaaactttcaaacttcttagaaccttgaaaattttaaggaagggtgaaaaagagcagttgtttttgagttatttcagtatgttgctatataatcaagttttcagagagtatgtgttttttctctcttcctcctcttccctttttataaaaaagtcaatagaagtacttaatctgcagagcaaatgctattacaagaaataaagtctaaattgagatagagaactgtcctttaaacattttcttatgtgagcagcgagtgcattcattcagagctaaaatcttgtatttgatgtaaatatttgattgaaatgttaatggcagctgggtagattatatttcctttctttttacagtagattgtactgaagataccccagatttcattaagtgtttgctcttttattattatagcaattttaaataaaaatttctcaggttttctccaaagatctacataattgccaaatctcttgtatgactgtgtctcttcagtacaataggaaaataagttgctgaattcaatgttaaaattagaaaatcacacatgatttgaaaatgttcaaacatcaaaatgtctatcaaatcagattttactagtttggaaaaaaaaaggaatgtgattcttacaatgctgttcataagatgtctaacacctattatttttcagtgctattcaatttaaaagttttttgtcatctttgataattttaacttatagaatgaaaacattttaaaattaacgaggagaatgtaaaatgtgggcttgttgaagacaggcccttgctgctgttaactgtgtgttcttcacgaagtctagctcagttcccagtgcaccgactcacttaatagttatttacctattcaacacatttaattttacagtagatgttcttatcataacattataatttttaaagttagaattttgtatttgctatacatatggatttcagaatacacaatttactttgtaccttccttgaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccccctcccccaccaaaaaaaaacccaaaagcaagaaccttgttacaagtgggtagaacaggagatgcccttataaggcccctgaccgttatgggtctgccaagcttcaattttggttttagatgttccaaaaatgtgtccttgaatggacacagaattgttttagtaactccctccctgcccccaaccaggatattttatactacaattttctatatcaattcctttaattaattttaaaaatgtacagaatcacaaaagtattatttttacgttttagatggtatctaggaagagaagtttctggacatagtttctctttgtggaccaattgctctatttgcattaatttgtgcaattattttgtatgcgtatccttattttttctttttagggcctgcagtttatgtttcgggtttgttttctaacgattttgttttgtcttattttcattctgtggataattttcttgggtgaaacaccttgttattatatgtttaatttttcacacattatcatattactgggaaaatcatccaaagtgcttgatactactccagcctgggtgacagggcaaaaacttgcctcaaaaaagcacaacagagtcttgaaatttattggtatcttcagctgaatagaacaaataaatttaggagataccaggttccttatagaaagggaattggtgagtagctatcttcttagattgcttacgtttttgtatccatgtttctcaaacaaatgacatatgtaatgtttatagttttactatttggatttttcttcagaattttacttcataattttatatatttatggttatgttaatacttacattttttcctgattgtttcagtatttcaaatataaacacaaactgggttgaattgtgaaatggcctaaattttagttcttctaaaatactttcaatagggtattttatttctatgaagtttattttcccttcatgtaaaattgatttcacatgataaatgctatgatgtttacttgttatagtcctctaatactttcacgctgatgaatttcagtgaacctgagaaggtactcctgcaatgtaaatatttttagtctaatcttcctaagtacccaacttactgatagaaatgactgaaatgtgtttatataaactaagtatattctatgcttgttaaagcatagtagaatattacctgattctttatccctacaagaatagaatatgacctaaattaataatgtctaacttcagcataaatttaatggaaactcaagttaaataacttgatataagaaaagtttcctcagctcataaaccctttgcagctaaaattctctgtatcaaaataccgttctgtttcagatttagcattcattttacaatttctctagcatcagtattcaagatattgcagtaagaatatgtcaacaatttttttatatatattatttattgtgcatgaataaaaggatagagtgggcatgttcaaacaaatagtttcaaggtaagggaaaatatttttttccttattgtagattgaaattactatatttcttaaaagtgatggcgggaaagctgtggagaaaaagggaaaaactctaagaggcagcataacttggtgtacttggcagggctgtaagaatttgcaactcgaaattaattcattccttccttccttccttctttccttcctttcttccttccttctttccttccttccttccttctttccttccttccttccttctttccttccttccttccttccttcttccttccctccatccatccctttctgcttcctttcttccttttttttgtttaagcatctctttcatttgatgtttgcttagtttgcatgtctgtggtcaatcttctatattaaccttgagctactatagaacagtgaattcttataataattttaattttgtcaaataatggaagctagttattatttctagagggagacatgaaagaaaggaggcactatgcatttggttttgattttttttccttttattttattttattttatttcttagcgaaagggtctcgctctgttccccaggctggagtgcagtagagctatcacagctcgcttcagtcttgagctcttgggctcaagcaattctcctgcctcagcctcccaagtagctgggactacaggtccatgccatcacgctgagctaattttattttattttttatttttatttttcatttttctgagatggagtctcgctctgtcacccaggatagagtgtggtgttgcagtctcggcccactgcaacctccgcctctgggttcaagcagttttcctgcgtcagcctccccagtagctgggactacaggtgcacaccgccacgcctggctaattttttgtattttagtagagatggggtttcaccgtgttgcctaggccggtcacgaactcctgatctcaggcaatccgcccacctcggcctcccaaagtgctgggattacagacgtgagccaccatgcctggtcgcaattttattttttatttttgcagacgggttatcaccatgttgatcaggctgctcttgaactcctggccttaagcgatcctgtcaccttggcctcccaaagcactgagattacaggcatgagcaaccatcctcggctaacaatatgcatttctctgaggaaaaaacacaaatttaaggtgctttattattctgggctggcaaaaaagccatccttgaaaattatgaggtaaaatactgactgaaaaggtttgaaaaattttataggtaaaaatatacaatatggaatgtacgactagactgcattttatagggagcatggaatgtgtcatagtaaagttgtctgttgcttgaggtaactgaaatgtagcaattcttgataattgctgacggggctcatcttagtagaacagagaaaagtttgtctcttgttttatattatactggtattatatttctatttccttaacacctaagttgaagatattttttaaaaaaattaaaatatttttagtgttttaaaaataaaaacattttggatttaaattatttttcacaattctacatgtgtttaaaaagtattagtatgtcttggaagaatatttaataataattctcaaatgatatgtaatattttgtcattgaggctaactattcaaaagttattcaaaggacaatttaagactaaaatacggaacacagtgagtagttttattctgaaaaataaggaccataacatatgcaataattagtttggtctatatatttgaaaatattgtcatacacactttagtgatgctaacttggaaaattgaaaacatattcctttagggctttatgttagctattatgaattccatatatttaaggggctgcctgtgttcactgatccaggtagcacagaaatagctcccacatttctacagcatgggagtgaagcatctctcatcattgcaagtctggcagagaaagatctggaagtggagctctctataagggtgtgtgtgctttgctaggttttcttgagaagtacatttcaaatcatgtcatgattttcatctttattcgtgtgttatctgctgtttgtgagaaattgaagaatttctatcttgcttttaatctgtgcatgaaatgggagaattttggctttataattttcaagcactttcatcatttatcattttacttttatattttttaccaggtttttagtttttactagtttatgctattattactaatttacatacagaaaggaaattttgagaacacaggcaacaattcagaaagggatacaaggaagcgctgtatatagtttattctttggagggaaggaccataaaatcctcatctttatatttcagagcacacacaagttcagggttgtcatcttaatgatgaatacacaagtttttcatctgcgaagattaaaaaaaattgattcgttgtagtttgtagccttggtgtcttgggatacagaatagcatgggttaagcatctgcacttagaaccaaattctagtccttgtactagatgtatgacattggacaagtttcttagtctacatctcagtttctacctctgtaaaagggaaacagacattataggattgtttgcaagatacgcattagtcataaaacactatgagctgtgtttggcacaagtacataaaattagcaatattttattattatttcctgtattagaatttttggattgttttgatgagcacttgctattagaggcagaagacaaagaaaaatgcagttctaactttcttgctggaatcttttcctactgtttgtatacctgggcaggacataatgcctttcggtgacaaagaagagactaacaaaataaatcacataagtcactgaaagatatatttggtgcactataggacgagaatgatttttaaaacctgaggtgttactcgagtagtactttgaattcaatcttcccctttattgcatgtcacttacatcttaggatgttgaacaatttcaaactctcatatttttagcagatatttcaagcacatatttaagatatctcaatatttaatggaactgagcacattatggattcctaatgttttattttatgtaattaattaaattaaatttatttaaatgaaaatcagccaagcaacataggctttggaattaggcaaaaataggtttgaatgtaattagtaactttgtgatacagcatgtgtttttttctctttgtagaataaggctcagtttccttgtcatatctgataatattattggaggcattatatgagaaaataaatgcttagattaatttgtcagaaacgttcccagtatttatttcctccctttatatcagccctttactgatataaaacctaaaccccatgctcaaagcaatggaggaaggtgctgccttgagaaagcttagatattttatagctttatgtataatttttttctttctgaaacacttccatatctggttgatcctcactgtcgctctgtaaagctcggtagcataagtggaattgttattatacccatttacagaaaacaaaacagaaatttatgtgatttgttcttagctgctataaatttgtggagaagcttttggctacaaaacaagttggctacttcctaaaccagagcctctattggtctcagttggcaacatagctagtatatttgaataaacagacatgaattaaaattatggcttcactatttactagttctatgactttgtattaatcagctaaactttctagtcttgttttctcctctgtaaaatggggttcattataatgcctgcctcatgatgtaattatcaggtttaaatgatagtaactgctgcatataatatagtgattaatactgctaatttcagtgattccaattcccctgagtatatattggtcagatatacttagctccgtgcttataggtgcatggaagggaaggtagctaatagttttctctatgtaattttcaaaataataaacttctttaatataatacaaccattcaagctgaaaatagaggctaggattttactttattatcatttttagaatactagtgaacatgtacattttacaagaattttgatgtgttcttgatccacaaaccctccccccaccaaattcaatggataaataacaagaactaaatcatgcataatttaaaaaatgtagatgatggttaacatttagtgtgaatatctgatactattcagttaccaattccaccactgatacatttgtgcaataaaaatgatggtaggtgtttctcacgaataggaccttattaaacttggaacaggttcattgtgacttcttccgtgaggatcagttttatgcatcttgctgctggttgtctaggtcactatcatctttttcacaagtttattccccagcacagtataaggaggctcttttgcctgtttctagtctgctgaaaggtctggaaggtttgaaacattttcaaataattacttggtcagagattatttctcttagggagcagagagatgtgcagttgtgcggggtggttgggggaagatttttacttactgacaatgagtaaaaataaggacttcctacatatgaactttgtgtagttcatgaaatattcactaccttattctgaattgactcttattcttcttatgttgccttatattgcagtaacagcagccatatgaactcttcaatgtaggatcataagacctttggtcaaaattactcttttaaagcaaatctgtatatttacacaacagttatatccatgactttggatttgggctggaagtagaatacactggataaaagctatatacttatctttaaagtgcttttatctaccttgtttgtatgcaccaaaaacctatcacaagattttcttctttcttttcttcctttcttaaacttttagtagatacctgctctgtaccaatctgttattgtctgaggtgacaaagaacaagataaggcttctgtattgaacattttttatgggttcaaaatcttttctttgtggcaaaagtagaagttgttaatgtaggttagctagatgattttatgattacattagtctcggtaatagacattatttctagatcatttataaatattatcctatacgttgggcctagattttaaattatcttaaaagcagaaatggtaattcaaaaaattgtaaagaaaacataaaaaagattctcaatggaaggtgaaaagccatcatcttaaatactgatttagaatatattgctgaaaacttgggtagccaaatgagtactactgctgttaacaaactaataatgccaattgcagatctgttaaaaagtttcaatttttcgcatcatatttggagatgaaaatttatattttattttgcatatgatttttttctttcattgccacaatctcttcaaatcagtttaaactggcatagactacataaattgctgggtgatgtttacataaattatggggattaactaattaattataataaatactattttaggttgttactgaagaagctagttgcaggttttaaatagtaagttttacaaaatactttaaaatgtcaatgcatatacctattttgaataatctaagagacactaacaccttgctagtgtctcttgttaaaacagattttatataatttaaaccttggttattataggggtttgagaatttcaggtagaaaatcatgattatctgaaaaaagttgatgcagctttaacatgtaacaaaaattatctaatagaattaaaatatttgcttacaatagcattttggtactatggatgatttagaatgtaaaacatgcagaaaattttaatttagcttcttgtggtctttatattttgaagcttaaaaattgtgatgaaaataatcatgcatatggtaatttaaaaaaaacactacacacggggatataataaatattgtcttctttcacctcatttctatgtctctgagataatcaccattgatggtttccagaaatggtagcataatatacactgttctttatcttgattgttttcttcttaacataaatcggagttctgcttttatgtgcagagattttcctcttctttttttctagttattgcatggtattctgttgttatgtggcctttttgttgatgattgttttcatttttgctgtttcttttaataatatgtccaagtgggtttgtagaatagtttgctatgagtggaataacttgtagtcaaaaagtgtttgcatttaaaactttgctggatatacaaaaaaggcatatcaatttacaaccctacctagagtgtatgagtatgtctgtttctgcctaatatcacaaggttaaattttttaaagctttgctcttggtatcttattgtttacatttactatggtaagacgttatttgtatttctatgtatgtgtgtgtgcataaacacacctgttcattcctttgcccgattttcttttgggttgttggtctatttatgggtgagtctacttattattatttgatacatacattaaagtagcacacttgtgatgtgtttcagctgttttacccagctttgtgtctttttaacctgtttatcgctttttggaatgacaatttcagttcatgatttttatgaatacacatattcttaaattttatttagtaaaatttagaaattgtttgcttaatttcctcaggaattttgtgccttgctcagaaaaacatttcccaccgtagtttattttttttaaaaaactgcctgtgctttaataccatcatattttggtattatgtttccagataaatcattgaatcatctggctttatgtgattaacaaaacctacagaatcccgttttatttttccttcgtaaggttagccaattgtcacaacgtatataaacatgaatttttacttcattgatttgaaatgtataagtttttttttttttttttaattttgaaagtctcattctgtcatccacccaggctggagtgcagtggcatgatcatggctcactgtaaccgcaaactcctgagctcaggttattcttctgcttcagcctcctgagtagctgggactacaggcacatgccactgcctggttaatttttaaaaatagtctgactgtgtggaccgggctagtctcaaactcctggcctcaagcaatccttccatcttggccttccaaagttctgggactataggtgtgagccactgcacttggcccagatttttttcttaagtaaataattcctcaaggagttacaaacaaatagggaatttacccagagtgtgaaataaagaaaattaaaactgtattacaagcaaagagatgtaaagtcatgcaaggcatttgtttcctgagcagtgttgttatcataaattgtgcttttgtgtttctggggtctcagatcaataaaagaggatgtcagattttgaacattaacggagcccagagggataaataaaggatgttattatgtttttttggcttgtgtcatagcagtaatatcacttaaatggactactcgttttgcatatttcttaacctatatcaagatttaagtaatgggttacgattatgtcttggttcttgaatatcactttgaagttaattcagtgtaacaatccatatgtgttcacaaatagaatgttaaaactaaagaccgcaatctatatgcaataaagaaaggtgaaggaactcagttactatggcttcattaactaacactgtatttagtttcatccccggtttgtcttaagaatcagttatgtgctctacctaaagccaaatatcaagctatttataacataaatttgatttaaactggaatactaaataaaattctagaaagttacttgcgtcaagatatactttcagcctgccttatggtgcatgtcataaactgtgtatttttggccaaccgtcagggaaatttataaatctttaaccactttattttgtagaactatgaacttaatgtgggcttattgataggggcaaaagatgagcaaagaccttgaagacccattggctttccatgagcattaaagtggaaagattttaactttcagtataatttaaagcaatatcttttgtttaatctgcaagactctactcatctgcttatattttaatgtatctttgatagaagaaaatttgcctttttgaaagaaataaatctacatgagcagaactgcattaaagccatttgtaaacttcatagcttcataatattcacaccaatcatttcttttccatttttgcaagtttttaaaaattcttcttttatccattacaaaacactgctgcaaatgaaatttcttttgcatatgtatttttcaccatttctgatgactgaagtataattactggattaaaggccatgaagcgtttagttaagtaaatcaatttctgatatatgctaaggaaatccaatccagactataatcccatcaatagtctatgaaaagtctagtctttcataccctgtgcatcattgttacaatttttaaaattcttacctatttgatacctaaaaatattttttgttatataaaatagtttttcatatttattattgcacacttatgtttcttctttcataaacagtttattaaagtcttttgcccaatttttattgtcattgcggtactttttcctattgaattgtatgagttgtttattcaagatgactatgacagaggaagatgggactagagagttgcacatctagcaatttaatgcttctgccgaggcaagaaccatgccacatcagcttggatgtcattgattagaactattcccatgaaatacccaacttcaaggggttggagactaatcctccttatgtccagaatagaactgtgtattggtgaatattaataatgcctataatatatgacactcctttgctaatcaaaacgtatttaattcttttccatggtttatttttttctttcaattttgtatatgactttttaaaaggtactgtttcaaagatgtgcaatttttgtttatttttggaatgtgcttccctctgatatatctgcaaatgtttaaaatttccactaacagaggaagacagaatggaaaagaacttgcctctgccaattcttctagtggttaattctatattaataacataattctgttgttaattttatattgctctattttcattataatttctaataatatacttgaaactatatttcttattttgacaattagaaagattgtctttcaacttcttactttatgaattgatgacattcgtgagtcaagattcagaacatctatattctactttgtatttatatgtaaatacatgtatatatacatgtatttttgatgtcatttactttaaaaatggaaaaatcaataagtattgtttacacatctatatatagctaggtgactattattcaatgcagagccaagtaccatgctatgattagattttccatttttatatatttttcctgtatacttgaaatttccaaatgttattatacattatgtggttttaaaatatttttaagttcttactatcgtatatctaattcatgtattctagtctttcaagagactttattcatcttccttgtgcaaactagattggcttctcttgatcctcctgaacaactgacatattgagatagcactgtccttttgtggttgaccatgtaattatttcttgacttatttcttcatatgctttaaatacattttctttattacttacaatagattatttaaaacaagttttaaaataataaatcatatacacacgcacatataagtgtgcatgcatgcatgtatatgcatgggtgtgtgtgcataatattttaatgaaatccctcattgatagctttttccatgttgggaaaaggcataaatgccttcatgatatccgtaatatttttcatcttactgagtatttctattcctcagaatacattaaatttttcttcaatatcaattatgttctaatttggagcaattaatctaggtttaaattacattttttccacaaaaatttttgaaatatcttggagtttctcatttttttgtttttcttgcactgtgaactttatcttacattttatttatttcctttccttcctaatgtatctctttctccactttatgcctgggcagcaccccactggagttttctgtcttcctgcaatttgaaatcaatgttctctaatcttattgcactgcccgtcaactgggaccttctctttgttcttttgatttgaggcttgttgtctgaacccgtcgattttaatttcttttttcttattctgattttctctagagcacctccttaagttactttctttttttttttcttttatttttatactttacattttagggtacatgtgcacattgtgcaggttagttacatatgtatacatgtgccatgctggtgcgccgcacccactaactcgtcatctagcattaggtatatctcccaatgctatccctcccctctccccccaccccacaacagtccccagagtgtgatgttccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccaaggtgtatatgtgccacattttcttaatccagttctaagaacgggtattttggtggtaaattatctgagtatttgcatgtttgcaatggttttaattctcctctcatatgtgattgaaggctttgatggatacagatttctaggatgaaaattacatttccttagaacttggaaggaatgaccgccttattttctatcatcagatgttgtttgagacgcctaattcttgttttttgtgcatttattatttgctttttggcagctttcaggattttatcattagtcctacctaaaaattcacagtgatgtatctaaatgggaacttttaaagtccatcctatttaggactcaatttgaaaacagattcccccatgaagacctgaaaaattctcagggatgaatacgtagaggacttgcctctctccatttcttttagttctttctagatatctgtttagttgattttgcccttcttgtatttagtgtaacatagacaaaaaagatcatacatcctttttttctgatattgtagctttaaacatttttactaatataatgcagttaaaatagattagatagcgttcatctgtttggctgtgtagaacatctatccacttctgagattgccttgagtggttctatctaaataatgcttaccctcatatttgctttatcccctcttcctcattgtatggctattagaaaatacagctttcatggaattttgaaaaccatagagcatcattggaagaaaagaaacatgtttctaagtgttgatgaaaacgatacaaaaagtaacactgagcattagaataagggaaagagatgagcagaacaacttaggcaatggcataaataataagtcatttggtttgtgtgttccacattaccaatcttatttcatctttgtagtcctctctcgtatttaattataagttgcttttcttttctctttacaagagtctgtaaaaccttatattcacaattttatctttgctatcttactcttttggtagagtcttgtgttggcagcatagttgaatgttttgtatctttttgatattttatcttcagcatatggttttgaattttaaatgtgaagatcatgataaccttcatatctagaatttcttctctaaaaaggcagtcaggttaaggcttcacctatgttttagcaatacactagtaatgaacagatagatattcagtggaaaaaaactattaagtaattgatataagaaacagagccctggcgatttcaggattttattgtttattgtcaactttttcttagctgttaccttgttgataatggagatgatttgttgcctcggaaaataaaagcacactgaagcaataaccatgtgaataatatgtttatggttgagagaaagtacagttcaccaagtaatattttttgatgaaattgaggcagattgattttatgctttctgatgatagaggtactgataagattacaaatctcatataaccattcagaaaagtttaccacttttcccctgaaaagaatctatagttgattttcattatttacagtagttatgttctaaaaattattctctaacactgaattagcaaatactgaaccattgctcctaggggaaattgaattaggttcctgtgagcctctcattacaacattttcatcaactgatcaatacataacattgtttatgtttacaaacatcttatttcatatatattgtttacagacatctttcttaatatattttgatccattaacactgaatacatggccaacagtactataattcaagcctgaagggagctaatctaacacacatattttctcagtaaagcacatcacagccttcttgtgctttaaaatgctagacagcaattcctatctatgcttgggaaccactttaaacagtgaaattactaacaaaaagtgcaaagatgcaaaataaaaatggaaattaaatagattcccaaaaggacacttgtttacagtatgaaagctgacacaagaaggcagagtgttgccttgtttgatctcagctggagatgtgagctgggtaacaatttttcactgctctgcaaatgtccatgaatgactgcaaaagtgctgcaagtattgattttgaggttacaaataaattttagagagtaggcaaatttgcaaataataaatccataaaaaatgaagatggtttctatttgatttgagccagtttaggcaaaacagatagctttttatttattttagaaatctgatagagtttaaaggatttcaccttgctctgaaatgtttataattacctgtgatgaaaaagcagcttggatttgaaaggatttggatctgagtctgactttaaactctgtggaagaaattgaggggaaatgaacacgcttattctccccaattcaaattcatggtggcacagctgaaggacaaagcattttcttttatttttcttttcttgtagtgaatgccccctaaaagagaaagatctaaagcactgaaggacattaaactcctttgaggtgtctaagcaacaatttttgtgaatcctgttatcataggttttttccacttttgttttgctattcttttcactgggaaagttagagtgctaacaaacataaagaaaagaaaagtgaggatgtgtgctgtatgtacctgtgcctaattggcacaatatttggctgtaagttgggatgcacataggctttacataggcttaccagaatctagttatcattttctctgcatgaaagattgtcctaagctctgaggggcagacattaagaagactagaaaggtggacgctcatggagcctatgttagaatgggtgaatgataataaacaaatagaaaaaaaagcagaaaaaaaaagattatagcttgagaaatgcactttaaaggaaatcagtagggagcatgatggaggaactagttgaagacaatatgttaggtaggctgagtgaggaaggtctgttatttaaggaggtaagacctgagctgagaccaggaagatgagaaccagctggacatatgaagagttggggaaagagcatccctggtagagggaactaaatacaaagggcctgaatgagaaaaaccttggtgtgattactctcaggaggaaggtgtctttgcaacagagagagggagcaaaagggtgggcaaaaacaaataaaccaacaaaagctagagagatcagcaggaggcaaagcacacagctcgtagtaagcagcatgagttttgatttaggtgaactgaagatccacataatctcagactgaaaggtaaacaataaggcaggaaaaagatcttaaccccctacctccttagcttcatcacagcaaatgtcagcaaaaatatgcaatgggaaaagcaaagatttccatactcacaaaatcatttcgagatgagaaaatatattcgtctgattggatttggatttttcctttctgtttggttggaagcaatttgttcagagtgaacatttctctagaaatgtcttcagcaacaaagagtttttattcttacagggatgtaaggtttgttgtgttgtggattgtcctatataaaagaggctactgatactagagttattactcagaacctttaaagtttgtctcttacttagcactgaaactattttctgaacaataatctgttggctttgacttcctacctcttcattgtgaatgatataaaaaaaatcatgtactgtctggcctcagggtcaccatttccctctttggctcctcaggctgaatcagagttgctagttgtgaggaggaatgaggccttcctgtagctatgtctttgattacatgaatagtttttactctgaaagtcagggtggagaaaaatctgaaatttaatttgctcatcttctgattgtcctaattgccttgcccagttttttcactggattaaaaaaatactacataaaaaaataatagcagattgtcatttctaaaaatttatatttttctcaattcatttatctaatggacaaaaacaggcatctacacacagtaaatgaggtgattattttcaaacataggatggtagcagacttagagagtgaaatcagagcttcgagtataccaggccctttaggaaagctgtgatcttcctataatctccaactcgattattgtttgtattttcaggtaataattaaggtggcatcatatacttcagggtttgtttctgctgccaggttcaatctttgtctatggaatgaactctaccttgcttgtggaaaaaaaatacactctgcttttcctttctctatattctagtgataatagacttggagttacatgtcattcaaaggaatagagtccaacttataaacaagtctcctgaatcttctcctatctgcttcattaagatacttatgatttctaagtgaattaagaccaggtttttttttggaaactgttaaaatctaataactttggaaaaatgaaagtttaggggaagcttccttgtactgctagaaacataagtgaaatgaaatccaactataatatatcaggacttcaaagccccaggatggatgtcatgctaagtagtaaaggcaataaattatcagtatttgggggatgctttctagaaagaaagattccaagacctctcttgataatctttatcacaaaataactcttcttgtcaaggagttttgcctatgtctgtctgaattttattctctgtaatttaaacatcctttcatttaggcaaccctctgagaaagagacaaaagtctatgcttcgtcagcatggcagaacttcgtatacttaacagcaataactcaaccatttattttctatgtaaaggaactcaacccttaggcttctcacagaacacgaatgtttcctctggtttatttttctcgtcatatacaacctcattccaatttttttctgataaaaaaaacaaactgaaacctacattgtgcaagagtaataatttctagttaattttgttgacagtagaggtttatattcaagataatgcatctcacttcatagtgaatacattccagtattacgtttagttttaaaataacttcttcatattgatgacatacattcaatatacagtttatttctttgttattcctgtgtttagttaggaattctaactctgctacttattgttgctatctgatattggacaggctagttaatttctcttggccttagttactttgtttgtgaaatttgaatcacatgatattgtctctatgaaaacatttaataacattttatatatagaaagtgctcaataaatacaagctttgattctcagtacatcttatgtctttatatgaactacatgcaactaacacatttactcacatgaaaaaatgtctgttaaattttatcctgtttttaatacacaattttaatgatataattaggttacctttggttccattttatactttcgtagtaataacactgatttcaaaaatatagactatcgactggatatcaagttcattgggattggtttgctttttacaaatttaactttggaataattcaggatttactcttataaattgcgatgagctgcatatattgtgatgtactctgtaatatcatctgttgaaataaaggggatatttcttatagttaatgtgctatcattttgtagttttgtagagattttcacttcttagagttgatttttcttcacacaaatattgagtagttactgtttttggttttcgatcttcacagcttcaagtgtcttaggaaacatactcagatacacatgtattaaatgtacttgttcatttttcattttctgtccattttcactttagatttctatattgttataaaactagtggtaaaaaatgaaggctatttccttttgcagtgatatttcatatgctttaactcattttctttcactagtagataggaacatggtacttggctatttattttatatttcctcatcaagataaagatgacagtcttgggactaaagatgaatagttgggacttctcaggcatgcttctgttacattggctgaacacattgtgctctccataattagcatgaactttacagtgtattccctgtgcctggccttgtgccagcctctgttaggaaacaaaactcagattcatcatctcccaacatattgcaaagatactaggagaacaaaaagacaaattcacaacagatttgaagatggattgctgtatgcctctgaatatgtttggtacatgaatccagaaagtgcaggatcattgtgattgatgaaactgggaaatccctgtattttgtgtaaatgtgggggtagaaaaaagaatgatggtcatgacttgtgactcttcaattggtaaggtgcccagaaatgtacctagcatgtagaaggtggtcaatgaaggatgtgagatagggtccaaggaaggttatttttgaatgtggggcacatacgtaatcacacaagaggacttgtcacattattccaggactgagacctgagccacgaaggtgagcaggtcacctggagcagtgggcatgcttggcttctggctggagggttatttcgggggaggcagtacacttcgactttttgttagctctggggagaaagctgagatcagagttatccaatgaatgtagaaatggtacagctctgacttaaagggaattccagagtttcacaccagaatgaggcacaggaagggacatgtgcaagaagtggagttcagggaggagttagtgaggcaggtgcaggcagaaggggcgtcaccatgcagacagcatcaacacttttctggaagagacgcttaaggtttaactctggattacaagacagacgcctaatctttgctcttattatcctcactgggaaatcatttgttattcttttgtcaaatataacaagtataaactctgcctaggttgtagagttctcccttaacgttttgtactctggggataactctttgacgtgtatatatatataatcatatcatatcatatatcatattttatatatatatcaaaatttatattagaatttgatatccagtcgatagtctatatttttgaagtcagtattattactaccaaagtataaaactgaatcagaggtaacctaattatataattaaaattgtatattaaaaacagataaagtttaacagacagcattttttcatatgtgagtaaatgtgtcagttgcatataattcatataaagacataagatgtactcagaatcaaagcttatatttaagtaatacattaaaaatacaaaatattaaatacaaagcttgtatttaaataattaatatattcaaaatacaaaaattaggccggtgtggtggcacacgcttgtaatcccaactactcgggagggtgaggcaggagaattgcttgaactcgggaggcggaggtttcagtgagcctatatatatatgtgtgtgtgtgtttatgtgtgtgtgtgtatatatatatacgtgtgtatatatatatacgtgtatatatatatacgtgtgtatatatatacgtgtatatatatacacgtgtatatatatacacgtgtatatatatacgtgtatatatgtatatatatgtatatatacatgtatannnnnnnnnnnnnnnnnnnnggcttgtatttataatcatctttattttttaacatttcctaaatttagacacgttgtgatggcactcgctgtaatcctcaagctacttcgggagggtgaattcagaggaattgcttaaactcgggaggctggtggtttcatggagcctatatatatatgtgtgtgtgtgtttatgtgtgtgtgtgtatatatatatacgtgtgtatatatatacgtgtatatatgtatatatatgtatatatacatgtatatatacgtatatatatacacctgtatatatatacatacgtatatatttatgccgtgtctatatacacgtgtatatatacacaagtatatatatacacatatgtgtatatacacgtatgtatatatatataccgaccatggcagagaattcctttctttcactatatatatatatatatatatatatatatatataaataaaataattctttttttatttaaaaaaatatgttttttgagacagggtcactctctgtcacccagactggagtgcagtgggatgatcttggctcactgtaactttaacctcctggaatcaagcaatcctctcaaatcagcctcctgagtagctgggcctataggcgtgcaacaccacacctgattaattttgaaaatgttttgtaaacatgaagtctatgttgcccggcctgctctggatctcctggcctcaagtgatcctcctgcctcagcctcccaaagtgctgggattaaaggcatgagccatcacgcccagctcacaaatattttcaatacctcaaatgtgctagacgcagtgctgagggataaaacacagccaccagggagtttgaaatctaagaagaaactttatgaacctccagagccacttgaaagtccctgtgtacttcataatttgaatatcttagaactttcctctgactgttcaagagtttagatacatccttcaacatcaaactcacattcttatgcactgtgaaccctttctggaacattctaatccttactaccagagtctttagaacttccaaattattttagtcacaatgtgaaattatagactcatcaaggccgagagatttactgattatttattgaatgcttttgacatacggaggaattaattccagaaagaccaggtgatttagtcaaaggtgacacagttatttatagaaagagcctggatttgtacctagaatttctgactcttaaaataatcatgtgcctggcaaagtgcctgggatacagaaagtactcactgaatgatagtagtctcgttcctcagtgggttacaatttctttaagaatggcattatgcttaacgcttccattgtgtgtcctggagaactggcctaggtctgagcccattgtagacgctaaggatgtatttactgttaattgttaatacaaatttatttcccattgtcttcatgttacagaggaactaaaaatcttgaaagagaaccaccattttagtggtaagcccaactgttgctgtgtctttcttataagtaatatttatggtttatgagtcttgcaatcaaacgatggacatatgctgggaccatttctctagtaaaagcaattatatattgtttttattttaaagaactgactatcatgatctgcaaatatttttaaagctaccattatgcaggcattccttaaattggaattagtggttatgcgttaatgggactgccaataattgtcgcattctataaatcaaaagaaaatggctcccttttttgttgatagatatttacagcccccagctttaagttgaagatacaagtataactgcttcaagattatattccttgaggaaagatattgcttcatggaaagtaagagtagaaacacaaagccctatatattaaagtttaacttgatgaaaaatcttatttaattgatagccatctaaatttaagcaaattattatatcttaggagactaatgccataggaaagagagtattgggctgttttctatcttatcattgaggcacagggaggttataattatggcatcctggtgctaaacatggagcagggtcaattttcgcaattgaagaaaagaagttataatagtcggtccttttttctcacctgggcaatgcatgcattacatgaatatccagagtttcttttcattcgttcctaaatggagtcaaatgcagattcaaagatataaatggggctacctacttttaaagttcacgagatacagatctatatagatgacaaaggtgataaatatatagaaacatataaacacataaacttcactcccaagttaaaacccacaattaaatcaagaaggcccatttgctacttggtaaaaataacaaatcaggaaaaggatatgataatcttgctatataataaaaatctttctccacatcgttttacataaaacacaatcttctcaacttattcccaaagtaaaaatcctcctccactcacatacttcatgatcccaggggacatttatggtattagcacagttactagaaagtattagagagggtgcttcccattctccagctatgcttgcttttcctcttcttgctgttgatgtttctgccctattgctctgtttttctcctttcacctttttctaggggttggggaatgtgaaagagcataaccctggaaacagaaacagaaatttaattacctaaattgcttggatttgatgcattatggagcctatcaaaaaaagcgtataccttcaagttttttatgaaaaatttcattgtcattttaaatgaaggaaggcaataataactagaggagagacaggggcagactcacatccttggaccaggagatggagaatcacagaaatgagagatgccatggaaaatgtctcagaaagtatttaaaatgctttccccacatcctattacataaatacactttaacaaatatttttctgacagggtggcttattataagagaagcagtataatactagtgtcctggaaagggcagaaaaaaataaaaaacaatgtggattcccaactggcattttattttatttttttagatgtcgttcagcccattcattaactcatctgttcacttagagaataaaagtttttcactggagtctgtacagttaaaattttcactgaggtgttatcttacttagtcctgtagtacatttttctctttattaattttacttcatttttcttggtagtgacggcttgctgatgttcactattaatgttgacagtatgaatagattgcaaaaccaatgaagatgcatatctttctaataaagaagaacaagcagagatgaatgttcttccaataacactgtcagtggcagagactactacaataaaatgtctatttttaagattatttgctgcatgtcactgcagggatggaaattcagtagaaaatttgttcattcagtcattttgagagtaatacaattagtagtaccactagggcagaagccttatagactagtctggtaattctcaaagtgttgtgttaggttgccaggcattcttgagaccctatacggggatctacaaaataacaatcattttcataatattaataatatcaagacatagtttgccttttccactttgttgcttttgcaccattagtgcaaccattgacatgaatcagctgtactgagtagtcatcttcatccctgccacacactcacaaaaaatccctcaaaacaaaacaaaacaattttgcttaagaatgtctatcataaaacagtaaaagttgtagattttattgaatctcaacccttaagtagacatatttttgtattctgcaaaaccaaatgaagggtatgcaggaagttcttaactgtcacatggaagtccacatgatcatatggaacaaaagcacttgtgtggttgtgactgcgagccgactgggccactcttctgtcataggccatccttttacttgaaggaatgactgatgaactagggttatttgtgtttggttatttgaccaacatttattttttagaagaataaagtaagtctgtcactttaagggaaacaatggacagtttttgttgccagttctaaaattcaagcttttaagttaaaaagagaattttggaaaaattgcctctgccattgtgagcttgtcattttcccaataattaaaggcttctcatatgaggtgtgtggtaatattgaggaaaataatattttgatattgtataatgaattatggcaacatttgggtcatctacctaattgtgaactaatattttctaaatgatcaatgcataatattagagaattaagtgtgactaaatgatccagtcaagcacaagatagaccagtggatttttaatggaatagagtataaaatgtttatttatatgggtttagaaattcacattatagataacccttaagacactatcatttgccaactgttagtgtggtttcaaagaataatatccacaattacctgaaaaggctaacaaaatactctctacatttaaaattgctatctagttcaagacagatttttctaatttaaatccaacaaagcaaaatatgaaaacccaactgtctttaaaaaagaaaaagagatttgcagaaataaaagcagtgttactctcctaattttggggggaccatgtagttatttttcacaaaatatgttattaatataaaattgtggtgtttattactattattattttttaaatgaactgataaatatcttaatcccccacctttttgttttttttttttgagacagggtcttgctgtgtcgcccaggctgaagtgcagtggcattatcttggctcactgcaacctctgcctactgggctcaagccatcctcccacttcatcctcccaagtagctgggatcacaggcacacaccaccacacctagctaatttttgtatttttggtagagacagggttttgccacgttgccaaggctaatctcgaattcctgagctcaagggatctacccaccttggcctcccgaagtgctgggattacagacatgaaccgctatgcctggcccctttttgttttaatgtaaaatacagtaagtgggaataagtgtaactcatgtatacaaaagctctttggggtccttaataatttttaagattgtataagtatattcttctgaaactgtttgagaactgctatcctaatctatggagatttcctactggtggggtttcaaaaatttaattgaaagcagaatagaatactagaacttaaaattttgtttgatcaattgcctctaccaaagtttattaaaattattatatttgggaaaattgcttctttatagaaatcaaaatgattaatcagttcctattgctgctcctgtttcatatcccacaaaattgatacaatgagataatttcactgggaattttaactagtgctgagacaagctcattaatgtttgttattattctgtttacccccactttcaggtagaaccaaaatttatcttatgctaatcagggaaatggcaaaataaacattagagaaaaaggttcttgtaaaagatttgtcaaatacaggtaacataaatctttttcgtcaaagagtagacttgtcagaaatattttaaaataaaagagtaaaagtacacgcacacacacatactttctttttttttttccctaatggcagtcacagggttagactaaaaatgagagacattaatgctcttttttctgtctagaaatccagaaatatgtatgtatgattatactctaaggataaaggaagttttttaattgttggggagggtgggagttatattaatctaccaatgatttgaaaacaattagataattatctggaaaaaataacataagctctctattttctgtgtgtactataagaacgtatagaagcatcgttttaaagtctaggcctaaacagaggtaatctgttaaaggatataacacaaagaacataagccataaaggaaacggttagtagatttgatgacataaaactcaaaaccaatttatgtcatagaagatagagttaacccatttaaaaaatcagattgggaaaatgtttctgcttcatgtaactgataaattgttaatatccatagtctatagtccggaaagagcccctgaaatcaaaaagaaaaaggcaaacaactcaatatgaaaatggtcaaggtcaagaaatgcaataataagaagagatacaaatatccagcaaacatgttaagaaactgtcaaattgataatattatatatattggaactatcctgtgttgagggtgtgtgaaataggcaatggactgtcacccggagttggagaggctttaacttaatcaaatgtgtgtatttaacctagacgttttacttctactaatttgttcttgggatattcacttatatggtcaaagatataagtagaggatactcactgtttttcagtggtgaaaatttgaatttaacgtacctggtcaccaatcatgaattagttaattaaatgacaaccaatcaatttggcatatttctgtagttatgaaaatatagtgcacatagttttaaaatgtttgtataaatttaaggggcacaagtgcagtattgttagatggatatattaggtagtgttgaagtctgggcttttagtgtaaccatcacctgaatagtgtacattgtacctaataggtaatttctcatccctaccaccttctctccctcttacccagtctccccgtctatcattccacactctatggccatgttgttcagttcccacttataaataaggtcatgtagtatttgactttctgtttctgagttgtttcacttaaaataatggcctgcaggtccatccatgttgctgcaaaacacgatttcattctttttatggctgaatacacacacacacacaccatattgtcttcatccaatcatccactgatggacatttacgtttatttcatatctttgcttttgtgaacagtgatgcgataaaaatacgagggcaggtatctttttaatataataatttattttcctttgggtatatgcccagtagtgggattgctggataaaatcctagttctatttttagttatttgagaaatctccatactgttttccataggggttttactagtttatattcttaccaacagtgtataagcattcccttttctctgcgtcctcaccaacatctgttgttttttgtctttttaataatagccattctgactggtgtaagatgatatctcatgggacttaattaaactaaaaagcttctacacagcaaaagaaatgatcaacaaagtgaacagacaacctgcagaatgggagaaaatatttgcaaactatgcatccagcaggggtgtgatatcttgaatttacaagggactcaaacaactcaacaaccgtaacaaaaaccaaataaacaaccataacataaaaaccaaataaccctataaaaagtggacaaaggatatgaatagtcttttttcaaaagaatacatacaaatggccaacaagcatatgaaaaaatgcttaacattgctaagcatcagataaatgcaaaataaaacgtcaatgagatatcattcgtacatgtagttttatatacagtgacacagaaaaattttatcatgttaagtataaaaattcttgattcttttaaataaaagtactgtgtatatgtgtgtgtaatacatatctataggtaccaataaaatgtcttcagaagatacagcaaactattgagagctgctttacatcaaattgtaatattatatattacatatatatgttatatattatatataatatataacatatattacatatatatgttatatataatatataatatataatatatatatataatatataaattatatattacatatatatgttatatattacatatattatatataatattatatattacatatatatgtttgttatacagttatgagaggtttccactctcactgttttatgtgttttctttattttttaacaataagcatgtattcatggtaaacataattagattccaatcttatccttaccacacacataacttgaataagctcattaaatattaattgaagtgtatttttctagtgaaattaaaataatgcaacagctcaaaacaacttaaatcatgatcttagatagaaataaattctgaaattatgatcacacagaaccatttgtgttctagggagcaactggaacacaaatgccaactctttcctccttttaagagaattaatttcttattgaggaactggccactgcatctagtccacacttccacattctccctatagtatgatacttaattaatctgtaactgaaactagggaaattacaaaaactttttttctgccatcctgacttgatatctagaaagcaggtgacatctggatatctagaaggacttggtatctagaaggatgaactctaagatgtgtagaaagcgacatgattttgtaatggggagagccaaatttggattctgctttgttaattgcttgatttatttgcagtaccatcatctgtaaaataggattaaattacaggtcattgtgagtgttgaggtatttggaaagcattattttttgtagtagagtttttaaaataaaaaaccttatcattctagcctgagtaggaagcattaaaaagctaatcaaagttggaagaaatcagttatgctttcaaaataacccaagtgaaaccatgacaagaaattgtcagataaaaacaagtgtcaggtaaatgccagataaacacagaggttaactttcctagtgtcaccttcgagaaagctgggatggaatctatcacttttttatcccaagccctgtgactttttactgtgctgtgccactttcagatatatcatgtggttttttctttccaatatttaatcgccctctgaggttgtgatttgttcatgggatttattttgctctttcacaccattgaagggagattttatctttgttgctttggagcctgaaaaagtgaatgtgtcttaaaaatacaggtctaactgcttacaaagatcaatgagcctttgactactttctctaaatattattcataatagatgattgcattgtcttctcaactgaaatgcaagaaataacaatttaacgaaaaatttctgaaaatctgcaggattgatttcaaaagtatcattcatcacgacacttcagcttcacttgtgagaccagtatataattttcttttgatcttttaatctatttatgaagataatttactttattaaaagaatttttatggcaaccaactaaattttctactagaaataattttatccagcacaattgaagactatgaaaacccaaatgttatagaatcttgctaactaagcctcagtattactgattcttttaaaaaatgttagagttcctgttgcgggaagtcagggaccctgaatggagggacccactgaagccatggcagaagaacataaattgtgaagatttcatggacatttattaattcaccaaattaatacttttataatttcttacacctgtctttactgcaatctttaaatgaaaattgtgaagatttcatggacatttatcacttccccagtcactattcttgtaatttcctatgcctgtctttactttaatctcttaatcccgtcatcttcctaagctgaggatgtatgtcacctcaggaccctgtgatgattgcgttaactacacaaattgtttaaacagtatgaaatctgggcaccttgacaaaagaacaggataacagcaatgttcagggaacaagggagataactattaggtctggctgcctgagagccgggtggaacagagccatatttctcctctttcaaaagcaaataggagaaatattactgaattctttttctcagcaagaaacatccctgagaaagagaatgcattcctagggggaggtctctaaaacggccactctggggacgtctgtctttttacagttgaagataagggatgaaataagccccagtctcctgtagcgctcccaggcctattaggacaaggaaattcccacctaataaattttggtcagaccggttgtctgctctcaaatcctgtctcctgataagatatatcaatgacaatgtatgcccgaaacttcattagcaattttaattttgcccttgtcctgtcatctcgccctgcctccatttgccttgtgatattttattactttgtgaagcatgtgatctctgtgacccacaccctatttgtacactccctccccttttgaaaatcactaataaaaacttgctggttttgcggcttctggggcatcacagaacctgccaacatgtgatgtctccccgaacacccagctttaaaatttctcccttttctactctttccctttatttctcagagcagccgacacttagggaaaatagaaaaggacccacgttgaattatcgggggcgggttcccccgataagttccaatggttataaggcagaaagaaacagaaaaaaattgtagaagataaaggaaggggacacccagttgtggtggctcatgcctataatctcagcactttgggaggccaagacaggacaggatgattgcttgagtccaggagttcgagaccagcctgggtaatatggcaagaaaccatctctacaaaaatataaaaaataaaacatacgtagatgtggtggtgtgcacctgtggtcccacctactaaggaggctgaaatgagaggactgcttgagcccaggaggttgagactgcagtatgccatgcttgagccactgcactccagcctgggaaacacagtgagaccctgtctgaaaaatataaataaataaagtgaagaggaagagaaaatgtctttggcctaccttcactagaatttataaattatggagcttcaaaatatgctccagcatactgggattggggagacgtctgctattgtagtgaagctcccttgaacaaatcattttgcttgtttgcatgttactttctttagctatgaaagtagttaaagctttcctacagctctgtcatgctatccaggcaattcaagctcccttactgctctgtaatcctgtagagagtttatttcacaggccattttatgttcacagatgatatgaactttagggtacattcatcctgtgtcctggaagaagaacaaaatgcaaataatttaaaagaggagcaagaacattatatgattctgttttctgttctctttactttcgttctatataatcctccttcctgtccattttgtttactaccaagtcttccactgctgttcctatttgaaagtactgaatatagattacaaactctaacttgtcctccacacttgcatttccaattgtcacttagacttgattagaatttaatgtaatttttaaaattccttataactcactgccaggtaacaccattacatctgtactttcttttatgatacttaactagattagaattgtatttgattacacatattttttatgcctcctccttgctcatacattcttcttttttacttgcacaattctgtcagttcaatctccaaattagaattcttctcattcctactcctactgttgtggtcacaagtctatgtcataacagagttcattgtccttttttcttgtaaagacaattccttatgatttgttctacacattttatttatttttctaacatacatatttgatcatgttctactccttttgaaagtgatctgtgactttccattgcagagaagctatatataatagtttagacttgtccaggactttacttcctggccttgtcattcattctctctctcccagacattctgtattttattcatatcagattatgtaccatttcttgaattcatactgttaattacaataaaaatagaccccatataactgtggcttaatcaatataaagctgtaattctgtgtcacatagcaacctagatatagatggtcaagggcttacatgatagatattttatgctattatttaggaacccagattctgccatctgaagcactttgtccctttcagcatgatcaatggtgacttagcaccaagtccccaatcctagcaccatgaacgaggaagtgaagaaaaaggtcactccccctgcctttaaaacatatcctggaatttccatatatcactttctctcacatgtcattggctacaatttagtaacctggccacatctagatgcataaaacgctagaatatgtcatctttacaaaaatcaaatatatgcccagtttcaattgctatcactttggaaaaaaagggaaaactagatattgagggataacaggagcccttgtcacattcatgatgttgttattgtgattgttggtggtctcctcctctttttcctccttcatttcctccccctcctcctctttcttccttctttttcttcccttcttctccctttctctctttctcctctacctcacctcattcctgctccttttcttcttagctccctcacttaccattttctctattgatttggcctttcatttagctctgccttattgttaaaattcttattcattgttgagggcaaagtcaaaataataccttctaagacttttcaagatattacatgtattagtccattctcatgctgctctaaaggcatgcctgagactgggtatttataaagggaagaggtttaatggattcatagttccatatggctggggaggcctcacaatcgtggcaaaggtgaaggacgagcaaaggcacatcttacatggcggcaggcaatagagcttgtgcaggggaacttctaaataaagttgacacataattttatatatcaacatttaacatatattttttaaatctttgtattcagaatatgagtatgctctaaatcttatttattttacctttgcattcaaaatgtgggtatgcactaaatgttattcctattttggtctctataatatttgtctacattgccttgtgtatattaaaatttgaaaaggatatatttggcatctaatatgttttgagtactattttttaagtgttattttatcctatcagcaaacaacaccaatcaaacaaattaaaaataaccagactcagaaattaagtaacttgactaaacttatttagctaagaaattgcagagaaataatctaattcactgaatgacaaacttgtcacataagccagtttgctgaaagacaatatgtggaaattagattagctaaattattaaggattaaaaaatacttcctccaccttcgtgatgtttcttttgctttgtatttgttagttcagctcagttgcttattatctttgggtatttacattgttctggtgtttagtattttttttgaaaatatgtgtcttttctgtcaaagcagtgtataatattgtctcttttgccctcctataccctactcttcctgccagcttcctgattttgccttcaaatcagttcctgcatcagtctgtggaagacctaggattttataggagttcaaaaattattttgttctttccattataccatgcgctttactggttatatgctcaaaagttttgatgaattgaaacccctgctaccctcttgctgggaaatataacgtcctctttatccatattagataatggtcctttaagaacttgttaattttttaatgaccaaaattgtctttaactttttaatgaccaaaattgtcttctatattttggtcctattttggtggccagtataagtatcaaaattgcatgattgaaactgtttcattagggaacttcacttgtaatcttcataaataaggagacttaataagcttattatctaaattttcatatggaagtttggtgaacacacctaactttgcattttggggagtcaagcattaggctactctttatcatcccttgatctctttctgcatccctgtccttcccaaataatggtaacttttttttgctggatgggctctaacttcaaactcaagtccatagaagttattgggccaatcttaataacgaaaaatcaggaagaagattgttactttccaccaaaccagttatgaactcccaacaaattgtcctggcaatcacctcttagacttagagggcatcaggaatgaattttgagtgcccatatggcttctgagctatagtctagctttcctctaagccttgcccccaatttcaacccagtttacatgcctagaatctattctgaccactatttaattgattaccttttgtgttgcatccaaacaaatctcttggtatatatttatctttcattaacagagacacagtgtactcctttttagctcaatttccctctctctctctctcattaacccctaaagaaaggggcagaataagagcaaagtaccgaagtcaccataaaaacttcttagggaaaccactttgcttctattttccatgtatattaatacctccaaaatgatttattactgatcaaagttgtatacggtaggacaagaaaaagcaacacaaaaccgagtccccagttacaaccaagttatacttttataaaaagacacagtgtgtaaactgttaattatttagcccagagtagttaacacatgcttactaaaaatatgacttttctggttgacatttaaatttgtcaaggtaagctacgaatagcaggatttctgcaaactaggccacaatcttacatggttatttcctttgagtggagaagccgaaaatatattaagctcttcaatttaaagtggttgatattatacccttgttttttccaaggcattctctttccttcttttttattcctgttttcttttctcattccctggtgaatactcaaagcaataagcagacactaatagattactctgagatgactgttttatatttgccttcctgaaattataaatattaatactgttttaaataaaaataacttttggttgtattcatttgaagagttttttttttctgtagtggctcaggattttaaaagtggttcgaaaacagtataccaaaaaatccacctaaacattcttgttgctgtttaaggaacgcagagctcatgtattataattctattctattttattggaattaattcagaaaatatggtcgaccaggtgggatcaaagggttttgctacttctgaagattttagcatataaatgcaccacaacagatggttaaaggatcgtttacaggtgtgacagcttctgtaccccgttgccctaaatcaatttaatagtgtgttgagttggctgccttggcagacatttagctgtttaaaaaatatctacacagtatatagtcaatgagaatcttattataattgcaatgaattcaatagttttgtccaatgaggagtcaggaagatgaagttctcttccccaagggagagtcaagatcatagatgctgatctttctggtggcgatttacactcaaaaatccttgaattattacaattaactttatttttcttttctactatttctctgtctttacctttcctcatttttgaactttactcttagttataaaaaatttaaatattatcttttttagtggtaaaatatattaataaaggaagatagaggaatctaaatggtcccaaatgaaaatatgtgaataaagtaccataaattccacaaccacttctgcagatgtatcatgtgttaaactttgaaactgcatgcaggtttataagttcaccacattgattgggtaatgtattggctttctattgctgccataacaaattactacaaaccgtgatttataacaatacaaatctattattttacagttctggaggttagaagtgtgaaattagtctcagtgggctaaaattgaggtgtcagcagggctgcttttcttcctggagtctctaggggataattcatttccttgccttgtccaacttctaggggtcacttgcatgccttggctcatggcctccttccatctccaaatcctgcaatggaaggcctggtctttcttgcattgtgtctctctagtactctccttcttttgaattcctctttcacttacaagaacccttacaattacagtggggccatctgattaacccaggataattgccccatctcaaactcagctcattagtagctttaattctaactgcaatcttaatttcatttgacatataacctagcatattcacaggttttgggaattaggacatgggggaccatttattctacccaccacagatgattgtaacataataaaagaaaaggaaataagaagatggaaaagtaaaaaaggacaatcaggaaagcaggttgctagtcccatctctgcagctagctagcaaggtgaactcagaagagctattcactttctctgcctcacagttaatcattttaataaataaataataacaactaacattctctgggagcctttagccatttgttcataaatacacacacgctctctctctctcacccacacacacatgtactataatcttatttaatcctcaaaatcctctacttctcagataattaaactgagacacagagagtttttgcaacatttcctgatcagtcagcagtaaataaaagaggcataatttaaaccatgaagtgttgtctaaaagcccagcatcttttattattaggttatactgcccttgttaagataggatattaataatgtatcttttcatttatctattaattagtaatatctatcaataaatattaattgggcacctgctgtaaaccagtaactctggtgagcattggaaatgcgatggtgaacaagcaaaacatagtttctatctctgtgagttgaaacacagacaagatggaatataaacatttgttcctgtagtctactcttacataacaaaccagcccaaaacttaatagcttaaaacaattatttaattacctcgcatgaatctgtaggtttacaggtatcagctgggcagttttgccatgtgtaaattcagctgggcttcaggttgcaggctgtaagctggaagcttgccatgtgacctgggtttcgaattgcatgatgactgcattctaaggagtgtcccagggatgaacaaatgttctaagacagaaaacacatgctgccagtctttttaaagactaggccaggggcttaggtaaggtcatttctgctgcattctattggctaagcctccttagagtgagttcatatgcaagaggagaagaaatatatttcaatcttaatagagctgtgaccaagaagctgtagccaactttattctgccacagccggaatacggaaagcagatgggagacctttatgagatgaagctgggagaggaaatcagtggctaaatctagcaaggcctcatagcaattttagaatctaaaatgacaacaatagaaagactttgggtagttttaagcagcatatttaagcatagttcagaaataatttatagataagatcactttggagaaaagagtgaaatcccaggatagaaacaatggtgacttagactagaaaggtaggtagggatgaagggaagtcatatgtgaatattgttcagaaggcatatttgagaagccatggtgactgctgcatgtagaaggtgaggtagcagaaagcaaggatcttccttctgtcttgataagttagagagttatttattgaattaattctcaatggaagagaggaaggaaggtctgaagggaaaatggtgagttccgttttagagctatttattgaacttaagaggctcataaaacatccaataaaagttgtctagaaggcaatcaaatgtatggtctgggattcaggagtaagatctgggttggagatggagaactgcattgcataactgaaactatgattgcggatgagagtacctaaagtgaaaatgtggtttagaaagaatagtatgcttaggacagaattctgaggaaaccaacagctgatggtcaacagagtaggtgaaaatcaaaggtaactgagaaagagcatccaggaaagtaggaaaacaatgcttaaagagtgtggtgtcgtggaaggcaagaaaaagcggtttccagtaggttatgaggatctctgtggaatgctgctgagaggtcagtttgttagctagagaaacaaaagtcctcggagaccttggcagatgaatttggtagagtgaatttggtaggcctgttgcagtgagctaatgaatgatggaaagtgagcaaatggggatcaggtgtgggccatggacttatctggagatgtttggctgcagagaggagagaaggagtagagaatgaggtgttcagcaaggttgttctatcttttgagagactcgaacaagagaaggaatcagttaaaaaataaaggaaatggccagttgcagtggctcatgcctgtaatcccagaactttgaagttggcggattgcttgaggccaggagttcgagatgagtctgggcagcagagtgagactctgtctctacaaaaatatttaacaattagctgagtgtggtggtgtgtgcctgtaggttcagctactcgagtaggctcagctatttgagagacgtaggcagaaggatcacttgagcccaggatttcgaggttacagtgagctgtgattgtgtcactgcactcaaacctgagcaatttaaaaaaagaaaaaaaggaagaaaggaaattttgagaatctaggaaaaaaaggatgctagctttgtgttaaaaaaaaatgttgggctgggcacggtggctcatgccagtaatcccagcactttgggaggctgaggcaggcggatcatgaggtcaggagtttgagaccagcctggccaatatggtgaaacctcgtctctactaaatatacaaaaattaaccaggcgtagtggtgcatgcctgtagtcccagctactcaggaggctgaggttacagtgagctgagatcacaccactgcactccagcctgggtgacagagtgagactccatctcaaaaaaaaaaaaaaaaaaaaaagttaaaaaactttgaatctttaatgtgggagggatatgaaaagcaaaattgctaaacactgtaaggagtttctgctaacatttttgttattaaagacctatcatcctgctgctgttattgacaattttctagttaacattaaacattttgcctgtatgttaaaatttaaaaatatgaccatgtctgtgacgtggcatgtatgtgagtggttagtttattgttgttgtttgtttgttttttcttggaacttttgaattaagaaatggcatagtttatttgtccttgggaattttttgcactgtcacttgtaagaatagagactatggaatcagaaatttttaacattaggagcagtttttttgaattcttcttgacatggctgagtaacaagtttctggatttctttgaaattttaggactgaaattgaaacaatctcaactcttgaattttttatgtaatgcatttaaaggaactctttgtatgaaaagttgaagtgttgaaaggagagatgatcaaagtttataaggtttggaagataataaacaagaacttatccaacaaattttataatgctataattagaggacacacactgaatgacaagaaagagagatttagggcaatcaaatgaaatgttcctttaaatagtcgattttaaatttatgaaatattaactaaagaggtggggcatagaaaaatacaaacagatccaaggggattcataaacgagacaggtctttaatagtatttgagttattcaaggttatactgaatgtttggaaaatgacttcatttgttttcataaaattgtcttacatgacacagataacaagttacatatgcccaagggaatcttggtgtttctagtatgggactggtgctttatgttttcatgttctagaagttaatagtatcaaatattattgaaataagtaagctcactgtctaaattagaatattagttctgtggcttacctaaatgtgtgtccttgagcaaattatttaattttgtcgtctcagttttcttatagtgaaaaataatagtacatacctcaaaatattttaatgaaaaatatgtgtattaacatacataaagaatttgtctttattgttgctgttataccaagatactgtattattagttctgttgcaatgacattttaaatatttaaagcagtttcaaactgagctgcatacttgtatataaataactaaggaaaggtagtatactccaaaaaattccttttctaaaaatataatttatttgtattggtttcttaatctagtagatcctacttattatttatttaatttaattttattccatctgagtaaattattcaactttaaattcagggaatgctttttttcttaggatataagttatcttttcttgatgatgatttatgaaaaaatagaaagaatttaaaaaccaagaaaggaaggaaattgtctggaagtcacataaatagaccttttctctttttgaatttagcaaatggtatgggcatgggttggagagaattagaaaagtaaaagtgttccatgtgaaacccacctaccatgtacatgcataaacacacatgcatacatagaaattatgtgttatgtatacttacacacacatacaagtacacacatataatataggctatagcttagtgcagatagtggtagtatgggaggttcaattgggacagttgttttttatactctcctcacccctcctttaattaataactctcatgctatttgatgccacatggaaaagaagatgaaaaaaattgtggaagacatggaaaatcatttttagaaccaagaaaggtcaaaattaggtgtccttcttggaggaaagagaaagatgaaacccgaaaacactggaatgacctacctatggtctaggtagatagaaattatcatagttgttaataaagtcctgtgttttcttgctccccaaaacggttctgagaaataatcatttaatttgagtgttagagcttaataaaactaagaaattgtctagtaacatttgctcattttataaattagtaaacgtacctctgaaagcttaggtaggtaacttggccaagatctcaaagggaactaagagatgaagtaatagcagagttctagactcttgactggcctgaactgttcatcatcatcaccactgcagcttcctaagaggcatgacatgagctttcaactgatatcttttcttttcttaatagtagattatacaagcctaggtgtttcatcatttaacaaatatattatcctttagatgttaaatcaagaattatttgaaatttcatttttggaagacagttatggactccttaactattttgaaatataaatttaaatgtgtctgttaaattttacttattttaaaatgatttttattcggtatctacagcctttatctgtttaggtatcttttttactaagacagagactgaatgatatacttttgagctttcttttatgctcatatataagtaccttgaaaagtgggcccatcagtctttttataaataaactcggatttttctatctttaataattcataactgccttctattaatatctgactttttccattaaaagtgacttcttaagaggctctatttaaagtgattttgagaagattccctttgtaagtataaactgttttcataattaattcaaatgatgctcctcaaatttgtataacttttaatttcatatgtgatattcagttttttgaatgagggttggagctttatgtggcagaggagacttcaagtgcttccattcttccactgccttgtgcctttccagaaagttggtgtgtgttccgtgtaatgacacctggaagtcctggcactctaaaaggcagtaggccattcacttcaaggtattggctcatgctgagagcataccacctggcagcctccacagcttgtgctttcaggtttccttttggcagagaactcaaagtgttcaatttgtggtagaaattgttgaatagttaaaatgtgtcagaggttgagtcgtattttccttgattattaaaataacttaaatatcaccaaacaaattatatttatgagcaaacagctcattattttattcacatatttaagactttaaatcttttctgaccactattctagaccattttctgtgctcccagttgatggaaaagtgaaatatacagtctttaactccaactcatactctggctggaaaaaacacacaagcgaactgattgtaagactatgacaccttgtgtgcacccttatggtgaaggattacacaaagtattacggcagtgctgggaacattgggcccagattggatgtcaggaagacgttcagaagagaagcgaagcattgaggttaatcttggagagggaggaggaggccgtctgtagtgtagtgagaagttgaatgtgtggggaatagaaagactctcaattcagttgctgggttaaaaaaatattgtacattattggaactacaatttgtttttttttttgcattgtacatttttaatgagctgtttatttctatgagtttgtttaaatctttcaatattaagcaaagttcagaaaaggaaatatttgattcatttggatgataactaaccatattagaatatagattattactggttcatactagtagcgtattaagagaagaaaaaactcatgcacaattaaagcactttttctgtttttttactcaacaacaatcaactcggaagtcttctatgaccctatatatgtggggtttccctacacaccaagcaagtagtaatttctgtagcagacaccaggtaggtgtcctccaatttaattctgacacagtctaccctgagatagcatcagatcccagtggttgaaggctcagtccccaagaatgttcccctccctgctgctgccttcagatgctaaccacaagccacaggttgttttagctgtgctttggaggctataaatcagggttcccatgatactctttttgggtttgattaatttgcttaagcaggtcacagaactcagggaaacacttacatttacaggtttattataaaggatattacacaagataaatatgaagagacacatagggtgaggtatgggaggctgctccaccctccagaaacctccacatattccactatctagaagttctccaaactctgtccttttgaatttttatggaggattcatcacattggcatgattggttaaaccactggtcattggtgatcgacttagtcttcagcctctctgccctccctggaggttgtgggtggagttaaaagcaacaaccctctacaggccttgttttttcaggcaattagcctctgtcctgaagctaccttgggttgccagctatctgtcaactcatttgcctatagaaagacatcactttgaagtttctaaggatttttaggagttgtttgtcaagaaacagggttgaagaccaaatgtatatttcacagtatcgtactttctgtgctttattcctgcaaagaatgccttttagaactggaaaaaaggactttcggaaaatgtattttttctacatttttctgcaaagtaaacacgcatagattaagaaaaattcaataaactctgataacattgtagatcaaccagctgtgagttgtttgttttttaaaatagctttttgttattttcaatatatttagattatcttggatttcaaagcaaccctatgaagtaggtaatgttatttgcaaataaggaatcagcatggtaaagggaaggcaaatgactgaccacaatcaaatagcaggacttctcgtttccagactggtctgtaaggaccttagaatttgccactccattaaactaagtaaaaatctgaacagacaaaaatcaacaccttttcttgatctaacacagatgcgaagtcacagggcaatttgccacccctaaaactggagagacacacaggcagatacatcagagaatcccaaccaactggagcagaaactcctaaggagaaacctccacaggaagaagtaggaaaacctggactgtaattgaaaaattgttgcaggctcagtgtggataaatctttgagttaaaaactccagggagacccagtcattgctcactcccttcatcactttaatgtgtttcaccttctagagttctaccagattctcacagtgaatatcagagaaaaatcctcttgtgcttctggcagggagaggggaaaatggctatttaaaaatacgccagagcattctgttcatcttaaccaaagcctgcccttaagagaaactacttcaccaaagcctgatcttttgggggtttctcagagcccagctgacctagagaaggggaaatactcaacactggcctctgccaaacattctgtctcatttaagatcagggaaaataatggaaaggcacatgtgaagttcatggctaatgggaacaggctcactaaaagatggagatctaagcatagggttatagaacactttccttttccccacatcttaccaccatatcacagaaagtctgtagtaaacccatcatatccaagggttccacatccatggattcaaccaactacagatcaaaaaccttttgacaaataaaaaagagagaaaccaacaatacaacaataaaaatgatacaaataaaaatatactataagaaatatttacatagcatttttattatattagttattataagtaacctagagattatttaaagtatataggaggatgtgtacagattatttgcaaatgttacaccattttatataatgcactagagcatccacatattttggtatctccttggggtcctggagtcaactccctgcaggcaccaatggagaactatatttacggtggttccttttacccagtacatcatgtccagaaaaatacgagggatactaaaggcagaaaacagctgaaacagacagaacaagcatcagaaccagagtcagatatggaaagaatgttggaattattggatgatgaatttaaaacatcaatgattaatatgctaagggcttcaatggcaaaagtaaacagtatgcagttatagatgtataacgtaagcatagatagaaattctaagaaagaataaaaaagaaatactagaggtcaaaaacactgtaagagaaataaagaataccttgaaaggcttgttaatagactggaatgactgaggaaagaatatctgaacttaaggttatgtcaacagacactttcaaaactaaaaaacagagagaaaaaaagattggaaaagtaaaacagaatagccaagaactatgggacaactacaaacagtgtaacatacatacacataatgggaatatcacaaggaaaataaagaaaagaacagaactaataatgactgagaatttcaacagttagtgtcagacattagactacacatccagatatctcaaagaacaccacacaaaataaatgccataaaaccccatacctatctacatatttaaactgcagataatcagagataagtaaaagatatgtaaataaacatacatgggaaaaatatctcacctatagaagagtaaataaaagaattatatctgacttaccctcagaaaccatgtaaacaagaggagagtggagtaaaatagttgaagtgttgagagaaacaaaaccactagtgtagatttatgtattctgccaaattatcatttagtagtgaagaggaaatacatattttcccagacaaacaaaacctgagggaattttttgccggtagacctaccttgcaagaaatgctaaagaagttcctcatcaagaaagaaaattatataggtcagatatgcagatttacataaagaaaggaattccattgcagaaggaataatgaagataaataaaatattttattttttttccaatttggataccttttatttcttttttctttttttttaattattatactttaagttttagggtacatgtgcacaatgtgcaggtttgttacatatgtatacatgtgccacgttggtgtgctgcacccattaacttgtcatttagcattaggtgtatctcctaatgctatccatcccccctccccccaccccacaacaggtcccggtgtgtgatgttccccttcctggttccatgtgttctcattgttcaattcccacctatgagtgagaacatgcggtgtttggctttttgtccttgcgatagtttgctgagaatggtggtttccagcttcatccatgtccctacaaaggacatgaactcatcattttttaaggctgcatagtattccacggtttatatgtgccacattttcttaatccagtctatcattgttggacatttgggttggttccaagtctttgctattgtgaatagtgctgcaataaacatacgtatgcatgtgtctttatagcagcatgatttataatcctttgggtatatacccagtaatgggatggctgggtcaaatggtatttctagttctagatccctgaggaatggccacatcgacttccacaatggttgaactagtttacagtcccaccaacagtgtaaaagtgttcctatttctccacatcctctccagcgcctgttgtttcctgactttttaatgattgccattctaactggtgtgagatggtatctcattgtggttttgatttgcatttctctgatggccagtgatgatgagcattttttcatgtgttttttgcctgcataaatgtcttcttttgagaagtgtctgttcatatccttcgcccactttttgatgagtttgtttgtttttttcttgtaaatttgtttgagttcattgtagattctggatattagccctttgtcagatgagtaggttgcaaaaattttctcccattctgtaggctgcctgttcaccgtgatggtggtttcttttgctgtgagaagctctttagtttaattagatcccatttgtcaattttggcttttgttgccattgcttttggtgttttagtcatgaagtccttgcccatgcctatgacctgaatggtattgcctaggttttcttctagagtttttacggttttaggtctaacatgtaagtctttaatccatcttgaattaatttttgtataaggtgtaaggaagggatccagtttcagctttttacatatggctagtcagttttcccagcaccatttattacatagggaatccgttccccatttcttgtttttgtcaggcttgtcaaagatcagatagttgtagatatgtggcattatttctgagggctttgttctgttccattcgtctatatctctcttttggtaccagtaccatgctgtttttgttactgtagccttgtagtatagtttgaagtcaggtagcgtgatgcctccagcttttttcttttggcttaggattgacttggcgatgtgggctcttttttggttccatatgaactttaaagtagttttttcctgtgaagaaagtcattgttagtttgatggggatggcattgaatctattaattaccttgggcagtatggccattttcactacattgattcttccaacccatgagcatggaatgttcttccatttgtttgtatcctcttttatttcattgagcagtggtttgtagttctccttgaagaggtccttcacgtcccttgtaaattggattcctaggtattttattctctttgaagcaattgtaaatgggagttcactcatgatttggctctctgtttgtctgttattggtgtataagaatgcttgtgattccacaatggaattaaagtaaaaaccaataacagaaagatagctggaaaatccccaaatagttgtatattaaacaacacacttctaaataatacatgggtcaaagaagaaatctcaacataaattttaaaatattttgaaaatgaaaatgcaactaatcaaaatttctggatgcagcaaaagaagtgcttggagggaaatttataacattgaatacacatgttagaaaagaagaaaaaagtaaaatcaatactccaaatttctactttaggaaactggataatgaagagcaaataaaactgatgtaagcaggagaaaataataataaaaaatggagcagaaagaaatgaaattgaaaacagaaaatcaagagtgagaaaatcaatgaaaccaaaaggtgtttttttaattttttaaagatcagtaatatcaatcagcttctagacaggttaactgagaaaaaaagatagatgatacaaaatgctaatataaaaaatgaaagaggcactaccactacagatctcatggagatgaaaaagattaaaaatagagtcatacaatgaataactctgcatccacgaatttgacatactatattaaatggaattataatgtaaattccaatgtaaattccttggaaaatacaatttgcctaaagtcacaaataaagaaatagacaattgaataaacctatgtctattaaagaaattaagtcaataattaataattttctgaaaaagaaagcaccaggcccagataagtttactggtgaattctaccaaatatttaaggaagatatgccaatttacaatagaagccaagggagtatttttcaggtctttttataagcaacattaccctattactaaaagcaaaaagacattatacaaaccagaaaactacagatcaatatctctcatgaacatagacacaaaaataattaacaaaatattagcaaatgaaacccaataatgtataaaaataattacacaccacagctgtgagatttgtttcaagtggcaaggatagttcagcattcaaaaatcaattaatgtaatctatcacatcaacaaactaaaaaagaaagatcgcataatcatatcatatgcagaaaaagcatttgacaaaattcagcattcattcatgataatgattatcagcaaattcaagttaggagaaacatcctcagtggataaagaatgtctacaaaacatctgtagctaatgccatacttattgtgagaaactagaagctttattgctaagatcaggaacaaagcaaggatgttctctttcaccacttcttttcaacataatagtggaattcttagctaatgtaataatacaagaaatggaaattaagttatacagattgggaaggaagaaataaaactatctttgtttgcagataattgtctgtgtagaaaatctgtatgacctgacaaaataaactcctggaactaataaataattatggcaaggttgcaggattcaaggtgaatatacaaaagtcagttgcttttctatacaacaacattgaaccagaagaatttgcaattaaaaatacaaccccccacgaaatgaaatactaaggtatgaatataataaaatatgtatgctatatatatatgtatatatgtatatatatatgtatatatgtatatatatgtatatatgtatatatatgtatatatgtatatatatatgtatatatgtatatatatgtatatatatatgtgaggaaaagtacaaagcactgataaaagaaatcaaagaactaaataaatgggaagatattccatattcatggatagaaagactcaatgttgtcaagatgtcagttcatcccaacttgatttatagattcaatgcaacctcaatcagaacctcagccagttattgtgtaggtattaacaaacttattttaaagtttatgtggagagaaaagaatacctagaattgccaacacaatattaaagaagatgaacaaagtcagaggactcataccaactgactttaagactaccttactacaaagttacagtaatcaagacagagtgatattggtaaaacagtagacaaatagattattggaacagaatagagagcccagcaatagactcatataagtatagtcaactgattatgacaaagaaacaaagacaatacaatgggcaaaggtagtctttttaatacatggtgcaggaacaacggaatattcaaaaacaaaaaaagaacctgtgacacatatcttatgccttttatacaaattaactcaaaagggagcataggactaaatgtaaagcacaaaactataaattcctagacagtaacatattagaaaatctacatggttttgggcatgttgattacttttaggatagaacaccaaaggcacagtctatgaaagaaatacttactgagctggatttcattaaaattatcttctgctctgtgagatgcagtcaggagaatgagaggacaaaccacagaatttgagaaaatatttttataaaagacatatctaataaaggcttttatctaaaatatgcaaagaactcataaaactcaacaataaggaaatgaataacctgaataaaaaaaaatagacaaaagacttgaacacacatctcattgaagaagatatactgaagatatactgcaaataagcatataaaaagactttccacatcatatttccacaataagataccactacatgcttattaggatgtctaatatccagaacactgacaacaccaaatgctggtgaggatatgatgcaatagaaactcccatttattgttggtggtagtgcaaaatggtacagccaatttggaaaacaatttggcagtttcttggataactaaacatacttttatcatatgatccagcaatcatgctccttggtatttatccaaatgatttgaaaatatgtccatacaaaaacctgtacttgggtatttatagaagttttattcctaattgccaaaacttggaaacaaccaagatgtccttcagtaggtgaatggatactgtggtacatccagacaatggaatattgttcatcactaaaaagaactatcaagccatgaaaagacatggaagaaactttattgtatattactaagtgaacaaaacaatttgaaaaggctacattctgtgtgattccaattatgtgacattctggaaaaggaaaaactaggaagacagtagaaaaatcagtaattgtcagaggctgaaggagggaaggatgaataggcaaagtacagagaatttttggggaagttgggtgatattatgtttcaatgtagattcattaattgtaacaaatgtaatactactctgatgtgggatgtccacagtaaagaactaataatatgcatagtattattagcaatttcttgatgagtgcctctattttttcactatttatacataagataattgaaatttacccaggtagttaaggctagatttttaatccaatgtttattcaccctaacacctttcttttataacataattatcaatgtatttaggaatagaatagtgatatccctagaaggcatctgatgccttgtatcatcatttttattttgtttcttgttggaataatctcttctattattaaaaacatatgactcgcctgggcgtggtggctcacccctgtaatctcagcactttgggaggccaaggcgggtggatcacctgaggtcaggagttcaagaccagcctgaccaatatggtaaaaccccgtctctactaaaaatacaaaaatcagccgggcatggtggtgtgcacctgtagtcccagatactggggaggctgagacagaagaattgcttgaacctgggaggcagaggttgccataagccgagatcacgccactgcactccagcctgggttacagagtgagactttggctcaaacaaacaaacaaaaacaagtatgactcacataaataagtacaatatttgtcttgtcatttggctaaagatacaaccatacttataagtagcaaaatatttggaagacgaatacccttattaatgaaatgtcaaggaactgtgatgcttgagagttgaagagtcacaggaaaagtgagcttgttgaaatcccttagaatgaaaatagaacaagcaagtagagagttagtgcccagtgcaacaatcatcaggtggacttctgagtgtcttggaagatcttagactgtaagtaatagtgataggaaaaaggtagttgtattaattatatattactgcacatactcttttttcctaaaactttatggctttaaacagctatttgatttctcatgattgtgtggtaagttgtgagtttcttcaactagtgtttcttaggttcacttaggggtctgcattctggttagtgagtcagctgggagctgggatggttgggtctctctcgtgtgtgcgtgcatgtatacgtgtttcccaagaaggctagactcgacttcacagacagtcttagaacagtgttctaagagagggaagccccatgtgcacaagtgcttatcattcctctgcttgtattacatttgcttatgtcccattgctcaaattaagtcacacagtcgtaacttgaatcaaggagggaattacatgcaggcataaataacaggagtcatgatttattctgaactatttagtaacagtctattgtggtctgtcctctggccctgatgattcaggtaaagatacacatattacacacactccatccctgctgccaacacccttaaaatctcattcaattaacagtctcaaagtccatgatctcatcatggactgcatgcaaagctttatggtaaagctcctccttatccagagaactgtgaaataaaaaataacagtttttccatgctcccctgtgtacaatacccaatgtaaataggtgaaaggcacagaataacctcaacaattcaattcaataatttaataacagaaacaggaggcacatagaattcactggcccacagcactactgaaatctgtccattgtatgcgccagagttagagaatgttcattaattggtattactaattactaacatatcatacttcctagaagtttccctaattcattgctctctgctccacttggtcctgttttttgggtactcggatctgtcatttctttttagtaagagctggtccatattttcagtgagtagctttctcagcctgtttatttcccataaaaaatcattttgaactatttgtatgcattttagttctagcagatttaactaccctaaaacttttgtagactttttaatggttttatttggggctcattccatgttcccaaagccatatccaaaagtttttcaagagaatcttctgctttctaagaagttctctgtgacaatacccttaatattttgtaaatattattttgtaatatattttgtaaaatatattttgtaaaactctctcttttttttgtctaattgtgtgggtctccttaggcaaagcctcacatcttcccaaggtcttaacaaagggttctgtagaaacaactttgattcagtctttaccctgaagccatttcttaactgtgccaggtggagatactgaaaatgtgaaacactaaatcttccaaaccagcacgtcctagcttttttatgtatcctctaaattctacttgcaaattgaacaggtctctctttagctcatttctttcttgtaccttctcataagcatctaaaagatacaaactgacactttagcatgctgtctcaaaatgtcctcagccagattcacaggttcactaagtacatttccaatcttccagtttgttacaggtgacagttatgccaatgttttcactaacacaacacatgagcttccatttttgctgtgtccaatagcagttttctactgccattttggcttctgttaactgtttatctgccattcttctaagctttactaatagtctctgtgatgattttttatcctctgtccattgtgcggtcccaaagtcagtaccacatggttagaacagccaatcacatggccgaacccagagccaatgcagaaggcaagtaggcaagaatgtgggtattgggaggtgtgatttattacgggacatgagtggaacaatctaccatatgacctatgtcaacaggtaccctttctattaagtagtaagaagtaggagtcttaaaagaagattctagaaaaggagagtctttagaaggaagacagttttgaggaattataaagattgggcaataagaatttgggaaaagtttaagaatgaagaaaatagtgtgggggattgttgacatggatttccgaagacctggtagaaggatgatatggggttaagaggagtaaggatgaggcagacggagacaaaaatagatttcaggagttcacactttggatcaaggagggatgagaaggagatagctttatcctgtgccagtttggtagtactaattttgtttctggtagattttgcttcagccagaaaatatattgttaaagatttatgaaaatcccaaacaaaataatacaattaccatccctccatatgcctgtgtaggaacatcactcaggtctatttctggcaatgtttaccaatcactatcgttggcctgagcccagaaaatatgtatgagccgacatccaaaagaatgcactgatttcacaaaaatataatgaaacaaactgggtcacctactttattcactgacatagagtttgcctagatacatttaagatgctctttttacaacctcaaatatatgtcagggaaatatggtggaaaaatcagtgttttaaaacggattttatttttgaaatgtgaggttttagactattgaaatatctacctctagatgatattttttcaaatataaatgcttttctaaactttcctattatattttttcatatgtaaaagcttttccatatataaaagctttccagaatctccctcaagttacactgtaagagcctctcaaagagaatgctatgttgatttaatttggcttctgtattattaatatagtgaccccagttagcaaaataaagtttgagattgtcggactttgcagaccaatgcaaagtcatgtctgaaagaggaggtggtattctatctttccagaaggggcgtatctcctagctgaataatctgaggctgaaaatattagatccataatgagtgtgaggaagacccacaaaggaaattaccataattaatgtgatatttctaagtattaaattacttataatgtaggaattataaatatagtaatgcttacttagcttaattaaattaaataaacccttaatgagcaaaaacaatttcttcagtgcaaaaattcatcagaatcactggccttatataaacagtggatatgtgtattacatctttgtcagtttggatatggaaataaaccttttagtggctttaattctatttatcatattttaatatttgcaattctgtaatctaattttcctttgtgtttttcacttttaacctgtgattttgaaagttgttagaaattaatgtctttcctgaagtaaattaagacactcactagtaatctttagagaaaattagccaaatcttcattggtaaaatagagataagatttattttattaccttgtgattatgctataagatgaaagagatattagatatgatgtctttcccaaaggtaaaggtttagagttgtaataaatgactagttaatgacctgctttttgagattaatatccaggctaggataatgttagagaggtttttaatattgcagcattaatatagtaaattcatatttagtagaaaacagatatctgaagagaagtagatctcaggtttctgtaacacaatagcactttgacatttattgtttcaactatttgtaagtggcgtgacccagaagaaacttaatgagatgcaatttataattcttctgaagcccaagtttgaaataagttgaagttgtgtgagagggggaactgggtcagctagtggactaattaagtagtcagcatttatttcttaacacagcttggttgttactttattgagaacttaaaaaaaaagctaattaggacactgcaagtggcattaaactttccatgctgagacttttgtggacttacattggatgtgctgtattttctgttcttcatctcatccttaatgactttaatcaggttttcatatgccctgctctccaaagcatccattattcattcaaatcattttattaaatatgtcagacctacacacagttatacagcatattaaagcaaacatcctgataatgcggcacccagttcaagacataaaacattaccaatacaattgagatgtcttgagttccttccactattgtatgccctccatgtaactcatatctcatatttgatgtgtatcttttctacaaattccactgtattcttactactcatatggtttactctaaaaagagtatatagcttttcaaatttatgcaagcagattgactatcttctgtaacttgcttttcccttactcaaagatatgtatttaaaattcttcagcacttaatatttatagttctacatcattattttcactgccgaatattatttcattatatactccagtgcctggtggtttgtggatgggtgttttggtagtacaagcaatgcagccatgaatattcttttaaatatctccttgcatacatttctaagtgtttcagagcacaggcctgagaatgaaattattgctggtgtgtacttctttaagtctacaggattttgcccagctgttcttcaaaatggtttgatgaattcacatatctactgtcagtatatgacatcttgtttttatatgttattaattcttggtatcagacttttcactttgcctatttgtggatatggcagggtacctcaattggtcttaatgagcatttccctgatttatagtgtagatgagcatcttctaatttttcaattaagccttctgagtcccttttaaatgcaatgtctcatgtcattcttaattttatattgggttgtctgttttttacgtactgattcatagttctttagataaccacaattctaattcattttcacttatattggatacagatatctcgattaatgttgtgatttgcctttatattttctttatagtacctttttataaaaacttttaaagtagaggaatttataaattttttatggtttctgctccctgtgtcttgcttacactaccttttcctatatttaatttacaatgacattgacttatattttcctccactttaaaaagtttttatttttagatttagtttttagcctacctataatatttgtgtgtgtgtgtgtgtgtgtgtgtgtaaggcttttttccttatggttaataaatttcctcaaaagcttctaactgaagagtctatttccctcaactttgctacaatgctacctctatttcaaacattttttatatgtggattggcttctacgctctgtgtactgtactggtgtaatagttgaaagtgtctctgctattcttggtctcttgcttttttataaaagttcaattcattatttgttatagtaataattactaataacagtgactacaatttatagatcacttattgttccagctttgtgttaattcataggtgagcatgtctacatttatatttgaggagagtaaagagtagaggattaagtaacttggcaaatatacacaactagtaggtgatataataataaggatttaaacctatgtccaactgactcttgcatgtgttattaatttaataatacttctgaaattaaaacaagaatagctaagctatattaaactgtttctatgtatcaacctttgtaaaaattattttcaaggatcatttcctttaatccatgcagataatataccatatagaatctattatgtagaaactatcattatctcatttttacagatgaaaataattatgtaatgtgcccaaagtcatacagctgttattcccagtaatacttgttttttattgtatatttttatggtgcacaatatgatgtttggaaaaaaacaatttttcacacatgaaaatgtctattcaaatttttatttgaaaatgtctatcaaatttttctgtgatcttggacaagttatttaggctctcttatttcctcatccattagttcccaaactagtaacaaattatgacacttacatgacattttttttggagagttaaaaaagttaaaacagtattatgcccaaagttagggcttaataagagctagcttttactatacattcttttaaagaggacttggcatctttataatatcatctttctatccatgaaaatagtaaatctgtttatttatttgtctttcataatatcttccaataaagtttgtaattttctatgtgtaatttatgttagatttttatccttaggtgcaactatttctattcttttagtggttgattttggtattttagaaggcatttttatttcaggaaacaaatcaatacgattataggttacaatttattttctccttattttgtaggtattactctactgtcttccagtttcctttgtggcagtcaacacatctgctgtcattataattcaaattcctttatagctgttctttcttttctatttgattactctcacattcatctgttttcctggataaacagtatctgaagtagcctttgtgaaagtcaatttattgagttgtgttttctaaaatttaaaatatttttttgatcaattctagaaaaatttcagccttctctttaaattactgtctcctattctctattctgtctggaaacaactccaatctgttgtctggtgttgtctatttctttgcttgctttgatgattctgactaattctcagtaaaacatctattttaataattatttaccaggatgatctcatataactcctaaatcaatccattggatttttatgtttaatagttaaatttattattttggagattatttttctttcaaatttaactctgaatactttatagttccttactgaatgcttatattttcaatatcttatttactctttaaagacttaaaatattttacattgtgcatctgaaatgtaatattgctgttttttatttctgttgatctctgtctcattattttgtgtgtgggagtgtgtgtgaatgtattgttttttctttctaaaaaagttttgagcttacagttgggtctcattaatctgttggaatcctaggtgtcctggttggagggtatgttttggtttagggagcatatgtgtttatttgcttttgcttagtgattagagttaaattcaaaattgctttcgattaatttccagagttgaggttttccactatgtaaattgaaactgaaaaatggtgggttttgtggcctaaggttatgagttccaagaggtgacttttgtttccactcagagcagagtcgagtaagagatttttttttttatttcatccccttgccagccgaccaccttttcacaattctgtcctatgttctcatactagggagtatccaaagtctttctcttttctccgatgagccattaaaattcaagattctaggtaaaactgaaaattaattgtcatgaagacagtcttcaatgtcctgcctaacatttctgttttccgtgtattatcttgggtgtttttcttgtgatctgagtcttgcatatatattacattaaggaaaaaaggagagttttggagatattgagccagtcagattgctcacaaagaaagtgaacctagtgtgctgtaaaaatactgaaaagaatcctaataaagtattatacatttttaggacccctgtttggaaatactaaaaaacaaatattttcagatgtctcaaagtataatttttttttaattttagtataagcagaatcacaaattcttgtactaataaacttgaatgttgttgaatggtgcaaggagtcaccaataattgaatctctaaattgaaatgaatctttgacgtcacctggtctcagcagcaaagcaccaatatcaagaaaacgacagccaaaaccaaaaccagtttacattttttaggtactaaccctgtatcagatactctacttcctccattattttttctcttttaatctaattctgtctttaactttatttttttaggcctcgggttactcgatctccattggaacatcgctgtggcagtgtgccacagcattttataactaaagccactgagtcctaaaaatgttaagctaattatctaaggctatagtggatagcatatggcccacctccaatcctggactttatttatttatttatttaccacaacacatatttcctttatgagtatcaaaattatcttgtgtatactttatataatctctttcaaaattcagggaagttgggctatttaaaaagaactacagaagatttagccattagaaacagacaaatatcctctgtagtttgtattcagataggtggttatgtctaccaatgataatgttgaggttagggacattttggtgtatttctatattcagtagttttgcataaggtcttatgtttctttatgctgtataatttctggatgttttgaggaaataaatattttaaaattttgattatatatttggggtatgttatagtgataactggaagaaacattgagcggaaacagaagtaaaattgagccttgcttattttggggtgaaatatttaaaaaatcatttgttcccttttaacaatgtatttgtttttagcgttaaccttcctctgcagcttcattgctgacctgggtaagaagtggcagaaagtacattggagctctgctgtgaccaatgctgagaaggcagcaaagatttgatttgcaatcaaactggtttggttttaagtgttagaaaaaaatgttgtgaagggaaaatgtctacctgaacaggggctctttttaaaaaaactaatttcaatatgtcccttaaaattttccagaataatgtggacataaacacataaggacttatataattaaaaaatgttttttgtttagtacctgagcattgctggaagtaatgaaagtaaacatgagtgcatcagtgcccccaaatgttacatttatgaaatttaaaaaacatgttacaattgtctagagtatcaaaatcataagactttgcgaatacttgatgtaaatacattgattacattaggcaggttcttgctgtgtcccattttattttgtagaggttgtagaaatacagatgagaagataatgtacaggtaaaattcaagattcttaagaagtcctggttgtgtcatgaaaggcatatatcaatacttatcttcatttaacttgttacttcgaattgttttcttgtgacttgtgacaggaaaaggtatagcaaagattaaatttacaaattataaatatcaattaataaagtttcttgatggattatttgtcttatttggatgcatatcatacagtagcatgcaagcacacagacacacatacacaaacactctacaagtttatatattaaaaataaaagaaaagaattttaaataaaaagctagagagattatttttccctaatgtctttttgacttagaaaatctatcactactctggaatttatttttattgtctattgaaatgtattttcaggttttcttgtgacgttttctagctgcttctagactgcctgggttcaaatttcagccctactgtcactatctgtgttaacttgggaaacttacctgtctgtatattggttattgggagcattaaatgactttatagatgtaagaccttacatagtacctggcacataattttatatgtaagtcttagttattacttaaaagaataatggttatagaaatcagtcatactgtcctttttcccaaagcatttttaaaaatttcattcaattaagtggtagattttggtcatgcaattatacagcaataatacataatacatcatactaacttactttaggggaaatattattttatgaaagtactataaaattttgcaaacaatttggcaaaatcctatcaaatcagtatatggttacatttggtccaatgctgtttaatatgttttgagagcatgagatgtgctgagtaaaagaaaggtatacttacacatacacaaatataactttctctcttcctcattaatattcatgttgccttggacattctacaagattcgtattcaaaaactccattcttgtctggttacatcactgctttttttttttttttaatccagattaccctagaaggaactagttcatggaatagaatagcaatttcattcatatatagatccagcaggcatattttagttttcctaacttcgatgctgacttactttatattattcacattgataaaagatccattgtcatccttattgaagtatgacatatgccttaactttgttcttaaaagtttgaaatcagaacatatgctttgattcattgataaagtgttttagaagctctggttctccccagcttgttttttttatgatatcatctcttaaggacttggcaactatctagtggctctgaaaaagccagacaaccaacctgggtagttcacaattcagtattgatttttgctcctgctttattttcaccagtcgcatttaatttagacaccttaaaatggacaaatctgcaatatactctgtgatttatatacagaagtgcatatgttctccagaacaagacgttcattcatttagatatcttcgaaatgatggctttaactgaattcatatgtgcctattttccgtgatcacatgcagttgaaataacttacggtgaagcacattattaatattttcccttgaaattagctatcatctgctcattccaattttctccatgtttttctgtcacagaaattaaatagctattagaattctaatttccagggagcttcacgctctttcccgaatgcctccttttcagctgttcatttgttgcccacttcctttctccctctcaatggtttagctccatcttctggcctttactaatgaataatggttgctttgctatttttttatttgccttgttgcagctatggtggtatattcagaattggctatgaataattatagaaaaaatagacaataactaaatattgatgttatgtaacttgcaatatattttctcctattttttttaattggctgaggaccacagagtaaaacagagaatttgaggaattattcacataacctatgggctttttaaaagtccatctattgaaaaggaagaattatgagctgcataaaagagtttaattatatacattgatcaaatgcatcagataattattgaaattctcaattttcattgcacagataacatattaattgcatagatcccatattaatggtatactttgtagtttatcatttttattagaagtacagtagaaatacaaagctaaggagaaataatttcacaaagtagaaagttccaaaagtgagtagagtaaaattcttacaaaaatcattgctttctcacctagaagaatccaaaagaatcaacccaaaagctcatagaactgataagagggttcagtaagatcactagatataaaattatgacttgaaagccaatggtactatcaatatctaaaatagaaaatataaagaaaaatcatctgacagtaatataagaaagatataaaatatctagggataaatctaataaaatgtttgaaaggtatgaataaatgtgtgaaactactgagaatcataaaacagttcttagtcaatagtgattggctataatgtggtaaatattaatctctgccaattagtttgtatttctatctcatcctaagcaaaatgctaaagaaaaaaatgcaaaacaataggtacaaaaattttgcaaaaggacactgacagcaatagttatttccaaaaaagtgtagtaattaaaacacttgctttcatcttcagaaataggcatagggacatatagcaacgtagcataagataaatgtgacatttaaaaccaaggaaatcaataaaattacattaaaagcattgggaaattgaacatctatgtggaaacaaaataagttaggtttttactattcataatatccagatattaatattagaagaatttaatgtaaaagggatagttaaaaatcaaacatcccagaatagtttgaaaatcttagaatgggaaatccttgttacacaagacataaaatttaggaatcatcaaatgaaggatcgagaatttggttacaaatgtcatcataaacacggaaaaaggtaagagaaaaaggaagaaaaataggggctttacatatgaagaagattaaagtacgttagaaatcaaaacttaaagggtaatctaatagtaaaaagaagtgtacaaaatctaggaatagatgattaatagaggaaactataaaaatagatgcactttcttactaatgatgatgggaatccaattttcctgtttatcagtgaggtggctgatgaaaccagctctggagtcaggctgcctgggttgacacccactcacccatttctagagatgatagctgagaaaattacttaacttgcttccaagttttttaatgtctaaaatatggataatattaggacccatgtggctttacagtataacaaattttaagttaatacataaaatatactaagagcaatgcgtactgtcaagagtacaaaaacgtaagttgccattattaaaacaaaaatgaaatgtcatttttacctgtgattagtaaaaactgaaacaatgaaaaatatcaattattagtgaattacacacaaaaagttattttattgatagcaatgttaattgctacactatatttgggtgataatttgatagcatggataacctttcacccagcataagatttgaccaaccaatcctacttttaataatctgttctgcagaaataatagcacatgtgctccaagatgtatgtattcacatgttcactgcagccttgtttgtaatcacaaaactctgaacaatctaaatatctttcaattagggaatgttaataaaatgttgctgctatcttcaaactagggaatatcatacaatggtttaaaagagtggactaagtctgtatcaacatggtaatttccctgccagatatcaaagtaagccacaagataattgttctgtggtgtccttaatcaaaaacataacaaaaccagaaacgcacaaacaaattcgactcttactagaactatggggctagaggtacatcccacattattgttaacaagggttgcttctgggaagaatagtaagcaaagggaatttacatccttttaatcagtatgcttgtttaaatttgtgctataatatactcctgctatttttgaattacagacatttaatttagagtattcaaataaatgtaagggccaaaaacaaaataagctacaaatcctttctggaaggaatttgtttcacaccatcagttgtaactaggcgttacaatggaatagggcgacagtcagggcaatgttagagcaatgtgccatgatcccttaacaagcatgaagtcataattttaccaggactcaatgcatcaagggtgtgtgagtccattatgctaaagataatccctccaattccttggcaatttagagatgaatgctaatggcccagagcatttagcatatttatatgattttgcattatactatattgaaaaaaatgtgtcctttgaaaataaatgtatgtgggttaacacataagtactatggcacatgcgcaggaacccgcttgcttaccaacaagtaagaagagcaagaaagttctgtgaaaccttcagaacctctttgagtcattcaaaagcaaaagtgttatacaagctaatttgagggtatccagacagtaaggtgataaagttctgtcttttttttttttgtattttatttaaaggataaattttaagtagaaatcttatagtcatttgaacatttttcagttattttgtttaaaagtaggttttatcatagactctaaaatgattatttggactgagatgtcattgaatctatgtttaacacatacataatccctcggtcttgtacattctaattaagatcagacaagagattgcaggttttttaggcattaagaccaatggtggctataaacatgaagaagagaaaaaaaaagagagagagagaaaacagagcaagaggaaagaagaaatataaaacaaagaggaagaaatgtaaaacaaagaggaagaaatataaagaaagaaaaagtaataaaacagagaatgatattatttaatccttgaaatttattgtatctcacatacattttccatgagaaagtatgtgatgaataatatatatgcactacctgacattttctagaatttctctctttgatgttcagccacacaggcccaagtatgagctttgagggcatggagacatttgaaagctgagacttgccagcagcacacagctggctggtgtcacagcaaggattagacgccaggcctgcagacattcattcagcctggcactctttatccacaatattcaaatttcatcagggcatagagtgcccagaactcacatagagcatgagttgagcaagagttcacagaggatagaactatatgaatttataaggagaaaatacgtatcccaaagataaagaatgagactatcacttgtgaaatagcgcctgatacagacagaggtaattctctttcgtttatgtatccagaacccatcattaaaattcacatgagaattattgcctattactgctggttctacaattgcctgctatcccagataatgaatgaagccagaataaatgttatagattttttaaagctgcatataatatgggcaacagcaataaactttcgccattttacctcactcagcaaacataacatgaaggtcaggaggggtaaatatttgttagagagaaagaaaaatgtattattacagcctcattgtcttctactgctgagtgatgatgttgcatcaatctagtatttctgtgaaacattagatcaaaacgtatgcaaaagagaagtaatttatcatcataaatatttgtggcagagctatagggaaaatcatcattgaggcaatttatggaaaatgtcattggggtgtatgtttattattctttgcatttcctctgaatcacttggtgtttcattcagtagctatatattgagtgtctgtgctaggaactttgctgggctctggggaacaggagtgaacaaagtaaagggtagacttttaaagaaatgagagttttttgagagatgctacactgccaggtccagaatgggaaatcctttctgtccatagataggaaaagaatttgccccagtggaaaagtgaactttaaaataaccccattaatgcaaagtagatggtttaacttcatttcatcataagaagagaacattgtatttacctacattttgtgagagtaaagaaatcacaggtctatttttatgattccccccaatttttacctggaaacctaacattacatgcactatctgttacaataattgtatttttaggggaataaatgtcacttacgacaaactttaaaactttaacaatttatttcaattatgtaaataagacatttgaaattgtgggaatttttctctatattttcatgtgcaaaatttgttattgggcatatattccatgcaaagaaattcaatgtatgttccaggcaaaaaaatttacctcatttcatttaggttttcaattgcagcttgcgctgtgtactttttcaggttggtaatgtcccctttcttggtacaaacttctccacttacaaaatgtatatggaaatcttaaaataataaaatttcacaaatattctaaatattatattttcatactaaaaatgattgcgcttttttcctattaggagaatgaattaactacatttcataggtaattttaaactaacagctgttattttgcaaaatgataacaaaggataaaaatattgttttgacatgatttcagaaataccccactatcaacggaaatgaaattttctcataagaacccgttttatgtctttgctagaccattggttctgattgtatgttcatttgacaaatatttaatgattatataattgtgaaaacttctgatttggatattgcagagaatacaaaaattattgtggtttatttattgtcaataacacatttacctaataatttataattttttccagtacatctctatatattatctaatttaaacttaaaagaattctcatgagatagacaggagaggaattaatagccccattcaatagattaggaagcatgcttaagatcagagactcttctaccaggtgcccagggaaacatagagctgggcttccgattcgggcaactggggagtgtgctgatggagttcataattagggaggatcatattcagttgatggcaagcaaggaacccttcctggaagaattggtagttattaaatgacatttatcagttgcctgctgtgtgccaagtacttgacaggcattcataggtaaatggcacttcattctctcctttcaattagctcacagtttatgggcaaactagacaaatataaaacaggctaatacacagaaaggcagattgctttagaatcacatgcaggagcagcttgtaattcagaccacacagagcaggtaacacctgagcaaatgctatacgtgctcttctctaagcaattgcaagaaattgatggattttaagcaggagggttatatctgccatgagaggaaaaagatttattatgaaggaggctttttgagaggttatttcagccatctagtcaatagatgtttaaggaccatattaaggcaatgtcatgagagctggagagcacagatagagaggtctaatgggcaatatttggtgacaattcatatgctgagaataaaggaagagaagtcaagagtgattctaacattttttggcctgaagagatgggcttatttcaacacataagcacttgtcttgtggaattgatgaattttagactaaaggaaaatatgagcaaaatcctggtgcatgattaataaatagttaatatcaacattaattagaacattaagatgtaggaaagtcatgagagactcatagggccaacactcttttcagcttatgtttactttaatacttccctgtcccacaatgaggcaggtaggtaatatttttatcgttttttacacatgactaagctcagacagactagtagagtaacttgcccaataaatccagatagaaaatggcaaagccaggattcaaacccagtttgttctcacttttagcccctagagctgctgtttctgaggtcagagccgcccaagattcttgaaaacagaataataatctctctgtgatatttaattgtttagattaaagtaatatgtgtttagatattgtaaaacagtggcattttatgtatttcttttttctttttttattctagaaagctcacacatgagttcatgaaagaattgaatatttttaattaaaaattataccaacagggaaataaatacaaaataatcatgaaaatacattattgaaaaattaatatatatttacagtatatatttttatcagtaaataaaggatgacagctagggtgatgatgaaagtttggaaaatatttgcataaggagttgaatttgaccttgttaatagggatgagaccgctaaaagatagattttgaagaaaaagaaaaaaaattggaagacagatccttgactgatgcctttatgtgatgtgctttaggaagactaatatgacaagagtgtaaattgaaggaaggagagagaagaggtgggtcacatggcagaaccaaggagaaagaaaaggaaagtgaaggtgcaagagatgcttaagaagtactgttatggaaacttcatataagtggggaacttacctgttgtgcttaatactgtcttccccaaacctagaacagtgcatagtaggttcttaaaagtgctttgtaaatgtgcaatgaaagaagtagaataaaatttaaatggtgatggatgacatgcataggacaagaaagggcaagaaggtcattattctgaactattgcatataaatgatggcaatagttatcatgcatgagcaggaagggaaaaataaacacatagatatggttcatcagaataaaataaaacattttttcattatttttatggaattagttggaaatatatggttttagaagtttccatataatgaactgagggacactggaaggtgacagattgaagctaagcttttttttttttttttttttttttttgagagagaactattctctagatttgaacgttatattttatcaaaaatgactcagtgtggaacaccaaaacatagtagataaaattccgtttttttcctgaatcagctcacaatactcatcctctttgttgtgcattttctaaacctaacactatgcttgtcacatagaatatttacagtgcattttttggtaaataaatagttttaggagataactgggataatagtgaaggcttgggaaatatgtgcataaaaattgaatttgaccttgtggaaaggggtgagaccactaagaggcagagtgaaagaagataagagaaaacaattggaagacaaatccttggagaaggtctttttaatttaggatgtaggaagaagataaggcagtgaaagataattagagcgagaggaaaagtaccaagatggtataattttacttggcagctatgtggaaaagaattagaagagagcaagactagtagcagcggaaagggaaagaattttaagaggcaaattttggtctaataaattcagagaagctaagaaagctagatccaaagaagagatgattatttttagttaccaggagatccttactaacagatgatagggaaatttcagtactgaaatcaggggcaaactatgcatggggttaatgtcacaagtttaggagagaaggagagaggctttcagtggtttccatattttgatgtcagaattccttggtgatgcagcttttaccagtttttgttcaaactgcaaagaggttgttgccatttctgcttatgaagcagactatgctgattcattgaagtgaatctcaacttataaatctaaaatatgtaaaacaaaaaaaacatactcagttcttctccctttctactcaataactatgcgaggctatttagattttgttcagcatacagactgtatcatgtatgctacattagcagcaccaatgagcagagtgacctaagagaaaaagatgtgttggatgcaccatcagcattgttgttggcttatatcatctgggcttgtaataaaaagtgaaataatcagcaaattacttatacccaggagattatcatttctgctgtttgacataaagtgtcttttagaaggacttgccctttgctgagtttctcaaagttgatattaaatatttaattacagaactcagtgagagcatctttacttactcctttgcaatctggtttgaatctcaaaacataaatgcaattctaatattaatcaggactatcattgagaaacttataatagtgtctcacagtgttattgtgaaggtcatgaagctggaggtgaaaatgaggattcatgtttctttctttgcctccagatgtgactatatagggtgttggtattgtataactcattttagaaagttgtctttggattgattttcagagtttatgacacgttatttctgatagtctcggtggtagtaaaccttccttcattacaggatggatcaaagttaaggaaatggctttaaattttggaggcatcattggggaataaggtaaagatgaaaatgaataatttcccttctaatgaagtaaagagtaattccaaagtactgcagctaatattcttgtgaaaggtgtcagtaggttatgctgcctatgctaaattggggcaagcatcaatatttaaatacgaacagtcttggatatttggggataacatgttagaagcatagtgctaagtttttcatcttcagatggttaccacaaacggggcaagcaaagtaccttagtttaggtaagcattctgatggatttgattgattcctggctgtaaatctcagtggcattcttatcctgcttggggacagagacagtgactgtcctaaggtacagagagggaaatgagcactgttggccgaatggctgttaactgtatgcatagtcaggggacataagaaagaaatatccagaaaaatagaggatatatgcaaatggacacttgagtaagtgcaatgaagaaataaaggataagaagagagggttgagggagaccaaagagagtcaggagagaagagctattgttgtaaaaataggttcactggagaattagctgaagtgcatggggaaaaataaattgtcttctgagttaggtggatcattccttatgaagttgtgtgcagcttgtgcctgttgttgggtcaaagccagtgtttccagatggccgcaataaccaggaggtcccttgacaactcactccagggcctaaaacaaatcgaaaatgaaaggtatggctccttattaagcttgtctgtgtattcaaacagtggcattctttatcaggcatcctgctgatgctgtggctgctgttttcatcacagaagctatttcacttaagatgagaagaggtctcattaataaatcatattgcatgatattcctatagtacctagatgacatgcccacactttgcagggaaatggaattaaatagacccagagagaattttatagcaagtctttcttttatgtgtcatttggaatcatcaattgctgaacaaatttaagatttaagatatacctgtcagtacacatacacttatgtataaaataagaaatcactgcagagttttcctaggtgagatgaaagctatttttcatgtatgtgaagaaaggacatagttatcaaatacactaaaggttattttcaactctgtacccagacaagaacaaaaagtatgggcatgaataaaagacagttatttcatctttgccttatgttaaggtgtgaaataaatgtaatgaaatgcattcagttgctttttgagatatttcagtctgctttgtagaagattggtaataaaggatgtgtaaatttacatattacacaggttttcggcaaataagggccacttaaagaggcaatcttgctttcctttggattcataccgtacaacagttactaaacagtattgcctaatattttttgattgtctagaattggcaattagaatctgtacatattttagcaatgctcgtattcatgaaacaaatctattttttctacagaccatctatttttgtgaagtaaatacaatgatataagatagggtttgttttatccttcaaaaaggattattttaaaaggatggtagatgttatgttctaggttgttagattgtgtttctggatgactggtttccagtttttggattgaaatgaccccgagattgagaaatatcagctatttatctatttaaagccacatatttggccaggcatggtggctcatgcctgtaatcctagcactttgggaggccgaggctggtggatcacgaggtcaggagtttgggaccagcctgaccaacaaggtgaaaccccgtctctactaaaaatatgaaagttatctgggcatggtggcacatgcctgtaatcccagctactcgagaggctgaggcaggagaatcgcttgaacccgggaggcggaggttgcagtgaggtgagatcgcaccactgcactgcactccagcctgagtgacgagcaggactgtgtctcaaaaaaaaaaaaaaaaaaagacacatatttgactttactagtagctttaagcactgttctgcggatcgtcagtgctctgtagagcattacaggggatcagtcttggacaaagtaaccctttttctcgaaaagatattactggatttatgtttcaaaatattattcttattatattgtggagaattgaatggaaggaatgtaagtggaggaaggaggacagttgggtagatatttcactagttgggtaagataagccatattactttttaattaagagcatggattctgaatccagactttctattttgaatgtagcatctatctcctatgcaagtgtctttggtagttcacttaatattattctatgtgtcaatctttctatcagtaagttggaaataattatagttcctacctcaaaagttatcatgagaaaaaaatgaattaatgtaccctagaacatgccaggcacagggcaagcacaatgttaagtatatactgtcagtgaactaggatgtttggaatggggagaaaaataagtggcccttatttgagtatatcgaggtattataatgagcacataacttagttatggactgacttttgggggaaggagtgaaagcagatagtgtcatatgccattcactggaaatagaaatattggaagaggatgggggattgtgggagtgatgaggatgtgcaaatacaatactatattattatttgtttaagaattaatatgtagtgtaacatatagggtaagttaggtccatggggaagattaaaatgcaaagttttggactttatttaattgcttctcgactgagtgacacaatatgacagaagtagctttgtggggacatgcgtctgtatttatcggggagtctggtatctatcttgtcttaaagaggttttggtcagcatttggagtctatggaagcacattaacttttagatgtaaaagcatcataaatacagtaaagatttttaaaggaattggattatgtagggaatgagctgtcattaatgtgtataaatcttaggagactacagtttgttcttatagctaattttttttacccatacatttttcatatttgttcctaaaatatgttaatacttacatagcttgttaaacaatgatgtttgcattttcttgtaaccagaactactttttatgctttagaatcttttagatcccacaaatagaatgctaagtaaataagtgttaataaattacaatggatcattaaatctatatttctttcaatatgttaattttgtattttatgtaaaaggacattacgttttaagcaaattcatatgattgtgtgccaatttcaatgatttttcctttctatttttcctattcttctagtctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggtaagtgacagtatctcatctctttgtaatggggcgaattcaatgcctacacttgacacttctatggatgttataaagctacaaaggtgtgataaagcccaaggatcccttggtttaattttgctgtgataatgactaatgcaatttaaaacctgggaaacatatttagagtaaaacaacaacaacaactacaaaagctgtctgtgtacaacttagagagatagactgtatcaacccaatgaccaaatattcagttgtaatataaaaagcaattttttgcatcagcagctaaaagtctatgacagctatactactagtccaaggtgaatgaagtggcttgagtacatttaagtgaaacagacagtaacatacagttattaaatattgttatatgcaaaagttttatcaggcaggtagcattattattgcccttgccttaaaacaagattcccgaatctcagagaagttaaaggtttttctcaggatcaacccacgtatggtacagcttacacacaggtctctgataccaaacctatgcttttgacaccattccacataattgtttataatgggatgattttgaatagcatgccagtcttgattcattatgttaaaatgtaatggagggaggtacaacctgtatgtttctcatatcccttgttgtgaagtttagtattagcagacttgcttgatttatgtcatagaatcccaggtgtttttaaccattcccaggtccgtaattgggtgtcagtgggtttgtgtactccctaaattgtatgaaacatcttgtgtgtgtgtgttcatatggatatgtttttagagagagtatccgtaaatcaaagtcaaagcggtgagggacaacgattgtcctagtacctaagtaccatactgtgcttccctcagcagcttgcttcctggaatatttgtaggttcaaatgaaaacccagaagcctatttcgaccaagatagggcaccttgttaacccacaagggcagacaagaagagagccagccgtcagtcaattctccattgatcagtttgtagtcatttactgcagcaagctcgagtcaggagtgcaggagctaggtgtctgattctctgccctgtcctcctaatcctgggaatgagaacactcagtggaaaagccagtcagcactatacaagctgaaaaaaaatttgctgtgtcaacaactatgtccccctgctttgagaagggagtgctttgctattcccatagggaattaaaaactaaaaccgagaatcatttacagtaaatacagatttcaatgtgctggatgtttccgacgcacacttattaatgtgataaaagggcttataaaactgagcttattaaataatttttagtttttcctcttgttctctgctaacttctttagtattttgtgttgttcaagctagcctgaaatatgggtgtattcttaatacctctttcatccttgcatcctattgatgtgatttccactgcctaattatatgtctgtagacactcatccttgtcgttgccattaccccaggccaagccaccataatgtgttcagtccctcatctctccagttccacccttgtctttttttaatccattttctatgaagtagcaggaattactgttaaaaaattttttttggactgcattactctcttgtttaaaatacttcaatagcttctcattatgatgaggataacattgaaaaattttagttggctttaaggtcttataatatccaattcccactcaactctccattgcattctgctgtcttgctcactcattaaaggtaaatccatttgaccttctttcactttctcagatgcaccaaactctttcacttcaaatctctgcctgtatcactaattcttactcctccttgagaactgggttcatatatcatttcctcagagatgcctttcacactgttatctttcaaagcaatctcttttcctttatagtacttaggacaatttataatgaatgggtgatgttcattctgtcacttaagaattgcctattgagcccctgctatgttccagggactgtcttagtgtcataggataagcattatgtttttcatgtaaggtgtggcaataagctccaggaaaagagtgcccaggcagtgctcagtgtactagatattcagctcatgactctgtacccagtgcttcagataatgctagaaagagagttaatgttcagtaaatggtgttaataagtaaatgagttaaacatatgtgtacagtattttaagttcaaggtgattttataagctaaattttgcttgcaaaattgaagaattgaatgactaattctctttacactttgataaggttgactgaggatggcatttttagtttaagaatacacttcgccttcatccttaccctcaccattgctccctctagttaaaactgaacttttgagaaaaattcaaaaagacaacagctgatacaagtttaaaaaaagagaaactctagtgtgtgaggagagatactcaaaagacaggctctggaattagcctgtgaagatggatggacttacgtacttgtgaaaaaaatctggaacattttaaaatacttttattaatacttagaaatattaaatgaaattgaagtgatgagataatctacaattattaaattatacaagttgatttgagttcaagtgcatctgttgagataaaaatgttagagtgataatattaagtaataatatattaaagccaaaatgaccttatggatatattttcaaggtgttatcaagtagctattgatgttttaatgtgaaaaatatttcagtggccttctatctgaagttattttcagacataaatatgtaagactctcataatactggcaaaagacttgacctttgtgtaatattttacttggctcatggaaatggaatttttgctatttgtttttttcttattaatgacttaatttttatggctttgccatcatgctacattttaacgagtttattcatacatttagtgtgtgaactgttttcccccatttggtccgaaatcattttgcttatgcttcaaagtaggcacctccttgctttagtgtcacatgatttgaagaatgcacctgtgttccctttgtccacattaaccacagtctggaaaatagatcccatggtttcatcactctacttagatctctacatgcctcagtttcaaacaatttggtctgttcttgatgggctgtctcttcacctccttgattatgtgattatttttaggctctaatcatcctcactttttagagagtctaggtcaggaatatatattggttaattataatgtctaaattactgttctttggaatagcatagggtccaaatgtgaaaatgatctcccaacattctgccctaatcatgaactagatgaaaatgacttgaaattgttatatgctgcttagtttcactacctttagctagtgaaagccattcctgcttcctggctatctgccacaatgctgagcaacaggccaagagactatataccacttttaaacaattagagacatggatgcatggatagaaacatctttgtatagcagcatctttgtatggaaccctctttgactaatctaagtttactggtgagaggagagctgaaactctgcatctggtgccaggtgatcttttaggttgctggtgtcttctccttacccaggccatgtggcaacagcctgacactccttgatgaccctgaaaactgcatatcatcactccataaagagaaattcaacacatttttaacaatagagcaatggggttatctatgttaatgcattcaacattatataatagttttatttttggatatatatgttgtaagtttgaatcaggacttaatccaaatgtggtttttatttattggtttagtgtcaacaaggtaagataatacatttctacagagagtaggtaaaaacagaattagcactttatatctgtatatcttggtttcaatatcgagcaatattatttgtcctctgaagggaaggcactttgcctgcagttccaagaaaacatcatgcatagaacaaaaatgctttcaaattataattttttccctcatattcctgagagagctgatgagggaaatatatgttaatctaatttggcctaggcatgctgccatgatttagtgatcataaatattaatttatatgcttgaaagaataagtacagttaattttaaatggagcaaagaaaatatttttaagcagtaagacatggtttgaataaaatgtatattttggcagtaatcatttttaatttaaccctttaacgtgcaaactgacagacttcccctgtgtaccgggtgaccttttaaagggtttgcatacagacaggtggctgatggcttgtctataactcagagtgttattaatactgggtcaagatgagactatcactgactgactagtagtaatactttgggagaattttaggaagattgtcattttatgaataggttatacaactacaaccagtcagtaacaataggcacatgaagaagtaatgcaatttaacattatgtaatctagccattttttattttagcaaaacatctaagaattcagtagagtttagaacttacttttagactgtagcaatattcttgagggtttaaaagaacatactatattttaaatatatttaccaggaggaataatcttccagatttcttctgtttttagatgatcaactatgtatctcaacagttttgttttaagtaattcaataaaaataagtgagtctctgctatagaaattcaaatatcctaatgtagtactatggatattagagttgaataactattgcatactaatagctttaaatgaaccagtgtttatgcagaactcccattgtctatacaactttgtattctgaattacaggatgaatatatttatagatacttctgtgctagtttgtgtggaaggaatagaggcagatctcaagtcatactttctcctgtaattgaatacggtacaaagaggtcaagagcacaaatctgtgttatgtttgaagagtttaatttcactttcatatacattttcagtgattttcaaatttaaaaatggtatattgattataaagaaatcagacaatataaaacttttagttgtgaggaatgaggtgaggagatcaaattgagagagagtttgagagtcagttactattactgaaaaaaaaccacctagggaaatgggttattaagcattgaatggtggtctcttcaaattacacgtcagataatgcaatcacttgtgaattacttctgcctgttgttaggagataatttaatattattcagtgtcttctgatgaaactgaatttattaagtctgatacagcactacttgagcagtttagtttcttaataatatgtaagttttgttaggttccataggttacaaaatattaatcttgagagttttaataacagtgaatcctgaatccacagccactgtaaattacttttgacacgtagaacaaatgagtttgaaagtcagagaaatttcttggttttttttttttttttttttgaaatggagtcccgctctgtcacccaggctgtagtgcagtggcgtgacctcggctcactgcaatcaccacctcccagcttcaaggaattctcctgcctcagtcttccaagtagctgggattacaggcgcctgccaccaggcctggctaatttttatatttttagtagagatggggtttcgccatgttggccaggctgatcttgagctcctgatctcaagtgatctgcccaccgcacctggcgcaagttaggcatttctttaaatgcattctttttgattttatacatcatctctatattcttttgcaaggtgaactgccggaaattttagatttaggatttccacttggtgaaatccatttacaaagtgtcatttatatttaaactttcttataatatatgtcaaaagttgagacataatattaagagcattaccacttgaaattgtattatatagtatgctttataattaaataaacaaaatgaaataagctatttcagagaataaggatgcttactggtaatttctatatggtaatatatgaatagcacagagacccccatccatggatataatgtctttaagaaggtgacaagggggagttgaaccatgactgtgatgtaggaaagtagaacccagcaaatggaaagtggcttagaatttagatttctttttctcttacttgcagagaaaagtgggtagacttaatggctgttttcaagtacattgatagctgtcgaattgatcataatgaccagctgtgcgtgttctgtctctgcagatgaaaagggaaggatttaactgacctatagtgtatggaaatcataggcgatctgtgatgtgttttaaagatctgtcactgaaagtttcaaaaaatgacatatggtctttttacattatcccttgagaaatttaggtttatttatatcttttgccagaagactggacagaggaaactaatttcattttgccagaaaaaaagttaacttttttcagcatgtggttcaatcttccattctgaaataaaaataaattatttttaatgtttatgttaaaatattttaaataacaaattagaatgctataaagattcccaaacactcttaacatggctttattaaagactagtatatgagcaattttgcttgatctatatctctttttttccctgcaattatttagaaacaaataccagacatcctgccatctcatctgtaaatatttcagtgtttatttggaaaaaatgatttttatattttaaatataatggtaatagtattattatacctagacaattaacaattcataaatattattcttttttccactgtttgaagcaaaataaaaatgagatccatatatcgcaattagttaacataatttttaagactcttagaatgtaatgcagtttcccacagtctagattttgatgattgcaacactatggtgcttaaaatattttcttctatatatgccctataacttggtagttagatttagaagtgtgatgaaattcaagtttacattattggcatgaatgtagccaacactaaataggtatatacctattcaacaccaaaataggtgggttgaatattatcatttggagacatatctctgttatctctctttttgggtagttaccagtagttgatgtttgttgtcttgattcattaattccgtaggtgttacaagatggtgataatttcaaatatatattcatccatcatctattagctagagtatttccaaaaataaatatctttagttcattattaccctgaaagtggttcatataggaaatgcaggaaaatgcttgttttatttcattatttaccagtcttcaaattaattaattggttccctagcatctaccaaagtcaagcacgtttttaaaacataatttcatagatttaaaacagtttatgtatttaagtatttcgcatttattattctaattaatattcaaatgttcccatctttatttaaagagctcctcttcaaattagctcctgtgtgctttgaggtaatgctgatggttttagagagttccttcccttctggtgtcataagatgttttagactcatcttgtacactttttggccaatattgaatccataaaatttttaatggtggtttttcttttttgaaatagttttcaacaaaattgataattgactctttttcatagcaaaaagatttaaataaaatttggtatctgaatttagattttgaagagatatgttcacattaggtgaatcctacattttattaatcaaaagggactaatattgttagagaaagatgcaggcttttctagaataaggaagatgatttgctgagttctggattcattctggagtctcgattttgcgttgtttattaagttatcagtataaatgatgaatttggttttgctgtgaatagtagaaataatatgaaagacaagtttatgtagcatgtctccaagtgctaaactgaggatataacttttcaggaaataaatcctctagttgttgtaactcttagtcctaaatatgaggtaatatatggacaattaaaaaaacaataaaaattttccaagtgatatgatgctataagcaaagttactaacaggaaaatagacatatttggaaagagaagtaaatctatgctagagaaataactgccaccatctggttaataggtgaccacttcaatttctctgggatcattcccaataacaaaaaaaataacataacagaagactgtggaaggaaaaaaaaatgaacccaaactgctgacttgaaaacaataggagaaaatatagcagcctcataaagaatattgcctcttatcctcacatagacttacatagattcctcattcaaaatgtactcgtcttcttcaggatactaatatcaaatgacagactatcatgtatgactaaacaatttttttccattctgtaagagtaagaaatgtttgtgatgccatttcatttcacttaaaccaaagatattaacattacactttagtaatactctaaagaagacagctgagggtgttgaaagaaaaggatattattttctactcaaataatgactcctttggtcagaatagtaatatttaggtaatgagtttttgatgtgaagtgacataagtagaaggtgataaagatcatagctatagctttttttgaaggagtcaacattcctttagttgcacaaatatatcttccttaaaaatatattcactggcaatttcataacacaatcctgagttattcacgtatctttatcagtcatcatttttctttgccttcctaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggtttgctactttctgttttctaatgatgccagatatagaatatgcatgcaatgtcagcatttgcaatgtgtatttgtgtaaggtgcttgaacagcagtttttgctttatgttttatgtcggatgcagcaaagatcatcaattaaattatctctggcttcagttagcaatagcaaatggtcatcagtaatgctggcacatcatgttaatcattaaataaattcaataaataattcctgacttttatgttttatatgataaatgttaccctaaactttgatattttcatttgaaaattttaaatttaagtctgatgaactttttagagttaaagaaatagacatgtattaacttaagacaagttgagttctaagggaaaagtgagtaattcatgaaatttttggagttacatagaccatctatgcctccagaaagagtatgtagttatctttgcaagatatattttttttcttctgttaagggacttgtgccactataaaaaacattgatttgtgaaattaaaatatgtaggaaggacacatttgggctgtgtttgctatttgagaagtaaactagatgcatccccttggactgtttgaaagaatcactgacaccagtgataaggatatttttatctgtgcttagatactaccttgcttcagtttaaggtctttcagggtaggggagccatgcagtgttatcttaataatacaggtaaaatccaccatgatttacaaatagggtaagtgactagggatgatagtggcacagcatcaacattatgattgattgaataaggtctcctttactgatatctgcatctcttcctagctgaaaatgtgtgtgtgtgtgtgtgtgagtatgagtgtatatgtgtgtgtatacatatgcatatatgtacatatatatgtgcacatatatgtatttatacagttgaccctaccaatatcctaccattgaccagaagccttacagataacacacagtcaattaacacatactttgtatgttatatgtattatataccatattgttataataaagtaagctagggaaaagaaaatgttatttagaaaatcataaggaaaacatatttactattcactaagtggaagtggatcatcataaaagccttcatcatcatcatcttcacattgagtaggctgtaaaggagaaggaagaagaagggttggtcttgctgcctcagaggtggcagaggtggaagaaaatccatgtataagtggattcacacagttcaaacccatgttgttcaaggggcaatagtatacactgtggctgctagtgccttagaatactgtggaagtgcaaggaaaatacacacttgtgtatgcatttcttggctcttctagctttgaggaaaaaatttgattcattaatttgttcaacacaaaacattctgtaacataaatgttgattaaatcctaattgatatataataatacaggccctaagacatacaaaatagatctttcatggaatattgaataactgaatagaactaacttgttatgcaaaagaactaaatgttgaatgccagagaggtgaataatttcagtagaaaatcttgattctagtctcaagagatgaagttaagattgtttttaacctgaaggcctcttgttcaaatgtgaacctcaaaaatgcatttgaatttcatagaggttctcattaaaactgaattttaataatattcattagtctttggtttaaaaaatttaaggattcatgactcatcataataaatgttagtgaaagactatataaaaatatatttttccaaaatgagaagagagaaactacaaaagcaaacgggaatatattgtaagtgatgttttgattacataaacgtccatatggacatctattcaaaatgcagagtattttgcacatatatattataagtcccttgaatgtattaaatgagcacatgcaatggatggcctcagcaaacatttattgaggccatgctttgtgcctgaaatgagggatgcaaagaaaggtaagaaagagtgatgtctgcatcccatgaactcattgcttagagataaaaatgtacacaatgtacacagacagcactacagaattacaagttaaaatgcaatgtagtctaggacatggaggagaaagaacctttcttaaaaggggaaggacaatttgtgaagggttcacataagacgtggcatttggctttgcttggattcattcatttatttgttcagtaaatattccctgagtgtctaatgtttgccaggcaggcactgcagtagatccaaggaagcaatgttaaacaataggccagccaccatcagtgcaactattaataatgtatttacagaaattaatatataattatactaatgggatacactataaatgaaaagaatggtatgctatgagagatcattacagaaagaattaatttagattgggatattgttcaaggaatagattacctggcaaaaaatgaggataaggtacattccaaaaaaaaaaaaaaagaaacaatgtttattcactcaaccagtgttttttcaagacaacagagatgagatagcactccttattgcaacagtagcttgaagttagcaataaattaaattttattaggctatgggtttttttttgtttgtttgtttgttttgttttgttttgttttgttttgtttttgacacagattctcgctctgtcgccaggctggactgcagtggcgcaatctcaggtcactgcaaccttcaattccctggttgaagagattctactgcctcagcctcctgagtagctgggattacaggcacacaccacgcccagctaatttttgtaatttttagtagagaccgggtatcaccatgttggccaggatggtctcgaactcctgacctcatgatctgcccgccttggcctcccaaagtgctgggattacaggcgtggactatgggtattttattatcattttataaaactttgacagcacagatttctagttattattaggtggtaaaaagattcagccatcaaaaacatttataaattaatataacttttccattgtcagtgcaataataattgttattataacacaaagacatggtggttagtatggccagtgcaaatttttatatagatgctggggtagagaattttcatatccttcctttctctcaagtaaactcaagtagggactactgatacaaccttttatactatgtttttaaaaaatttctcagcaggaagacatggatgattcagagagtagaatgtacagtaagcagagctaacagatgtcagcaggaaataggagggacataatcaatctgattcagctgatgctaatttatatgtttttcattcagaaggacatcttttcttcagaattctccccttaacacggagggttcagtttcttggaaaaggcaatttagtcatgttacataaaactgagtcagaaaacaatgtaagttttaacttcctttcaaacagctatggcttaatatcaaagtggcatatggtagaatcattcctaggattttgttcttgctctttaactaatagcattgctctggagcacctgactttgtatccgattagagaaagtcagggtagttttctcccagggggtgtaagaatgttcaagagttaataaggcaaaggatatagtggtggagctttccaagcagacaagcagaggaagcaaaatgtgtgaagccctaaggtgatgagaagaagcttccctgtgaacaaaaaaacctaaaagggccaatgtgacttgagggtacagaataggaaagttgagcctcagaaacttgcaagatcattggactttggaaagcaaaactcaccaaaaccatttaatcagagaaatgatttggtttgaatttttgtctatagccttaacatttcatgctttccactgttgtgatcatctccttaaaaaacatacattacattacatttgaatgtccctgtaccaggactaaagcatggccagtttgcctatttctactctcttcgtaattgatacagatcattcaaaagtcaaattgatcaataatgtccaaaaccgttgtcagcattacaacgatgaccacttgtttcatgctgtgtttatcttgacattcattttagatttgggtttgtggagaaaaattagcttctctgatactttgctctctagagctggcaataatgtccctttggactaaattataaacatttcacggtccttaggataggaatgttattttacatatccatgtaagaattcttttatatgcttttaaatattcttttgaaatgtatgtagtactataaactctaggtgtatttatttgaatatagacatatgaatataaaatctcagatgttaaacagtttgagatgtttaatgttttattaaaaagacaaaaacatagcctttgtaggaatagaattctgacttgtcatggactaaagatactttggtttcatgcttcttaacattctgtggttttattttttactattgacaaaaatgaggtaataatttttgtttagtgacttcctgaaagagaatcatttattaagcgttaatatgtattattactttttatgagagaaatattatctaattttgataattatattttatcaaaaatgacttattttggcacatcaacaaacctagcagataaaattccacgtttttccctgaatcagatcataataccattaattttacacttgcattatttgtattaattaaataattacttatttgtgcttattaggttattaccattggaaaacatgttaaagggtaccactacatcattgcaaatctggtaggtgaattaattggtatatattattttactagatatgcttatttattaaaaatttaattttgaatggccagcatttatcagtggtgttttaaaaaatacagtttgattgtaattagccaggtgtagtggtgggcacctgtaatcccagctacttgggaggctgaggcaggaaaattgcttgaatccagaaggcggaggttgcagtgagctgagatcccaccattgtactccagcctagtgacaagagacaaaccctgtctcagaaaataataataataaatatagcttgattatatttgatatattagatatattgctgcaattatgttttagaattgcttcccactttgcatcttctaatcaatttcttattattataaatgatataagaatttatagaacaatatttgacaagcttcataaattgtcttagatgctgtattttaagaaaagggaaaattctcaaaaatatttaaagtttaattgtccacatattcccttgtctctgtttttcactgtctctattttttataaactctgccctctgcatattcctttaatttttagcatatataatatctgaaataaatgtaaatttgtgagaatatgtcttagtatgaaattaaacctgaaaaaatctagaatattgagatattatgcattatttatgacttcctacttactatgtaagcaaccaaatgaaaattaaatttctgtagccaatcatctttttattatgattcctgtcaaaataaggaccacttaatcacggcttcttgggtttgtgttttctctgggccgtggtcactcatattggctcagaataaaccttttacaattaaaaaagaaggtagtatactgaagcaacagagtagttaattctatttccctcttttaagcatcatcagagtcaatttagaattatcactagaaatttcttttttcaaaataatttaagcctttactgctacagagtttaatgttatttaaataattaagatgctatgtgattcaggatcactatacctctacacccctgtctcacccaagaacaagaaaaaaaggtgagagaaagagggagagaggcagagagcttattttaaatagcataataggactttgaaaagcttttgacatatacaaatttaatgattcctagtgtatcacattgttacatcagaagacattagttctagtggtgacagaaagagataaaacaaaacaatacaacatttacagccttccaactgataaatgttgttttcactagaagttgaaggaatttagaatatgaaatctcaaaactgcatgctattgggttgctcaagacaaaatttctgtttggcaatgaaatgggtaactactataaaaattctctaggactttcctttagagtgtattaagatgctaaggactccctgaagagaaacaagagttaaactagatgaagctctgtattcagtctctccagaaccacattatgtgcaggaaacagcctggacagtcagtcccctgtgtgaatcgtgccatttgatgaacaacacagagccacattgaaagctgtgatctttaaaaatgtacagatggagaagattatatttgaacattgagaaataatgacagaaggtggctcctcaatttgagagctgatatctgatgctattaaaatgaaaataagtgtttgaatgaccaaattaaaaagaaaaagaaaaagcaagttcatgctgctgtcatgcttcttgagagaaaatctacctaatattttatctgaattcaagtcttgtttttctttttctcaatacttggtttctttgccatatggaacttctagtgaatcaataagttcgaaaggctgtatagtgttgcaatttctgagaatttggaggacacttggaaattttactgacattcaaaattaaacaatgccacccgaagttgaagggctttcatcttccaaactcttgagactttccttttcttccccctgtcaggttgtaatgagttctataataggtgtttatagaagattttttaaaaatctgcagataatattattgattaatttccttaggaattgctgaatgcttgattgggctcctaaaacacagtgtataattaagtcccttacaacagcactgaaaagggtaacttgtaaataaggtgatgaagaagtggtcataaggaaatccagttctcatttctccaaccttactacccttatagatttaattctttaaaaagccatggttccataatgaattccagcattaagaaaggggtctcctagaaattaaaaattcaagaaaaagttgaaacaaattacctgatatgtttgaatattttattttctaaaaagctttattcataggcatgaaatgttttcatggaagcactggaaaaaatggggataagcatatagaaatctctagcattgaaaaaatgggacatgattataaacatgggctgagatcatgttcgagaaagaaaatgcaattctagtacactatttggctttgctctgaataacatttagagttataagtactgattaaaatgggtgagaagataaatggttttgtcatgtaagcaaattacatactcatgtgggatacacaaaaactcaataaaatttcaaaaattgataaattaagaaagagcagtaaaagtgtcatgcagaagtaagaggtaaatatgtgaaaagcaaatatattaaaattgaatgttttgaagcaacttaactggaacatacctacggtaaaacagaatatatgatttttgttatatacctttttgcactatttgcattatcttgataaacagaaacaaaattgtgagccaataaaaagtaattaccttctccttcagctaaataatataataatatgcatgttttaatatcaataacaaagaaaagattctcctaagttttggggtgtggtaattcaaaattaatttaggatacttttaacttttgtgtacaataagataaatatttgtgaaatgtgaaaacatttataattgtgatatatggaaattaatttcatctttgagagagatatactatcaagttgataaaattcatgtcagcacaatatttgaaatcaatgtaaatatcacataatagttttagtaatgactgaattcattgcaataacacaagagaaatttttttttaagatttaatatattctataaaattagcttctggctgaatgtgaaattgtttaattgttctcaaataatgactggacatttagtacctcattttgaagatgttcctatcacctgagtgaagaagtaattcaaacaggagtaacttgctcacaaggttgtagttcttcgagaactactttaatgttattaagtgtctgtaaccacatggtggttctccgctgtagaccaagtaagtaaaacctagtccttatcaatggaagatttctcaatagagtggagaacatttatgtaggtacaaccatgagtgtttcatgagatgatccatcagtaaacgtgtattgattagggaaccactatgatgctaatgtggggttaggtgctgatgaagaacactggctgataaatacatgggacattttctgcaggcttattatatctcatatgttctttgaaatatctaaaaccacaatgtatagagttatttggtaaatgttaagtagcattttgttctcaaacaaaaagcgtgatatcaatgtgttctatgtttagggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaaggtttgctttggtttctgtcttttctttttctttcatatgtgaggagagagaagagtcttggcaaataaggaggaaggagaaaataataaagggagtagagagcacgtttcaaaatatggcaaacatattgactgctaaatatatttttcacatttttatggtttaagtaaagctattagagctttactgtattactcttgtgttttctacttccgtacacctatgataatttataataaataaattcattcatttattaatccatttggcatttttattgagtggattctgagccagacacttttttggcaaataagacagggataatgtccctgctcacagttgaatggaataaagacaaaagcattgacagaagaatgccacgagggaagagaacagaaaactcttagcgacatggagggggtagggaatttttaagctgagacctgaagaataagggacaattttaccctgactgctgtttagaatattatgtttgcaaataaattaaagaacaataggtgtcagtttgttcctaatcttcaaaaagccaacttgcagacagttcttagttcagtcaataaacgtatggccacaaagagagagagagagaaagagagagagtgagaaagagagagagagagtgtgtgtgtgtgtgtgtgtgtgtgtgtgtgtgtgtataaaataacagttgatgagtagcctggtctcttgaacactttaaaaagaagataaaaatctcaatttgccttaataattaaaacataactgtaatgctttatgcaatcaaacaaaaaattcttgaacgctaaatattatttgttcctcaggtataagagctacacagactgatctttgttctccatgggtttggacacaatgagatcttcacttgtttatttgatgcattttattgggtatacacatgcgtgcatgaatttacttccaagtagtcaatatttctgctgttgacaggaaggtatttttccttcagttggtaaccttattgagagcagagttaaaatgaaaaactggctaagggtagtttaaagagtgagtgggttgaaagttaagatgatgttcacattctttatgaaaattaagagcaaaagttgaaaaattgtatagtaattttgtttgtgaattataaagcaattgtatatgaaccaggcaggacagtgttatttcagttgctctcacagttgtacctgagtatgcatcatagagatgttgtttgatgctaggtgcatgactgtctatgagattggtcctagaaaaggattagaaattttgaagttctttacttttggatttataaatggatcttttaatttttaagtcaattttgtaaaagcattccataggattttaaagaagaacaccaagtaactttttttcaaaaacgaggtgacttcctatttggtgactttagttgagattcagtatttgtggccgggcgcagtggctcacgcctgtaatccctgcactttgggaggccgaggtgggcggatcacgtggtcaggagatcgagaccatcctggataacacggtgaaaccccgtctctaccaaaaatacaaaaaattagccgggcgtggtggcaggctcctgtaatcccagctactccggaggctgaggcaggagaatggcgtgaacccgggaggtagagcttgcagtgggccgagatcgcgccactgcacactccagcctgagagacagagcgagactctgtctcaaaaaaaaaaaaaaaaaaaaaaaaaaaaagacatactgtttatatcggggaggtacttttcatgtaacgaggcttctgagcaggtagatggatacccagagccttagttggtgtcagcgtatgtatccatctgtgcctagaaggggtctaactgccgatcccattctgtggaattgcaggcttccgtccattcagagatggtgccatgtaagttctctgatggagtggatgttatcctcaaatggaaccagcatgctcctttcgaatattctgttagtcattgtgttgcccccaactgctgcctgctaggagaagcatgaaagcaaaatgaaattatgtttttctcctagaagtcgtatcatgattcaagttaatgtgtcttgcattaaaatgcaagaggtatttgcagtgtgagagatgtttggcaatgcattctgttaaaaattttgccaaaactagtgccagatttcactgagttgagaacctgcattgtgacctttcttgctcccttcctgctgtagcatttcccctccataatgcctcccttttggtggcttctgcccattttcagagagatcattatgcttcttcacggtgaggtgtttcagagaacctagactaatgtgttttaaaacttaggctgtgaatcactgtttgaccctgggtccaggattctcatctgtacaatgcagtaatgaccattaattcccaggttgctgtgaggattaaataacacttgcaaagggttagcacagctttggaaacataggtgcctataagggctaatttgttttcccagccatttcctaaaatgagagaatttcagccaatttccaaggtgtattccaactttaacattttataatccctctaactccacccagaggcatattttatgaggtccctgaagctcaataaaaattactgaaaatctgtgaggagaatgtgtttggggaggaagtttatcctaacaaagaaatgcattgcttatgtactagaaggccagaaactaaatataaataaatgaaaaatgtatgaatcctgtctttgagaatccagcctaaagaaggagacaatcatatcaatcagcaaatataatagactgataaaatatgccagtttcttggccatgattttgacaatgtttggagggaaggtcaaggaaggctttcatgggagggatgcctgtgcaaggctttgcacatggttgagaaggaagaaaagtgtgagaagttgcttggggaagtgcaaaatgtacagagactcgaagtaaggcaacagcatgacagatccagggaactgcacatttgttgctactgcaaaaatgtaaatatttgggaccagtgaggagggaggtcatgttatggaagttgcaagaggtaaggtccttaaattgtcaacagatgtggaaggtagtaacaagagcatgctttcataattatttttgcttccagacagaagagaggaagaaaaactaggagattatatagcaccctctaaatataaacaaagaatatagtctcaatatattatttgcttacagaaagggagtgaaatatttctaatgagattattaacaatgaggttatgtcctttgatgttgtcttttgggtgatcgactgaattggatacattgcctgataaattcatatcacattttactactcaactactcaacaataaaaactagtgctattggcataaaaatctataaaaatacagttcaatacaccaaattctttccatagttagggtttaggaattatagaaattatatcaaatcgtgggagtaataaataaatgattgttcaacgttttcatcttcccctaaagttaaatcagcttccaaagttttcaaattaaaataaattttattcagtaaataaaaataaaatgtaaataaggtttaatatttaacatattttaataaccaccaaatataaattacaatgtttaaatttcttcattcttacaaactatacaaaaaataactaaagtcatggcactgagattttaggtctgattcccttttactaatttgctatttggggcaacattcattcattcatttatgaattcatttatttactcaacacatatttattgtctactccacagcaggcactgttctaggtgtcagagaaaagacaaagttctggcccttaaggagattacagtcttcagactagaaaccaacaattaaattgtagcattgatggaggttgtcttattgccatcttaaacttatatattcaaaactaaacttatgattttcctcactacttcctcctcagcctctggaaactattccttcagcggtctttcttatcccagttgatggcaactacgtctttcagttgttgcttagaccaaaaacttggtcctttacttttctctttctcttgtaatctacatcctatgaatcagaaaaccccattagcactgcctcacttcctaccaccttctcttcagccaacctaaatccctaggtagctaccaccataggattattacaacagtttctaaaattgatttccctccgttcacccctgcccctgttatcttccatccttgtggtccttttagagtataaatagattattttgtggttctgttccaaatgctccaatgtctctccatttcacttggagtaaaagagccaaagtcatcctgttgtcttatgaggccctgtcacccagtcccatggagccacatctctgtacactggctcactctgtttcagccacattggcctccttgctgttcctcaaccaacctaagcaacttcctactttagggcctttgaactggctgtttctttttcttgactgttgtccccttaaatatttgcatggctaagtctcctgcactccttagatctctttcaaatcctgtcttctcatggaaggcaatagtaggctatgtatttaaaactgcaatcttgccaccatcagggtttgtgcatcacccttccctgatccagctttcccaattcttaccttttagtttactgttcttatcatttatgtattcatttcactgttaattatctcctcctacttgaaagtaagtgccatttaaaaaaaattcattgatataactcaggctcctagaataaatcctcatacatagtaaccatctaatagatacttcctgaatcaacaaataaagaaaagcaaaggtactgtggtatcacctatgagaagctcctaatcctaattctagaggtaagaaaaggcttctcaatgggagcaatatggaattggagacctgaagaagtaggagttaggagaaagcataaggaacaatgattccagataaaggaactaggatatgtaatgtctccagtgcaaggaaaatataaatatttccataaggctttaggttgaacagaaatgatttgaagaaatgctgagaaatcatactttagaactgtgtatgatccagaagttttatgccttgttgacatattaaggatttcttgtctaatttgaagagcaacagggaactacaagaggagagtgctgatcatggctttgatacaggaagattactatggctgccctgatgacaagagattgcagggagcgctggtggaggcagggaagcttttggaagatatcacagtcagacaagagacaatggttgtcttaattgtggttgtggcatggggatggagggaaatagatggatttgttacatctgccttttctcttaatttcttcataaatgaaataataattgtaaaatcgtaatcattcataggtaatatactgatataaattcagtcaagagatatttgtgggttagaaataagcctttcaaaggaaatctggctcatttgtatcttattagccttaaatctcacacagtggtttgcaaagagtaagcacactatagatatttgtagggatgaagagtaattatttggaaaatattgaataagtaaaggaaaaaatataacattattattgtgatgaaatatgatttagatttctgccatagatttctgcatgtgtcctcttattgagccctgacagaaaagcaatgagttactttagttgataaaatgtaaagttaatgtagttatctgacctgacccatcatagcaccaggatttacatgggaatattaaaacagtcattttatcttccttaaaagtaatttttttaaagagaaagagtataaagatatttcccactatctcaaaaataatttatgaatatttctatttttagactgatttttagtatttttaatgtctccaacatcgtgtaaggtatgactagccattctaccttatcacatagtaacctttgttcaacttttgtgtcttcagtctcctactggtgttaaggaattcaacaataatctgtggctgacatttgtgtggcactttaaataatggctttcccacaagaatctcattttattcaggaaacaacttcacacgcagactcaaactttcttaattgctgtcctaagagagttattagatctgcctgaaaatagtataatctttttcagttcagtaattagtgtcgtgcattaaattgtaccctagtggcctaatagaattaattctgcttcttgagtgttttaactgtccaaaccacagctggcagactggcgttcactcttcctaatattacagcattttgcccaacacaacctggaagtttgaaatttgacatattaattccttgtattttatagtttaaaaagtgtgtaaatgactgaaataaacttataaattttatattgataagattgtttattttgtaaacatgaattttaaaaatatgtatatcacaccattaaaaataaaaatgtgttattaatatttataatttaattcagggcatctcacatcttattttcatatttctttatctgtaaagggaacaagtgtaggtaaactcttaggtttcctgcaaatctctaataccatgattatgtgaagtgctaacttaagccctcaataaaacattgttaacatttcaaatttttgccaaatctctgacatctcaagtggtgcctctgtctcttagagattgtagtgacttgcaggtaggcagacaactctgatctccaggtgccgaaactgaatcctaaattactctggacaatgtatattttgtttttcatagatcataaaaaataaagaactttcaccttgttataagatttctaggaagtggagagtcagggagagggatgtgttcaaccaacaaaataaaagatctgcttctaaggaagtctttacctatggctgaatcaaaccagacaatgccttgatttcagcatcttttttctgtcttggtgaatctgattagctttatctgaaaatttgaattcttaagtaatctaaagttcctgaatataaaattcttaatctgtaagattttcagtaaagattaatagccaatttgggtaatttaggcaaaaatatgttgttttacatttattccttttacctgaagactctttcttcacagaaaattaaaattattttattatttatggagaataataaaagatgttaatttaggtttcttgccaatgcagctcccttttcacccttggaaaatgtgatagagcttgtgtgcttactaaggtttttatgaagatttttatgcctttatgcagtgaagtttcaaagggcacatattcaatatgctttacagtaaattaaagacgaccttatcacagacagctcttttccatagggtaaactgtagttgaatttgaaattaagacaagtgaataattttaagtttataatacatttcctcatactgttcatttgtcttatggccctatttgatttggtcactgttggttatcttaaaaaaaactttcttaaaatttttcttatagatttacttatctttcctagaaatcataatttttgaccctgttttaaattattttgtaaaaggatgaaactgagaattaatattgcataagattctccagaggaatatcaatcaatgtataaaaattttttaactaaataattgaggctattttagaaatgagtacgtaaaatgtaccaggccataaaactttttaacattccgaagtatgttacataaaacactattcttatggaaaataattgatgttaaagaaatttcaaaattggtcattagtttgggaaatactaattaaacagttaaactgttattgcgggatttctgagggtctataatatgtcaatgtgaaaatcattttctgtacttattagatcacagaacccttttgtgtggagtgagatggtggttttcaaaacatggtaaaaacaaactagttttgcatcaagatagatagtaacaaaagaagaaaataatgcaaacctactggtcaataacttacatatataacatattttacaactcatcaagcttctcacctactatacatttatttgatacagtatttgccaaataaagtaactaaccatcccagtgtacctgggattgaaaaggttcctgggactcaagacttttccttgcaaaattgtgacaatcgaggaaaaccaggaccattggtcatcataattacctcggaatcacagagatctggattcaaatccacttttgccacacattttttgtgaagctgggtaaaatgaaagtttataacctggaatcttcacctatagaattggaataaaaacagtggtggcatagggttttttagacttactgggaaactgtctacctcaggcttgtcacaaagagaacaaggtaaacatgaatatttttccctaccttccttttcaacgctcttgtaacatagacagaagaagcattgctctccttattttactaaacaaccttagacaataatactttagttcacttgcccaaggcaacagaacagtaaataataaaatctggacttgagccttgtcttctgatgctaaatgcaatgctttctaaactatagtcaactaaattcaagtgttaaagaaaatttctgaaagtcgccattcatgggaaatatcgtcacactttaatagtacttaaattttagtactttttctttgaatatattttttcaaaattttattatgatgtagatactatgtttagaaaaaggtgcccgtcattgtgataacccatgaaaatttatactgtagcctatttatcctcttttatgttcattaaatttgagctatacacagaactttttttcattctccccttttttggtgttagaatactgttttctggtatcagagatcacagtaatgtattattgattggtttggctgatgactattggacataacaaacatgtctaaaatgcatatttcattttatttttgacaaataagtctcaataaatatacatttaaagcaaagtaaaaagcacatttggaaaatggactgtaaaaacgatttccctgattttttcttaatgtgtggctatgacgtgattgtgatatagcactgcaaagcaaaatggtcctccactgaaatataaatttccaactcagctgagggatttcacagaacataaacacaggggcagagatgaagcatttgttttcaaaggagatagttacattgccatcatgctcctttcaaattaatttacatctagtttaatgaatggtagaataaaactgaaatatttaactatccaatcaaaaaatgtgaacatatttgtttagaaaaataaatgagccatacatgcagaacataagcaaaaaggaactctggaaacagaagctgttgatattctctcaacccagaattgtgtttctatgattgtgacttttaatttaaaatggtaataggcttaagacttgattagttttgagcatttgaaaaaggttgaaaggatttttactcttaatgtgtgcatgctctgaatcatattcataatatgctacgtggatctgaatgctttcaattctttcaagctaatcatattttttttaatgtagttaaccaacatttgtagacctcaaacacatttggtagacggctttatagctttcccttagtaatgtgagcaagctaagtcaaaaatgttggctttttgctatgatcataatttccatacaaactgcaatattttaaaatatttgacttattcaatttagcttacatttctttttcagagacctagacattattgtaagaattatcttggcaataaacttatcactgtataaaaacaaattaatcaatttttttcctttagagtagaaacaaacatacaagtgaagcagatatatcttgatgtgatatttcttatttggttcaagaagtcttttattaagtagatgtcctgtattgtcatctcaggtgaacaacagagtatggggagcttagtggttttactgttagatggcttatcttttttccatgacaaggaaggcaaggttttcagtggaatttagagaaagagaaatgtgtggaggtctcagtatttggagaagacaaagatgaaattatcatttttgagagtgaaagacctgaaatactaaggaactgagtagaattatttgggaatgctgagtacctgttttggattggtgatcaagaatttagcatgtcacaaagtcagtatggtacagtactgcatttttttctcccaagcttcgccgtactcttagtacctacagattgaaaaacaatgacagaaattttctcaacgttcagtaaaactttaatgtcaaaatgtagttaatcattaactgacagcatcatccatttggcaaatggtagtatagatacatgcacatactactacttatctagacactgacaatgccttgtacacatgtacctagggcttggccctagaacctgtaataattctgctgtcccactgggatctgaataccataagtttggaaccaatgttatcatatactattgaagcatggaggcatgggggcatagaaattatgaagttttgtggttcttctacttgattaccagaatcgcctaggggagcctaagtagacacccctaaaaccactgcagatcagtgtgaacatgaccagggttgaattagagactaagaatcctgaaagtaatccatattccttctgcattgacaaatgaatttctcattggactgtaaagaaatattaattgttagtcttatagttttgtatatcaccatagcaggctataaagtgaggctgtaacaagaagcaggttagaaaaaaaaaaaagaaaaataaacactgacacaattattatgaaaaggtctaacctgaaacagctgagatattaacataatagaaaatgtttagagtcaggagcacatttcatagtccccatgttttgtaatgcttctcttcgattcttaggtttctagatgcagaaattgtgtttaaattcttggacttttaaatggtattgtgtgctgagcaactgcagtcttgattgctggggtgcagtgagtttctgaattttctcccgttcttatgaaatgtgtgtgatcctttgcagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggtcagttactcaaaataatcgttaacgtgacttaatatggccattaatgttttcttcctgctaaattagtcatccttgtcttattccttgtgtctaatatacaggcaatgttcttttctaacaacacaaaggtaggttgaagagagaaacaaatattattgatgtagttttcttgacttcatctggttaaagtaatctgtacagtgtatatgtttggttgaagtaaatatataactctgctgctttcccatttcttcattaggttcaggttgaaggtctctcaggaaatataaagtttgaccagaatggaaaaagaataaactatacaattaacatcatggagctcaaaactaatgggccccggaaggtaaatccttagtgatttaaaggcagttctatgtgaggaggtgagttagctagcctatgagttcacccttccagagaattctggagatgtgtattcacatagagtttaacgacttccagaaacagatatattttgaagtttttttttcctaaagtctgtttatttctggtaagtaacattgaattgtaattttaaaaataattataggtagagctgttgaactttaattttttagactgaaggggaagtctttaatgaaaagagaaagaattattgttgaaggtttacagttcagaagacaaaaagtagctggtgcaaatacacatgtaactgttcaattcaacatcaaccttttagctgtttaggctaaaatgtcattatttggattttaattacatttctatatgaccactcccaaacaattactcttagaaaatacaaaaagtgaatatgaagagacaagtcatttttaggaatttttttatacttccttttattcctgttagattcacatatataaaagacatttctatttagaacaagtccagtaaatgtggttctaatttcagattcagacatggctttgaaaataattaaatgctttgctaatagacaagtcatttatccatacacctgtctgctgtaaccttttccagattggctactggagtgaagtggacaaaatggttgttacccttactgagctcccttctggaaatgacacctctgggcttgagaataagactgttgttgtcaccacaattttggtaatttgctacatatgccatgttttactttgtattttcttatggctaatatctgcaggagtagctatttatattttaggagaataatatctgttttgcttcttttgcaatgttttaatcatttatttcatatttactctgttaaaaggaatacacaagatctagctaaagcattgaaaatgttccccattttctttaaggaacgctacagtttacacagataattcctaccctggtgcttacatcggtgaacaattggggaatgtcttgaagagtgttcctcatgtttctgcgagttattcacctttccattcccacccgatactgtgtaaattctttctttccctttgttacatgatttcatgatgatgtcaagttgtctttattctatctaatgaaagatgatctccttaaaaataaggattatttcccttgtttttactccaaatttcagcactggttggcacatagctagtacacaaaaaatgcatattgaatgaataaggaaaaattgaactggatcttcaacacccaggctttggatagatggaagagagatgtggatcagcatgacaagctgttggtgaaatgaaatggagaaaatggtgttcgttataggacagaattttgtgacaaactattttgttgtattttcttttacaaaaaaaaatgggcttagcagtgaagttgtaaattggtgtgatttattctcctaacaatattgagagcagatatagatagattggtaagggatttgaattaaaacattagtaggcaattgaaaatctcttgataagtgcaaattagacatttgaggatttttgcctttatcatgccattgagaggaactatctcactgagaccccaaatatcctcagtgccactttccaatggagaatattggactgtgttgattcattttttcttgcttcctttttcttatgtttacagggggaagctactctctagctatccttgtagcatcattctaggatattgtatctcacagatgaagtgagacctgaagcctgcgggggtagaatcagtacatcatcatgacaatgatcctgtcagtttgtgtatcactgaccatgaacctgatttccacatgaaccttatctttgggacagcagtgacacagggttttgggtgaatgctggttttgggattggcctaaccttaatcaaggataagggtgtggtgaatccaaacttgaataaaataggttttgagcagtaatattttgctctaagtcctagcagtgacaaacatggctagagaacatacaaagagtttgtggttttgagtatcttgttaactcagtatgcttgcatacaagccgtcttaatgaattatagtgatagacattccgaggctttctggggggaagcattatgcttaaattattcctctactgttgtgtgttcaccatctatattcttcattcactctggctaatgggtaataattaaaccagaagatttgattcaatgagagtacataattaacacagatattttaatcagctaaagcaaagtcttttcatataggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatggggtaagtatagctcttctcatagataaagtcattcaatttgaattgttgttgacagactgcttcctctccctgtgaagtatctatatctgaggttgttgatttcccacattactctagaaacattatcttgttgatttgtgaacatctgaaagattaagattgaagccagaagtagacatgtagattaactgagacaagcatttcatctctcttgaagcatatgggccatatgtattgtcaaaaggctgcaaatgcatggatgcagtgcagatgtgtaatgatcatagtcaagccagctgggtatactgtgtattcataaagaggaggggcattcggggaataattcctttttgtttatcctttactgggactataccaaggaaaaaattattgtcatttttctgatttcctctcctttttctttgatccagtgacataaccacgattcctttttcaccatgactccaggtactattactttcctttttttcccttacagaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcagcaaggatgcgatatttcgccaaggttggttactcacctgcttcaactttgtgcatttcaggtctcaagtggacattcatggtgtttatggattcaccctaaagaagttaccagctgccgacttcctgtccaagcagtttaagactcttgaaggacatcctcttagcttcggcataagtctgtgaaatatttgaacaatgttctttgaatgttgctcatctatttctctggtgaaattatacacaccatgaagaggctataaaatgcataaggttcctatcattccatgccttcttggaggggtaccgtgtttttgctgcatattctcattttacagtcatctgtgtgttgatccacagacctgtatatgggaaaatgggcaacattatttattaactgcaaagtaacaccttgttagataaaacttcgttggcacacatctcatctcttttattttcccatcattagttcatggaaatggtatgggagagatattataaaatttattttttttctaggtgaggttgctggattaatataatagcatattttcaactacccacaaatgcctggaagggactaatcattcattaaaaaacctgtccatatcgaatggtaatacacacacacatggaataaactcacctacctttaatctcattatgatatgttaaatccctgcactagaatacctaattataatgaatctaccacaaagtacccattgattttattcatgttgcacgtatgaataagaatgatagccatgtttggctcttcagaggaataaatcatgatttttctagtgtgattaacattttaagtcaaaatgattatcactctactggcacattttaatttgggctctattacccttcttcgattttacaggatatcttaataactagtggagcgggtgcctttcatgatacaattttattatattgtaaatttttaaaatcacttttgagaataacaagtgattaatttaagaaaactgtatgagaagctcaaagatttgcatcttttgcaatctttttagtatatttcactgagtaagataaaggaaatacatcatgtagccagaaattatcagtagcttacttctctgatagtaggtaattatagtgggaatgataaaaaaaaattacatttttatgaattatacagattttaaaaatttcagttccaccagattccctgtgacttccctgtgggacttcagtgaattagaaatatgccaatggaatttgcacagcatgacatatgtgtgtatatatatgtgtatatatatatatatatatacatatatatatataccatatatctcaccgtactatcgttcatctcccacaacatatataagattcatagatatctcatctctgtatacagtatatttgatctcagtcagagatacacagagacatctccaactaatcggaggcaacactccccaaattggggactcggccaacacactgacccatcacatgatcaagatgtggttctccccatgctcagacgcaccatgagagtcgcaaccctcgctctgaccgtcacccaccaacctcctgcgccatgtcccgcaagcactcccgagacgtctccgcggccacctacgccgccggctgacccaccccccacagacctcggctccagtacacgaccgcagcacacacgatcccaccgctcgtactcccccacggcccacctcagtcccccggcaaccgannnnnnnnnnnnnnnnnnnnatctttcacttatgctatatatgaattttaaaattcaacataatacattggaaaagttaatgatttttaatgaacaaaactatcattttttaagaatgcaatgatggttaccctagttgagaagaatacagtagcttattatcatttttaaaaagcatgacatccacagatcactttagaaatgtctttaaatattaaaaaaattatgattcttttccaagtaaaatatgatatgaaactatattattaatgttaataggacacatttaagttgtaatctagagttatttattaaattaagtgatttctcatttttctgaaattaagtttagaatatcttatctataagacatggtctcatgaagaatagaatcacagaaattatgagagcaatatgctgtaaaggttatttttattgtcctgtttgcttctggattgtccccaatgaccctaaaggaatcaaatgaatataaaaacatatatcatttaaaaaatgatttagtagggattaaaaagaaataagagcatatgcacatttctttattcctttagtgctgatgctgatgggcgaaagttttacttttaattgtagaagtaatttttgtctgtcaccataaaataatattgaatttccttctctgcataatttctcaggaactctttgagaaacatgaattgatactttaaaaatacttaaaagtaaataataaatagttgaagtacttttcacctttgaattatttataagtccaataaaaatttttagatatcatgtacattttaaatcagttgacatattaaatctgatataaggactggaatagaggacaacttacatctaactttccttaatttttacaactggaatagaatgacacaaaaatgattcttaaacgtgtcataaattaatacgcaatatgtagagtcaaaagcaattaccatgtaatcagcttttgttttaagggatttgagcaggcaggtactgaatctgcgctcttaaatatatgatatgtgtcatataactatacttcccattgatattggataaatagtgaacattttgagagtgattttgtctacataaggcatttttcaaatgtaaaatatatttaatatccttttcagaatatatgtgagaagtgtttaactttttccatcctttcatatttatttttttgtatttcatacagactttgtgataaagtcccttaattatattctttttgttatttcttgctatttttctctctctatctcctttattttagcaactgatgtttttatatcaaaaaacttttcatttaagttagcttctctcctttcttaactgcttgagtggtttattctacaaatatttcccaagtgtttgatctagaatatgtttcatcaaaagatttatttcttactgttaattgtcagaaactttagatcacaaattgccaatcatgatctaaatttttagaactatcacttgttcacactagcaagtctaattgttagacatagtagagttattgacaacagagaaacggttagttttattggtttgtcaatatcacttaaatacttagttacgtgcagaatcccatcaaatctttcaaaataatacagtatatatctttttctatatctctatacctgtattcctctacttcaggttttaaagtaaattattgggtatctattaagcttttaaaaactattttatgtaagaatttgtagtcagaaaaatattgttattttattatacatcaaactagaaatttatgtcttcacaaacttttaaatgtctaatttgttttctttgagttttatttttttttgagcaggacacataaaggaacagggtcatagccatccatactctgaagccatctgatttttattcattaatagttatattttgtgcggtatctttgcttgtagcattattttttcctcatttttctctcctgtactgtatctaatacctatgttttacatacacaaaattaacaaaatttgaggccttttttgttttggaaattcactgattgaattaaagggaggatttctttggtgtttaaagttacatctgtggagtatgctttttttaatttttgattttgttcataaatgttgttatgaggtttgctggtgatattacattctcttgtttatgtttacttacatcatgagtggataaacttttatgagtatttgtaaatttcttgaaattgctttcttatgggattcatgtcataaactatttgggcattacaattatgaaagtattccagaaatcagaagttttgacctgtgtgtatgttattaaatttagctactctgtactccttgcccaaaatgtttaatgatttccagtttcattaactagtagatacattgaaaaatataaaattaaatattcccctataagtcaatatttgcataatactgctaacttgtttttttattaggtcattcatttcactttacaaatccatttcatacttgttattagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcagggtaagagattctgctttgtagtttctgattttgttcctgaaatttaacctatttaaactttgtttccctcccatagtcaattccaaggtactatgtgaaagcacccctaattctatttcttttcttgactttgtctctgtttctgacccttccctatcctgatacttcggtccagctctagtttctgattcctgactccttaggagaaaaatcacaatgttgcaatgaaatctgttttacaaaaattgattgtccttttggaacaaaattgaagcaaagtatagtagttaagtttagattattatgctttcagcaaaacatcttatttttatttgattttaaataaatatgactgcatgtatcttacctagtttataattgaaaaactcacattcaaaccaattatgttaattatgtgtgaggaaacagactatgttcatatgtgtcgattctgaattttctgtgcaaagcttccaaggaaaagccaacaaaggctctccacttcctaacttttaaaatatgtagtatatttatactgtgtctattagatgtaggttacttttttcttttaacttttgttcttatgctctgtttataggataagcccaaggacctgatgttggcataattttctttctttctactattgtgtgtataaaacaactctttctatgaaaatgtttaaatacagctgattaacttaggtctgaagccaatatatgtgacatataatggtctctgataatctacaaatatattcgaatatatctgagtttcagtgaaatctagtccagcttattccggaattaggattaggaccttcaaatggccatcaaaatttgaagactatctcatgctacattacctctgatctcttttctgaataacttcacttcagctgaagatactatgggagaaagggttctgggagtgggggtggtagaaccatggctaataacagatagtaacttgggtgtatgtgaagagtccaggaccttgatgaattaattaggtacctcaatataagtgcaaaaatgtggaccatcagcagctttttttactttaatgcagattttagaatgaatcttgtaatgtagatttcttactaatgaaaatgtattatcatttctaaacatatatgcaatatgtgtatgaatactcggtttaaaaatgtatgttcctcaattagaagtgcatttgaaagcatttttaatatttgtatgcagtgtagcttgcttttatcttatttggaaaaatgaggtgctccctcttgaagtaaatgagatctatgagaatgatgcagatgcctgttataacaggatttacttggtgctacttatgttgattaaaataatcttaattattttcagactctctcttccagttgagcatgcatctatggagagtttcagttattaccttgtttggacagtagtagtgtcagctacttttcactactacacattcacattcacaaagcttttcagtatatcttcactgagtcaatcatagaaacacgtgtcttaatcaccaaggtgccagaattgtatggccagtgtattcacattccctagtagacaagacaagaaagctagttgagtttgggaaaagaatgttgctactcttttgtttcagtgcactaacttcatggagcccatttgttccaatatgcaatcgtggaggttgtataaggttgtggagcttttcttccctagagtaatagagaagtgatgttggatagttaggcaaattgatgacttctatctatcagtatagctccccaaagaagtttcttatccattacctcttttaatctaacaatatttctgtctgatagtcagggcaatgatttttgtttgatatctgtgcattattaaacagaagctcagatattttggggtatttgatcacattcatgcaactaataagtatgctgaggtcttttcctcctagccagggttctttccatacactatttttcctcgtgcagcaaaatctctggatttatttcactgccttcatgctctgttcttggttacatccacacttgtttgtgtaatgctagagacacggttgaaacccaagcaagtcctcacagttcctctcaaactatctccaaaaggaactgttgatgaaatgacattggctaggtctcagtgcatataatgttgtagtgagcgtctccttatctagagaaagaagagtgtgggctcaaacttgtttaaaatcacattattctgtttgtaacaaaaaagagaagccaataaaacagcatgcatcaccaaagagaataggaactgtatatgttaattatttcattgaaatatatgacacggttgcaatttgggaaattatgtatataaaagttttgtttcttcaagttgaattaaataaaaatgttgctagttcatgagtaattttgagcaatttttctaactgtattacaataatatttgataattagatgccatgatgataatagtaaggaaaatattatttttgcttctggttctcaaaatgttttctaggatactatggctttccaactgtatccatccagtatcatacctttcacacagagttactgaattagtatagggaaattgaataacagattccctttgagtcaataacttttttcatagaatgttgtataaaatattgaacaaaatgaagccaatttagagacattttaaagacaaaaatatttgattttcattaatattgtttccttaaatcatagggtcaactgtaatatgtctattggctgtagtgtggttgaattactgactttctgtggaaaaatgtggcaagggaaattcttgtttctattcctaaaattaacattcaccacaggtcttgggttcatcctctctcaactttcctttggtcctaaggaattttggggcttctgtgtaaggtagatacagaacagagtgaaagctgacagactgattattatggtgcccagcctgaccaggaaagggttatgggtgaagtgggctaaagccaggctgaaaacatgtattgcttactttgttctctgcccattcattatgcttacttttggagccaagacccagtaaaatagcagattacacatgcaataatacacttttaccacttgctaatctttaaagttctaacatttatcttcatgttttgtaatgtggcttaatttgcctttagtgatagctttttcctttttatactcttttataactaggaattttattagttatattattgttaaattttctgctatcactgagtttatcaagtcaacggttggttttcgtcatagccagagatttggatttagcatcgcagacatggatttgagaagttaggtcattgtctacatttcaaataataactaactgaaagataaaaaatatgttgagaccatttagaaattaatggccaattctaaaatagaattcagaatttggaactcctagtcttttgtctcaatgttaattgtttcataaaagtatattcttgttgagataaaagcacttcatataaatttataagatgactattttatttaatagttagggatctgttttgtactgacatgatgtttttctttccgttaaagtctaagatattttcagatttcaggtaaataatagcaaaccatattatattaatattactttagtaaagtcagtgagtatgtaattgttggagaagttcaatttaagctgcagattttctaatttaaaatctatacttttcttcagtgatgatcattaaacgaaacattcatgaaatatttactttgttttgcttgaaagagagagtaaatggagaacaatcttgtaaccaccaagagatgtgaggaaaattagtctatgtcttcattttctgcagttttctgtttatggaacccatgcacatccttgtacagagtgaatgataaagtctgaatcattttggagttactgatcatccctaattatagtgccactgtagcatacctataattaagagagaattagcctctcaattataagccactatttttagagcttcacattttaataatttcttatctcaataaaataggacagatcttgaattagatgactttgtgtagaaaatgattttataggacccatatgcagtatgttactacagaaactttgatttttaaggacaggaatggttttcttatctaaacctatcattggcctgtcaaaccacaaagcacaattattaacttgcagataggaagtaactcttcatgcctgtgctgtctcccacactgcaatctgttccttctggttgtctcctctgggaggatgaaggacacagattattctctaaatatatggtctactttgttgataattttggaagaaaaaaattctaaacattgcattgccaaaataaaggtatttgccttcttgtttaatgcagtttgttccatctgcaaaagataaatttagtctgataataaaccatgagactctactattattgctcagcattgtagactttttatagtttagaaatagtataaataatggataactagtattaatgctgctgttacttaccagtgaaataattagtttgaaattttccatatgcatacattgtctactatataatcaatattacaagagaattaaaataattgagagtatttttttaaagatgttaaccttttttcaactctctctacggcatacaatacacttatttatatttacatatgaaaacgttcctgaaaagtaattgcaaataaaaatggcctagccattatgacacctcttctatggaactgtattaattgctatttcattaaagtcacatttaagtcagttattgtttgtgtttggtaataatacagcatgatttctttattgccatgttataaataatggatttcacaaatttgtcattccccgtacttattttattattcctgatattgctaatgatttatctgccacaattgcctctattgcctattcctaggaaggcagaaatatgtatgtctatgatacatatgtatatatctatttatcaatatataattatctttcaaatcttttggaaataaaatgagtgtagccatttgtgtctctatatatgcagaacgttactcatatcgaaatagacccttcatagatctgtcaccaatgcttaaatatttaaatagtttcaaaaatagtaggtattaaataaatgctgaatgtgaataaataaggaaaaaatagcatcgtatacatatgttgcaagtcactcatgcatggttagtcatttattacaaattttccttcctcagttttttgggggcttgattatagcagaacaatctgcacagctgacaattcttgcatgcccaatccttctctagatgatccaggagatgttaaaatcatttcctctctggttggcagtttttctttctctgacattttaattttttctcaccattccacagaacatctgagaaagcactgaattgaaaaagcatcctaaatgtatttacgaatacatttagcctaagttgccttcagtagaacccatgatctctgatttcagctaacgttagctgggttaacaatacaggaagggtcaaaatgtttcctttaaaacgtattgcccagtttaaggaccgtgcagctcattcagtagttcttaaatttcataggaagagaaaaataaggagatgtagaagaagccataatgaatcatgtgtttttggtgatccaatgctaaggaaggtgtatgtccccttgttgaattgtaattattgtgcaaagtggcagctttttccagggtacatgtgttattttggtcattctctttccataagtattctttgccaatgtcaatgtgctctgtaaccatgcaattgtgtcttttaaagaccactcttgccatacactcgctaaataatttgactaataagattacaggaagctttctattattgtccataccaaagagaaagcattccttttcataccaatagcagatcatgagaacgattaatctagaaggaaaggttaaaacaatacagaagtgatttgggattagtctctcatttcaaaacctttctaaaattcctgtttaaatgcttcagagagaatattaatttcagaataaattgtacaggtgctttaaatgccttagttttcaattcactttattattgtatttaagtaaaagaatgatctctgcctacctctgttggatctttcacactggttgccatggtaataaacatggtcccagagctctatagagaagagaatagaattgttcaattatttaaatatattgggaccaaatctcaactagatataagtattatcgacaaaattttgaacattcttcaattagacttttgatatttgaaggaaaatttgatggctcatgcctgtaatcccaacactttgggaggccaaggcaggcagatctcgaggtcaagagattgagaccatcctggccaacatggtgaaagcccatcactactaaaaatacaaaaattagctgagcgtgacggcacgtgcccagctactcgggaggctgaggcaggacaatagcttgaacctgggaggtggaggttgcagtgagccgggatcacgccactgcactccagccaggcaacagagtgaggctctgtctcaaaaaaaaaaagaaaatttgatattaaagtaatttatattttgcatttctagcagacaattttgctctgactcctactaagtgattagccaaagcaaagaaattggtaaaggtggctgctattttcatagggaaatgatcttttgtttgtttcttcaaacagggcctcaccctgtcacccaggctgcagtgcagtggcatggtaatggctcgctgcaacctcaacctcctggcttgaactgatcctcctgagtagctgggaccacaagtgttcaccaccatgctcagctagtttctaaattttttgtagaaacgagatctccctatgttgcccaggctggtctcgagctcctgggctcaagtgatcctcccaccccggcctcccagaatgcaggtattacaggcatgagccacctcacccagcccaaaaatgaaattttaaaaataaaatggacattggacaaatcaagcaatgacaaatattatcaaagttccaaaatatgctatttcatcgtgtctttaaaggaacaaagatcttatcatagtagaggatgttttatagattttaaaatttatagtatctctctcagattttttagtctatgttgcttctttaacaatattgagtagaattaaaagtctcatattagcattaaaataaaacaaacaaaattagaggcttatatgaatatttgcttatatgaattatatgcttttcaaaatgaaatagcaaccattaaaatgactgcagacattttactgtggctagcatctgatgatacaaatatgaaatatataagattaccttttcttaactgtgtataaaaattatgaagtcattgtcctatataattttgctccaaatacttttctgactagtctttcattcctgacatagcaaaaagaatgcagacttaagctaaatccttttataaggcagacagtgactattgatggaacaactttgatctttttatcagaaagatggagatcagagtcttcaaacatttatttcaggatacagatacactttccatctatggcttagtaatatgatatttgagggtaagaaatgtagaaagtatcgtggtccttgacttaccaaagggatttatactgatactacaaggggcccattctatcttatgtatattagtgggattttcctgggtactctttgaatttgcagccatttttccttttatgttacttcctgcgttccagggtttttgtacatttccttattttgaaatcaaattcagtgctgtttttttttcatagtcaaattttcttaagattgttaaaatcttccttctttccttccttcctccctccttcccccgcttcctccccccacccttccttccttccttccttccttctttcgttcttttttgtaacctcaaaatattgaaacaccactctttagcttggcagtgggacatatagagatatttcctaaagcaatggtagctggtttatagagcacagcaccaatggtctagtagtgttcctagtttccaaaaaaccaactgtgctggccttaaaatttgtttatttataatgaaaaagaatatcatagacttttaaattaggatagtttgctaacacaaccaatttttctcataattattttcactttttaattgcataaacacacacacatatacacaaacattgaaaatgccctatttctgaatgcatgttgttgaggttggatcaagatgctgaattaaagtattttaaaagccaactctcacattgcagataagttccttctctgtggtaatctctaatgtccgtatcatctgcaaacacagaagttagattacaaattagtttccaaattctgttcattttagagatatcataacatttattgagttaatcatccaaacaattcttgaatgtaccttatgaattcgttaagagtcactatttttattgacaatctattctgttttgttttcattgttatggtctttagaaagttcttataagatcaaaacttgtatcctaagtattttcatttatttgtcttaattctgacttaagtaattgctttcttttgcatactatagatacatcaaatatatggagagaactatcatctctttcataacttttctcatcactagcctaaaagttctgaattccctcaactattaattattatattttcaaacccttgttatggttttcatatattttaattgcaagtttgtccatgttagtcttacagtgcggtatctagatctggggtctgatttgatctacttatagaagatctttttaatttttttaatagattttgggggaacaggtggtgtttggttacatgaatcagttctttagtggtgatttctgaggatcttgacctgaatccaaaaattaagatttcagaccacaatttcaatctgaacattcatgttcttcaggcggcccagtgtttacatggagaaaaaaaaaaaggctctaatgaaatcatgtattcttcagttactacaatcacaccattgtctattactctattgctatttattttgcttacttatatatcctccctggcctttaaagtatttgaaattagaattctgttatctagactctataatttcatttaaaatctttaagtttattagctttttggtaactgcatggaattaattgcttgccttaatttgaagtttactgaaaacctggttgattttaatgaattgtggtaagcctcatgtattccattctatgaatatgaactgattgaagctacatgccagattttgcattcactcctgtttaattttacattagttttttctttttttttttttttttgctcattgtcctaatctcataacattgaaatactggttctatcatatacagtagtaatatctgcaaatttgaaatatttgtcatgtatatcttcatccaaattgttgactgaaatactagacataatggaaatgagtatataatcagtggtataacaacagcttctgttgaaatcagcatttgtatatgaagaaataataatcaatgttctttaaatatgattgatattttcatcacaaactcacctaattttgataaagctaattttctacctaaggcacaaaaatatgatatacttttcaagtgttttgatcgtaatcaagatgttcatgatagatcttgaatgtgccaattgaataacactattaaaaataacactattaaaaaatgaaagacagggtcataggggtatcacttgctcttcctctacattatcagttcacattgtatgcatatatgtgcacgtatagttaatacataaggtataatgagtaggcattccattaatgatataatttaccattcgtaaggtaatgagaacatatggaaataacatttgcattgacaactttaaagtcattgttttttaagcataaaaattaccaaaaagatatgattctatgactagtacaagcattaacatgtgatatggctagcctttgggtcactacccaaatctcaccttgaattgcaatccctataatccccataatccccatgtgtcaaggaagagaccaagtggaggaaactgattcatggaggcagttttccccatgctgttcttgtgatagtgactgagttctcatgagatctgatggttttataagtggctcttaccctttgctccatacttcttcccgccaccttgtgaagaaggtgccttgcttcccttttgactttcaccacaattttaagttaaatgagtcctctccagccatgctgaactgtgagagaattaaacttcttccctttataaattacgcagtcttgtccagttctttgtaacagtatgaaaacgaacttatatgacatgactctagttttatcacatttgagagtcatttcaaaatgccaaagagagctctgagacctagctttacttctggtggattaaaatgctgcgacagcctctaatttactcaagcctcagtttacttataaattatatgtagatatttactggattgctctaagttttataatattgttaagtgacttttttatttttaccaaaacatttttaatctaaactctatgttgaggatttttatgctttagtgtatatacacatctattgaaaatttggatatccaggtgttattcctggttcttctatgggctaatgagctatgctaacttaggaaaggtaatctttttgaatcttgattctataataaagggcttagattgtaaaatttttagatttttaagattcattctagtactaatcatttgaaaaccataaactgttaaaaatacttatagttgaccaggcacggtggctcatgcctgtaaactcagcactttgggaggccaaggcaggtggatcacgaggtcaggagttcaacagcagcctggccaacatgatgaaaccccatctctactaaaaatacaaaaaataaatagccgggtgtggtgatgggcgcctgtaatcctaactattccggacactgaggcaggagaatcgcttgaacccaggaggtggagtttgcagtgagcagagaccatgccattgcactccagcctaggcgacagagtaagactccatctaaaaaaaaaaaaaaaaaaaacacacacaacaacaacaacaaaaacacttataggcccggcatggtggtgcacacccataatcccagcactttaaaaggctgaggcaggtggatcaactgaggtcaggaatttgaatttgagaccagcctgaccagcatagtgaaaccctgtctctactaaaaacacaaaaattagttaggcgtgttggcgggcgcctgtaatcccagctaccggagaggctgaggcaggagaattacttgaaatgggaggcggagattacagtgagccgagatcgtgccactgcacttcagcctgggcgacagagcgagacttcatctcaaaaaacaaaacaggccaggcgtgctagctcacgcctgtaatcccagcactttgggaggccgaggtgggtggatcacctgaggtcgggagtttgagaccagcttgaccaacaaggagaaaccctgtctctactaaaaatacaaaattagaccagcgtggtggcgcatgcctgtaatcccagctactctggaggctgaggcaggagaatagcttgaacctgggaggtggaggttatggtgagccaagatggcgccattgcactccagtctgggcaacaagagcaaaactccgtctcaaaaacaaaacaaaacaaaacaaaaccttatagttggccagggcgtggtggctcacgcctgtaatcccagcactttgggaggccaaggtgggcggacaacgaggtcaggagattgagaccatcctggctaacacgatgaaaccccgtctctaataaaaataaaaaaaaaaaaaattagccaggtgtggtggtgggcgcctgtagtcccagctacttgggaggctgaggcaggagaatggcatgaacccgggaggtggagcttgcagtgagccgagataggagatagagccactgcactccagcctgggctacagagccagactccgtctcaaaaacaaacaaacaaacaaacaaaaaaacaaaaaaaccttatagttataattgtcaataaataccatttacatttttaagaagctgagaaattacattattttagtgttagaagtacaatttaatgcaaatcttgttaatattttaaaattagttttatttaaaatgataaattaatcgtatagaaaaattttcatgaaaaatcaaactacttttctttaaactattttattaactgtaaccctttataaaaaactaatttattatattttaataaaaaacagaaacattgtgagttttcatataaaatgtcatgattacctcatgcatctgattttaatgattcgaaaaatattttatgctcacttgattcattacttcatggaattgacagtttgaatacaaattcttttaatccaaaaactgaaacatgacattttaggagagcttaatgtgcaaaggaatgtcgagagaaatatttttattgacttcaagtatttaccattaagtttttaatttcatataggtaatatatgatgtagtttttgtgtaaaataaaattaatatataagcaaaaacctaccatctttagccaaatgaataagaagtagtaagtcaatggaattaagctctgtgaaaatctttattggtacaacacaactttattattcaggcgtgcttaatttatatgaaatgtttcttcaacaatgctagacaatgagcatgtttttcctttgactctttaaggatattaatatgatacactgttattttctgtgaattattagttggactgatatgcctattaataacacaaaaccatggaaaaagatttgaatagctatgtttaaagaaacttgacttcttaagaaacacagagaagtcaaagtatgcaccagattaaactgtaggcatcatttttctcctcatcaaaatgtgatggcagatgttgttactggtgcactgggttcttgcagtctcccaggatagaaatcaagagaaactaccagttatagcagcaaaaatgaagtttatttagcttgtgcacaagggtcccagcactgagaggggaaaagaatgctccattagggtagtgcgtatgttagttttataggatctttctatagggaaggattctgtcaggacttttctagagcttgggcagtggcgcaacatgctacatatgtcatatgtagcattagcattttaagtcttcccccctgggaactatttataccattaaaataaggaaggggtaactataggttggagtttaattctaactgtgcatgcagtggctccagggaagaccctaaccttctgaaataaaaacttacaattaagagcttcttgggtcttttgttactgattgactgagagttagataagctagagcttgagtgaggggcttttatcatttttctccagctcatattaaaacagggaaccaaccagcctgcttgtctcaatgtcatcctgaattatttcatttcactttattatacttgcttaaagaatgattgtatttgatttaacatgtaacttcaaaatacacagtcttccggccgggcacagtggctcacgcctgtaatcccagcactttgggaggccaaagcaggcggatcacctgaggtcaggagttcaagaccagcctggccaacatggtgaaaccccatctctactaaaaatacaaaaattagccaggcgtggtggcacgtgcctgtaatcccagctacccaggaggctgaggcaggagaattgcttgaagccaagaggcagaagttgcagtgagccgagatcatgccattgcactccagcctgggggacaagaacgagacttcatgtcaaaaaaaaaaaatacacagtcttccttggcttagctgtatgggaaatatatatatatatttatttatatatatatttatatatatttatttatatatatttatttatatatatttatttatatatatttatttatatatttatttatatttatttttatatatttatttatatatatttgtatatatttatttatatatttatttatatatttatttatatatttatatatattagttcatatatatttatatatttatatatattagttatatatatttatatattagttatatatatttatatatatttttatatatttatttatatatatgtatatattaacatatttatatatattcatatatttatatataaatatatatattaatatatttatatatatttatatattaatatatgtttatatatttatacatatttatgtatattaatatatatatttatatatatttatatatgtatttatatatatttatatatttatatttatttatatatgtatttatacatatttatatatttatatttatttatttatatatatttatatatttatatttatttatttatatatatttatatatatttatatatttatatttatttatttatatatatttatatatatttatatatttatttatatatatttatatatatatttatagagagagagagagtttaaatttcgtgaaaagcagcatgtagatttgcgaaagaggtagaaaatcaaggtgcagttgttcctgagaaagacttgtaactcttccctggggccatcttgacagaaatgattgtcaacccctgtgttttccttttgcattgcatcatgttcttctctggaccagcattcagatcagtattacagatgatgggaaattatgtggtttattttaaaagtgtgtatggcttgcctgtgttccctcttctactttggtaaaatttgctcaaatgtagatgttgcttatgagggtggtgatcatcattgcctggcgttcatctccaaagtccacacaaaggggctaattgaggcaattcgatttgtctttgatttgcattttctttacaattgcttaaattatctgggtgcttttggtagaacaatgtgtgcatgtaacatgaaattgctggattccaaaattttaacaggaaatgctattaagaacagtatcttagttgaccacatggtattacattattttttagtgtatttgtaaatatattataagaaataagtggtcaagaggctggagtggatccgatgattgtagtgtgctccccagtgcatcaggtagaccacaaatatatgaattaggccaaactaaacactgtcacctacattaacctactaggttggcacaaaagtaattgtggttctgccattgaaagtagtggcaaaaacagcaattacttctgcaccaacctaatgaaaaataactataatttatcatgcatcttcttagatgagaagcccaaaactttgctttacctttggaatgtttttctgctggttacttttttatttttgctatggttttggagaaaatcaagatttctaggcatcatttttattatttagtctaagactctttctgatatgtttaatagaaagtaaatgcatatattctgaattgtctctcagtaagaatgtcatcagattcctctaattcttgttttgaaagtagctgtgaaattcaaattagtaaatgtcttgtcctaatgaatcgcagttttcaacagaacagtattataatgtctatgagttatcttatttgtctacctttggctaaatatgttcaaacaatagctcttgaaaagatagggtcatgaaaacattttattaactttgttaaaaaagggaacagtaaactaaaaactgtgagccaaatgatttagctgaggaaaaattgtctatcttacagaaattctgacttatgaaaaaagttactttcagtctgattcagtatcatcaatgtgtattttaaagtctcagatactttatagatgttattaatctacaattacatcataaaatcatgctcctcataagaatatgtcatatatgttataatacatgtgaagcctcattataaaaaaatgactaacagaacttgtatgtctaggtgacctaacataccagaactaatgacctaacataccagaactaatatatcttctaaatgattcaaactgcaaagacagcgatcaacagctgagacgaaagtagctaggtccattttttttctagattgtattttaaaatcctttcattcttggaaatattatatttacacttagagaaatattcttaaaaccagccgaaaatattttatgaatgaaacagaaaatgttattgctaatttttgaattttctctgaagggcattcatatttcatgtaatattttaatgcctcaaaattgatattttaaacttggaaaaattgacatttaatggatgatttgataaaataattgtgtcatcattttgaactcttctttatcagcctgtgattttgttccaaaattgtgatattgacgtcatgtttttgtgagaattcacattacaaaaaaactttgaggtttagccagattgcttcctatttaatcaaactcaaatgctataactaatctttcaatttggttgagaatatgaaggcagactataggagaaaacacaaacaagcagtttctacagtaggcaaagtttcagaaaaagcaaaaatggtttttcattcctaactaaatcacaaaatagctaattagaatacatttattaagaacctactatgtacaaagcttcatgctaaacatagctggggtcctagtaaaattttcactctcatagatatgcttttacaacagaaagaaagcttgattcactaggtaatgaattttaaaatctaaaatctgaagcggcattgtttggtaatagatttaacagtggtttacttaattaggtgagagaataagtattaagaagtaaggaatgttgacatatctttagagttaaagtgcctttttcaggagacagctggccttctgcctgcatagaccactgagctgaaatgatccatgagcctgtctcaatacaacagcccctactccaatggtgacagtgagaaacacaacttaagtctgagcatctctgttatgctatcataaaccccagtgacacaagcatactctatactctatttgcacttgacccaagattttcaccaaaatagagtgcttttatatgtaaagctacctgaatcctcagagcagtattataaaccatttggatttatatcatatgtctgctttttgtaaggtaaaagttatattttttaaattccttagaataaaaaacaaacaaaccccccccaaacctcttaagttttaaaagtaagtcttcgatttcaatttttcatttcaaacttactaaattaaaataacaaaaggggttattcaaagtcatcttcccaaaagggattaaagtcatgagaaagttgtgaatagaaaaataagcagacattcaaatgctttgactttccaactctatgctcagcttcttttgagtctgaataggaagtattaaatgactcttttgatgtgtatctttgcttttgagtccattaagttttaagataaatattcctttaataatacagtttcaattagcctttctttctttcatatctgtcactgataagaatgttggtttttttccagtatatcttgaaataaataggattttggtgtttaaatattcaaagaaaaaagtcctgtttaattaaaagaaaacttcaatggccaaagaatattcttttaaaaatcagtgttattctagaaatgtttcagtcagtattagatagaagtttccagcgtaatattatctttattccacagcgaataggcatttcattagaatctcaccacttacatgcctgaccaacccacattacacagatcctgttctaccactaattaggaatcgaccatttaggatttgggcagcaaagatatcctttttgttgtctcctaatttgaattattcctatagatagtatagtgcatttttcaatttattttggattgtgactatttcagattacttctagatatacagtattttgtttaccatagtaaatcgatgtttcaggtccttgcgaatctattaaaaatgatttggcataataacaatttcatagaattgttattagtgaaaaaaattgttgaaagatgagatttgttcatattgtgtatatcatctatgttttgaaaagtaatacctctttttgtgttttgtgagtaattttttagggccatctcttaatgctatctggccccttacttttcctgcagagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaaggtgggtggaatagtataacaatatgctaaatgttgttatagtatcccacctaccctgatgtatctttaagactctcttacggtttgtatacggatatgaggtaactcaccatcacaaaaatgaccaaaaaacgtttctgaatgtttttaaacatttagatactgttttatatatttatgacaggattttgttttgtttggtttgctttgttttaaaacatatccttttttttttcctttaagagttaaaacacattcattttaaggaatacatgtttgtttagctttactttgtttgagtttttttttccacatttctaactaccttgtcagtctaccagcctgcttacaaacactctgcatacagactaagcaaatggctgtatcctaacagtaaactgaaataactaactgagaaatatgccactttttaattttcattttaatttttgtttaagggatatactttggggaaaggaaaatgcactttgaatttctttgcacacatctctttactatgtagttaactctttgtattcctattttgtcgtttgttttttttttagtggagtcacattcaagacactgttatttgtttgttgtggatgtgagtacattgctgtagaatatagaactccccatattagcactctttcctttattttctttttgttatgctctaccaccttacccaaagtttcagatttttagtagctcatagtaacatattattgtggcctttttcccacttcatttttttgtgacaagagttgccacagaagccaaagaaaaacaaattaaaacaaaacaaacaaaaagtctaaaatttgctcaccctgtctgacaagtatgttttatcgtttcaagaaatgcggttaacctcgcagtactaaaactgaatgaacaaggcctgttggacaaattgaaaaacaaatggtggtacgacaaaggagagtgcggcagcgggggaggtgattccaaggtcagccccagtgagaaaagtaatgggtaactcaatgcaaaacaaagtaagcagcagctatgcacagtgtgggcactccgtgccaccaagtttccaacgctaagctgaagagtgcaattggatgaccaggacacttgacttcttctttctttcttcctctacttctctttccctctctttctccatatctcaaggaaaaatttgtaactaatggatttgttgcaaactgttgcacctgctggttacttccagcgatacattaatgctcatttggctctgcaaatcttaccgtttgcttaggccaaatggcgcatcaatgactatcgctcttacaaagctcttgaatcagtattatgtaatgaataacataaaataacattgataatgttatttatgttattttccacgtgaagaaccccagtaaatcttgcagtattgaaactcagtgagcaaggcgtcttagacaagctgaaaaacaaatggtggtacgataaaggtgaatgtggagccaaggactctggaagtaaggtcagttgctgcaggttttatgtgaaaaaacaaaatcaaacacaaacagcaaaatcaaaccacaagtgtgttagtgggaatgacccatcttaaatagaatgtaaatgcaaatatgcatgagatgcataatttggtaagatgttttggtaatgcctgcagagttactgatttgttgtttttattttattttaaatatagtatatgcatttaatatatttatttcagtctgtgttcatgtctaactcatacataatagtgcatgaaacagcaacatactgaaatagagtaaatggcctaatgagaacattaatgaaacacttaagattaagtgattatagggatgtgtgttttccttgtctgttttgatggcacagttgcagcatctatagtatcactgattggcaagactattcgtgtgcatcatgtgtgctctgtttgtattgaatggcaaagctttgttgtgagatgtagtctagtggatgagagtacactgaggggatgaattttggagaccaagagatcaaaaatggtacactgcaattctaaacatgtccaaagcctacttggagagtgagaatgtactggaaccttcaccagccaacatattgcaggataacttcctgaaggtttatcttagccatcttagtactttgagggattggaaatgtggtcagtcctccatttatgactctactaagccagtaacatggtcaacatttaaaacttgcttctacaatcacacgtatggtttattttagccctgttcgctgtcagctttaccagattatttataggatgaagaaactgtcttgtaccttcaatttttcccacggtaatggaatataactatttatcaatttatcactgcaactgacatagccagggaaatgtttaagaaatgaataaatagaagtttattccctgcaggtagtcgattgagtccaccaaaatcttaagctaaattttatgttgtttcatggtagctgttatgaaaatggaccatctaagagaaaatccattgtttctcaaattcaaatgcattctgtgtgactaggttgttcccgtgataatgctatgtgacattgctgttctcttctattcaccagtttgccttcctaataacctcttctcatatacattctttaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttagggggtaggaacgaggctctaatacaaactttttagtgcacgtttagctttcttgttgcgtccttaagctcttttaaataaggaaggtggccaatggatcatcctgtatgtattgttgacgttcttccatgttcccagttggtgactaacctgcagctcaactgtctattttcctctttaatggcacagtagcttgggtgaatgtggacagattcctgccataattgtgctttattatttgtagttcagctttgcactgtttgctttcatttgctagaagctttcagatagaagtaaacttttcaaaaacaaccctgcctttcctctggatgcatttgaaaaccataacgtatgatttctttttctttctttccctcctctctcatttaagatgaccttgaatgatgccatgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataagaaccttttgagtgccttacacaatggttttcttgtgtgtttattgtcaaagtggtgagaggcatccagtatcttgaagacttttctttcagccaagaattcttaaatatgtggagttcatcttgaattgtaaggaatgattaattaaaacacaacatctttttctactcgagttacagacaaagcgtggtggacatgcacagctaacatggaagtactataatttacctgaagtctttgtacagacaacaaacctgtttctgcagccactattgttagtctcttgattcataatgacttaagcacacttgacatcaactgcatcaagatgtgacatgttttataaaaaaaggaaaaaaaacatttaaaactaaaaaatatttttaggtattttcacaaacaaactggcttttaaataaatttgcttccatattggttgaataagacaaaaacaattaaactgagtgggaagtgaataaaaaaaggctttaggtatcgattccatatttttcaaagccaaatatgtaaatgctaaggaaagtaaacaaagaggagattccaatcttgtaatttaatattgttattaaaactttaatgtatcctattctttaacatttggtgttaatataaaattacttggcaatgcttgacatttgaaataaacatttttctattgttttattgcaagtggtccaattaattttgcttagctacagtttggtcataaatcaagtgagtttaaagacactaccaagttgttaggtgcccagagaaaatttctcccttttaaaaaggccaggtgatttttcaaatgtaatcttgcccccaaagtaatatctgaatatctttttgacatgtctaaatatatatatatataaagaaatatttgttaacacaaaagcatttgatctatgtagataaatgctaatagatttaaaaagctaatattaacaaataccagaatacgtgaagttccatttttaaagtgtttgagcttacagaagagaaacattcattttaaatgaagtaaaaaatgccttgaaagtaattctttagatagttgcccattgattaaattccaaaaactaaatatgtttttagctttaaaattataaaagctgtcataaactttatatattatgaattttaaaatatgtttgagtctcctgcaatatagtttcatcccattgacatcaattaaaaataaccctaatatattatttttatatttattcctcaggtggaatggctattttaatatgcccagtgtggataaaatgtcacatttctgtaacttttgactaaagagcctatatttatctagttaatgaatttaaaggatctatctttcccttcataaaatacctcttatttccattaaagccccccaagtttaattaatttaggattttgaatgattattgacatccaatagttatttttaatatttgtattcttgttatttctggaagaaagcctttgtgtagcacttggtattttgcaaagtgcttttaaaacattcttacttaccgtatttcatagaagggaaggaaaaatgtaaggtttaacagtaagcacttgcattgaacatggaggcatgtggtatcatgatattcttcactaaatttagctgtccctaatcacagatcctaaggtaatataatataattttagtgcatttctcctcatcaggaatgctggaggtgcattttaagttttaataataagtgctagaatgaccaaattgcagactaattgtttccatattgtacttaaaatgagtttttaaaagtgaaaaagaaatgactatatacaatcaatgctatttattgtacctctgggcctactcttctaaaaattgtagcttatcgatttttctctgtcaagcttgaactaatgtaaataattgaaataatgtaaagttatattttcatgtttttatagatacaacatgacaagaatacataatgtaagagtatttcaactatggataatgttgattggataatgcacatctcagttacaagcagtactcatagtttaatatccatgtaacggtgcatcaatatattgctatataaatatgtctgtgtgcatataagtgaaaagtggtcaaacaagagtgatgacagctgtctaaaggtttttttattcattttatataaaaactgttatggaaagaccaaaatgtttatgaactattcttatgtaaatttacaattgtcctttactgtacttttttgtttacagtatagtaccttattttctgctgtgttaagtgggtgtcaaactccaagaagacatacactttctataacttctattgaagatattggaatttccaatttttcatgtgtactatgtcagaaaatgctttcgattttatttttaaatctaacatcggatggcttttccggagtgttgtaaaaacttcaatcatacataaaacatgttcttacaaaaggcaaagatctttattttttttacttaatagtacttcaaactaataacagtgagaccaaaaagtgtatctaagtttattcccaaacaaacccaactgttcctactgaatgaggacatctttgctcaatttatttatcagctaagtacgaaggtaacagaataaaaaaaattttgtaagctaaaataattaacaattcaggtcattcatacctacactcattaagtg

SEQ ID NO: 14625 - DNA, 14012 bp, Human
cccctgaaagaaggaattgaagagaaaggatgaaagagggggatacaaggaatactgcgtaactgggtgagggcacaaaagtgggcagtgtctgggaacttccaatacagaagaatccagtatatgaccaaaccccagttggtgctggactcaggagaggagacagtcccttcagccacaggggctgcaacaaagttgtttgtcaaacccagcatgaggaaggtgctgggcagggctgctctgggccacccacagtagacagactaaagatgtcagtctgaagatgcagctcttctttgtcttgccaagataacaccgataagtgacccaggtgggaagccacttggtttgggtgggctttctctctcccatgcacagtgctttctaccatagatcttactaagccatgtcagagttttggatttctgattctcctcaagccaaggagggatgagcagattgctgaactcccgggtgtgagaaattgggaaggaaaaggactgagctcagggccaagagcatgggcaccaggaggcctccaagtgtaacccctgtctacgcacatcctcctcgtggggcacaaaggtaggcagtcaaaaatcaaagaaggaattttgctcaggagatgaaaaaaggaaagagctcaaatgggtggatctttggggaaagtttcctcaagataagggctgcggctctcttaccccaaatctcaatgctcctgtaaaggagactgagtggtgcagagtggtacaagcccttctgctaaggggagaatctggccttaccctagtgactccgaggagactggccctttcctctcccaacccgagtgtagccaggatcccacccacaactatccccctacctccaccctctggcttctttccccttccctttaggctcacctaaaacagcccctttctgccccagttcccacggatgccttggcactgtctggcacaatccttggcagggaagtggggaagggaacccccatcctggcaggactaagacaaaatctatccgtgcaacaggtgtggggaggcctacccagctcacggaaagttccccccttctcaagggttgggcaacaccgcctttgccgcagcgtccccgtactgagggggccgggcacctgttggggcaggagctgccgtcctgtcattagcctgggggcaccaagcccattcctccccgggaccactgcggggtttgctttcggagcctccgggacgcacgggcccagacccgccctgctgtcgcctgggacccctcccccgtctgccgctcgttcccgcgcctcttctgtctcccacggtctccccattttcctgtcctctccgtcctccctctgcctctctctctccggtttcctcgacacctgcgccctctccagtctccgcccgggtcgcgtctccctcgcggtctcagcgccccctccctcccccgccgcagccctttgtttcccggcggagtagttcctgggttgccgagcgtctctgtctccgcatctctcctcgccccgcctcctccctgcctggatccgccctgcccgcagcctctcctccccttcctccccgccgccacggccccgtaggtgctcggggacccaccttccacctagcacgggttcgttcccctctcccggcctggcccgggctccccggtggccgccgccccctcgccgcccccgccttctcccggggagggggtcaggtgggcgggcactattgttgtaggagccggcgccagattcctcagccgcgctcggggtgggaccggctgggtttgggggggtggggtggggggagcggtgatctgagctccgagcagctggtcttcgcggctcgctccctccttcgcgctctctcgctccctgccgccgcccgcagggctgcggggctcggtggcatctcccgggcgcggcccgcagtccttgcccctgcctccgggccgctcccgcccccggcgccgctcgctcccccgacccggactcccccatgtatgacgactcctacgtgcccgggtttgaggactcggaggcggtgagtgcccacgatgagggtgggggcggggaagttggggtgacacctcctctcccttcaaccctttccccggttcaggactttgaaaaacgcctcagtggcagggcagggtttgtaggggggcgctctaagaacgtggggagatggattttcatgccaagcgttccccagcgacccagactcagaccctggggcatcgggtgtgtgcagagagggggcagtataggggaagggctcaagcaggtggctccacggcccaggaaagaggggtgggagaaggcagggctggaggccgagggcacagaggctctggagagggaacacgccatgtctggagttccaaattctggatttctggggtctgaacacaacagctaggagagccgccgaggtggttggggaggcagacattctagacctcttgtgcctcaagcaaacgacacatcagggagctgagaggacatcagggagccaggggccaacctcttcagacagacggatcctaaaacttgaggagctccattattcccttccaccccctccatctctgcgcattgcctcatctcctcaccctttctctagcccagtttctctcccaggctgaaacctgggcgcccagcacatgggtaggccaggtgactgagccccatctattccacagccccctgctgaggcttcctctgcagcgggcatcctgagctcttgcccagcatggagggcctggaggtgaggccagaggagctgagggcctggggatggagaggaagcgctttgctcagagaaacaggcaaccgataaatatttaattctcctctttgcttttatctcctgacccactgagacaaatcagctcattaagcagtgattcccggagctcagacagcagggagagtgcctggaaagatggggcaagaatgcggagcagcttctcagccccttggagctgacaactttccctcaaatgtcctgtaagaaggcctccttaggagtggaccactagatggcttggaaggggccccaataggttggagcacccctgggtcggaaagaggagttcatgttcaagtcttctcccatcacttactgccaggcccaggatagatgaatgctgatgttcagaataggcaactgtccttttctgggactggtctccttctgggcccaattctccatggggcctctggggctaattacattgccgctagatcagatcattttcaaggctctggtggacacctctttctgacagttgaagggacagctggtatagcccagggtgccaaggtgagcttgaaaacaaacctctctgtggggctggatggccctaggaggttcttcccatccctggtgagaaggcaagggctattgcaaggagcagactgacatgtggatggtgttggagggcagcctgctgacccattgctccctcccatctctctctggctctgatcaccctcccccacttccctttctcttgcctggctccttgctctccctgaggccccctctgaagcagtaggagggagatcaggctctaaataaatccaacggctcatctccctcctctccttcccccgtgccaggcaagagaggagctgcagcctgcccacacactcactaggcaaggggggcaccaccagggcactgtgccaactcctggcagctccaaagtactgaaactctggctattttggcgtagcagggtacaggaaaggtaagaccctagatcatgcttggcagggcagccctggcctccccaagtaatactggagcactagagatgagtgagcctggaggacttgggagtaatggagagggggttccattctgagcacaactcattaaatatttaggaagagatcctgtgattcccatcccagggtgagaggtcaggtaagccagatgcctcaggcgttatgattactaaattaggccgccagcggtgcctcacacctgtaatcccagcactttgggtggccgaggtagatcacttgaggtcaggagttggagaccagcctggccaatatggtgaaaccctgtgtctactaaaaatataaaaattagcccagcatggtggcacatgcctgtagtcccaactactcaggaggctggggcagtagaattgcttgaacccgggaggcagaggttgcagtgagccgacatcgcaccattacattccagcctgggcatcacagtgaaactccatctcaaaaaaaaaaaaaaaattactaaattaaaccaggcatagagactcatgcctataatcccaatgctttgggaggctaaggtaggaagatggcttaagcccaggagtttgagaccagcctaggcaacatagcaagatcctgtctctacaaaaaactagtaggcatggtagcgcatgcctgtagtcgtagctactcaggagacaggaggatcgcttgagcccaggagttcaagcctgcagtgagctacgattgtgccactacactccagcctgggtgacagagcaagacctgtctctaagtaaataaataaaataataaaaataaagattactaaattgggctgagagcctggagcacaggcagaaaaggtcagactcctcttttagcacagttctgggcctctgggaggtacccaatgtatctgtaccaaagcgagtggtcatctgccttgcctcctgcctcccagtctgttggcccctgtctggttgcttcagacaccaacatcccacagaggtttctcttgtgtcctaagacccctgggaaggaggtccctcaccctgtgcaaagattatttctggggttcatcccccacttatcctgctgccatccagcctcattttgttctcaggagagatgaggaacagtcggcggactactcttctgtaaaatgaaagatctttcccccttgtgctatcttcaggcctttggtctactatagacactgtctttagcctaaggctcgagagcctgggctgacccctagctgaacagccctcttgcccacggcagggtaggggtagagggcatggttgacagcaggtatgtgattttgccttcttctctgagagtctggcctctgctgccttccgtaggtggtcatgcccagtgagcttgagagaatgttcctctacctgaggacattctaaagccccttcccctatacacacacacactcctgcatgaaccccttatctaggcttatcccttctctctgccactggcatctcagaattgtgggaagtatcacttgaggcttctccccacagagagggaaaactgaggcaggaaacgaaagactccctttccctgacagaggaggaaacccagacattgtaacctctgggctcttgtctcaaagtccagcgtcccttactcatttgtgcctctccctcatggtcttgaggctgaactctgtgaccgtcaaatgcaccctcattgcccaagacctttcctatgggcaggactcagagactctccttgctcatgttaccccctccccacatccccggggtcctgctccgtagctaggttgcctggcactagcatagccttcttctagggctgatgtcccctgggcctgggaaaggactagggagatgtaggccaagtggtaggtgtggcccagcctcacctgcacccagggagacagctttgtgttcttggtctgtgtcttgtttgctgcccacacctggctagttgccccagcaggtgtggaaggaagaaaagtagggggtggggagagcaaaggggaggtaacttctaggagctggcagctttgtgtcctcctcttcaccctggaagggtaagggctcaccatttgggagccttcagagccttgttggagtagggaaagtggaatcttagggggcagatggctggatccccacattcaggactggtgctgtgccaaccagcatctcttgactgttgcggctggctggactcctgacaggcatcttaaagggatgatgtccaggctgctttgcaggctgctatgaacaagagggctgggtctcctggatccagaatcatctctaatacatcatcttcagcacacctcccttccctcggctcagaggacatgttagaggggagaaaagggaggaaagagagaagtgaaggctctattcaaagctgcagtattaataggcttgggggaggaggggcccagatctttgcacctatggattgggccagctttcctgtagcctcagaggcactggggcccttctcaggggataggaggggccatagggacccagctatccccttggagatggagaaactgggggcaatagaggcaacactgtaaggtgaggagggtgcctccatggcatccttcatgccggagcctgggagtcacagcctctttcccaacccagggttcagccgactcctacaccagccgcccatctctggactcagacgtctccctggaggaggaccgggagagtgcccggcgtgaagtagagagccaggctcagcagcagctcgaaagggccaaggtatactttctgggcatggggcaagacaggaggccaagctaggtggaaacctgcactcggtcctaagtcccaaggggtccttgggcaggatgtccttgagtgtgagagggtgtgtgtgatgggcagaggccacggccttctgctgttggggcactgaagctggaaggggtgcttcgagccttctctcacttgcactaatgggcaaattctccagcacaaacctgtggcatttgcggtgaggaccaatgtcagctactgtggcgtactggatgaggagtgcccagtccagggctctggagtcaactttgaggccaaagattttctgcacattaaagaggtgatcgacccccctacttccagaagcctctaacttcattttcttgctcttgctccagatcctaatgcttctgacttgaatcctcagtctaattccccaagctaatcagctcttctccttaacacacacctgtccacccctcatatctaagatctcatccccagggtctccatccttctgagacctggcttgggcatcagtctccatgtctgtcaagtgagcagttagattagctgcctccgaggtcccctgtgacagctgcaatgcctcactcagaaatcctgggtggcccgaacttggctgtcctttcccctggccccttctgcccaccgccccttgcattgcattcctcagaccagctcagtgactgcctcgctggctccttcacattgaagagccaggactggggcggggcgcttctctcaccaccccttcctgctccacctgcccccagaagtacagcaatgactggtggatcgggcggctagtgaaagagggcggggacatcgccttcatccccagcccccagcgcctggagagcatccggctcaaacaggagcagaaggccaggtgagagttgggccgtgagtcagtaaacacaccccaaacacttgcactgtacccacaggacacgtcaccatgcatgccatacacatgcatatccccctgaaatacacatacacgtatgcccagctctacacactcaacactaaacaaatctacaaacacacacacatattgcatgtacacctgtctcactagataaagcatatggaattgtgtacaattattaaataatgcatagaacatacatacacagagacacattcttctctctctctctttcacctccctttcttctcaggagatctgggaacccttccagcctgagtgacattggcaaccgacgctcccctccgccatctctaggtagcctccccccaacccacccattttgggtaggtgggtagctaagacacagggaaagaggggatcctgcccaagtgaactgtgtgggaagggtttgtggagggattggaaggggtggggagaagccagtatctcccctggggacggggataccatgcccccagggacctttcccccttcaccaactttaatcttgtatttccttttccaaaaagccaagcagaagcaaaagcaggtgagtcaaggaagggacctgggctggggggatcatggcttatggctctggggacagtgttctaggcagtcattgttggagggcagaacagagaggggagggagcccagaacctctggatctgccctgacgccaaccaggcatgagacaggcaccagggccatggtttctactgacctcatgtccattctgcaggcggaacatgttcccccatatgacgtggtgccctccatgcggcctgtggtgctggtgggaccctctctgaaaggttatgaggtgagaggaggtccttgaccccaaagagtcacctctaccaagcctgccacaggaagtccctagggaaagtggaaggggtgtgtctcctccgtccagggtgtgtatgtggagcgcattgactctggggccatgcatggggaggctgcttctctccaaaggggcccttcatcagtgccatgccttcccccaggtcacagacatgatgcagaaggctctcttcgacttcctcaaacacagatttgatggcaggtaagctgccctggcctgaggtggcctgagaaccaaggagaagctcatggcctacttccagatgcctgtagctagtcttctctaagggaagagttagtgggagctgagtaaggagaggctgaggcacaggtttagaagcaagctgtgattctccactcccaccccaggatctccatcacccgagtcacagccgacctctccctggcaaagcgatctgtgctcaacaatccgggcaagaggaccatcattgagcgctcctctgcccgctccagcattggtgagaagtccccaccacctgcttctgtgcccactcaagtgccagtgagaaccttcctcctcccttttcttttttttgagatggagtctcgctctgtcacctaggctggagtgcagtggtgagatctcggctcactgcaacctccacctcctgggttcaagcgatcttcccatctcagcctcctgagtagccgggactacaggcgcccatcaccacgcccagctaatttttgcatttttagtagacgtggggtttcaccatgttggccaggctggtctcgaactcctgacctcaagtgatcggcccaccttggcctctcaaaatgctgggattacaggcatgagccaccatgcctggcccctcttcccttttctcttccttacctccttgtctttctgcccaactcctctacctgcccccaggattggcaagaacacacccctcctcctcaattcccattcctctgcctgtccaggcttcgatgaatgcccttttcctccaattccttcctgtccaccattcgggagccctcaaagcctgctggagtgagcagtgggcagagctcctggtgagcactgctgctgcctccctccatagcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtaagtcagctgggctcatggaggaggcccacagggctatcctactagaatgtggcatgattctacttggtccctgcctggggcacctgagttcccttttcctgctgcccttaacacaactctgagtcatcctcacctgctactgatgccacaagtggaagaaatgcctagctctgcccgggctcagctctgcccagagtcctgagagactccaggcctagctctgccctccccgctcaggtactccagcgtctcattcgctcccgggggaagtcacagatgaagcacctgaccgtacagatgatggcatatgataagctggttcagtgcccaccggtgagtgcctgggtcagctgctcctgtgcccactcccccagggctgcggcagtgatagagatgggtggggggctgctactgaggggaaaccaacgttgcgccttcctccccctccccaggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcaggtaaccatttccagtgggcagagatgctcaagctaagccagccaaggcactgcccctccctgcccagaggactgtccttggcctccagttcagcatgccaaaggattgtagaactctcagctctgctgtacagagctagcacagacgggcaaaggaacttcctgaggagagagggaatcaatcaatgagatggatacgtcagagattagtttcctaggggtcaagagaaacacaatctccaaaccttctcccaggctgccttgaaggcagagcctgaattttgcgggagtcgaagctccagttttctctctcggaagaggaaaaatgctccagcatgctttttccttgcactatttcctttaccggggaattgagagttgaggggggaagaatctcgcacctcaccagaagacaaggtgaggtctgtactgcctcactgagagctgttgtatggcccccagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgacagtcaagggactgctttggcatccagggcctccagtcacctcactgccatacattagaaatgagacaatcaaagcccccccagggtggcacacccatccgtttgctggggtgtggcagccacatccaagactggagcagcaggctggccacgctcgggccagagagagctcacagctgaagctcttggagggaagggctctcctcaccctgccaggaagcttcttaacatgtgacaggaccagggaccaggagcatggtgaagccaagtggcagatgggagccaacctggatgggggtttggggaaggagggcatgtgtagcagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtccctccggcttctgttctgtctgtgatgcggcccaaagtctggtggagggaaagatgtgtttgggccgcccttctctcagaggatctgtccagcgggaaggggacaaaggcagagctggggaggcactccactcccaggcatccccactcctcatgcccaggtgtcaagagggagacatccagcagcacggaagggcttgtcctgggatgtggggaagacgcttggtcacggctttacagtatccttgcgccaggccaaaaaggccctagaagcagctacaacttgaactctatgtactaggccaactctttctgtggggtaagaagagcatgtgaacaagaggggtatggggggaggactgcagccctgcgttcctctcaccacagcctgatacagctgggtccacccgttctgcaccatcccctcccaggagcaatgggtccaactagggagccacaagcaaagctcccgagaccaggcgttgggcacacagcggcagagtggttccaactgcctcacctgccaaaatttcacaactgctttcctttctcacctttgcctaaagctccctagagggtgtccaggccagggccacacattacgcgaggctagagcaggggcggaagatgcattacagtcctgcgtggcttctgcatctcctctcaagtccacctacagactcaagactatcagcagagacccctctactcttctcttaatgtggctgtctctcattttccaagccaacccaccccgcacccagtggtgtccctcctgccagggagaagctgggaagtttaactagaactagatctaacagtcttaatattcatgtatttattctcagaacatacaaacttatcttctcagagaatagaaaacagagatttcactcagtgacaaagatggacacagccagttcaccgtgtccccccatctacttagaaaatcccctgggggaggggatgcctagagcatacagcaccccttggtgcggggctgtgcacaggtctaaagactctcaacttcctttaccatccaaacaggaaaacagctgtccagatgacagtaagattccactgtctgtaatcctcatggtgccaggtctcctggggcatctagggcaatgatgctactgcagtttatgcagttacacagtcaagtctgtgccaaaggaggtcccatccggcggccaggtttctgttcagtctggggagcaatgccaactggctgcccccatagcctggcatgagctgatggcccagtgcaatcccaaagcaaagaagggcagaactgggccaagaagctgtggtaatttgctctccctgcctccgacagcgtcgtcctctccttttgcagccccacacgcaggcctcctgacctgagggtctgggctagggagttggattgttttcctaagcccccatatcccaagagtgaggacctggaaagagggatgtgagggttctgaaaaacaggcatcaggcagctttggagatgccctcagcccacaggaagagtgctgtgtcaggcaaagatggtctcttcccggcgcttcttggtgaggatggtgcctggcttatgctgggcatctgggtggttggctagttcggggggacaggaagacactgggctttccaggatagcttgcttcagctcgtagaacacagcagagtcctcttttgtgaggaaggtgatggccaccccactcttgcctgctcgtcccgtgcggccaatgcggtggatgtaatctggggaatgggaagaacgtcactcagcatagcccagatgccctggggagccgtgtctgatgcctccacttctagaggcatccttcccaccccatctccaaaggcaggaatacagcacatgctgcctgaacctgaggcgcccacagtgccctctccaggtgcccatctcccctgtcctcctactgactgtggtccctaccacactaagacccacagctgcctagcttcattcttcacactcctgaggac

SEQ ID NO: 14626 - DNA, 21914 bp, Human
  misc_feature (1)...(21914): n = A,T,C or G
aatgtcagtgctgctagctcagcaggtttaattacaagggacccctcagggtactctgtgagcatagaggagtgtggccctggtggggacacaggcatgcatggatgacagtgctgtcagcctcatcttattctgacctgggctcagccaggagtcacattaaaggtatcatcatggagtcctcccacctcagttcatgacatttcctccaggaaatgtgggatctgggactgatttggttaccatgatctctataacttgggccagccatataaaactgccatggacctcagtttttgtttatatatatttttcctttcaaatttgtcttgtgccccagggggcaacaggaccagtttctcagggttttggtgaagatcagatggaattagggatgtgaaaagatcttgaacagtttaaagcatagagaaagtgcatggagtatcattcgtccatccatccagtcatccatctactcaatgaacatttattattattattttattttttgagatggagtttcgctcttattgcccaagctggagcgcaatggtgtgatctcagctcactgcaacctctgcctcctggatttaagtgattctctcacctcagcctcccgaatagctgggattacaggcatgcgccaccatgcctggctaattttgtgtttttagtagaaatggggtttcaccatgttggtcaggctggtctcgaactcctgacctcaggtgatccactcacctcggcttcccaaagtgctgggattacaagtgtgggccaccatacctggcctcaatgaacacttgtttaggtccttctaagggttgtggatacagcagtgagcacagcaggtcaaaatccttgccttcataaggctgacattccagtcaggagagacagaaaatgaacacataagaaaaatatatagaatggcagttgctgattagagctatggagaaaaagcataaagctgggaaaaagatagagagctccaggaaagggggttgctattttaatagggtggtcagagggagcctcactgataaggggacatttgggatgtgacctggaggagctcttgttccagacagagggaacagcaggcactgaggtcccaggctggcctgtgcggggtgtgttgggaaacagcaaagaggttcttgtgactggggtgcagtgaggaagctgaagagccttaggattatcactgttagctggtggcagatcatgaggtcaggagatcgagaccatcctagctaacacagtgaaactccgtctctactaaaaaatagaaaaaatttccctgggcatggtggcaggcgcctgtagtcccagctatttgggaggctgaatggtgtgaacccgggaggcggagcttgcagtgagccaagatcgtgccactgcactccagcctgggtgacagagtgagactccgtctcaaaaaaaaaaaaaaaaaaaaaaaaactccagattttttcttctgcttctgttgagaaaaatcagatcgggacccactgggacccagtggcaacagtctacagctgctgggtggtgcctgccccatgcacagggtatgaactcttttcctcccagttctgaaccataagctgcttcactcattgacttgggcacttgagtttgtgaccaccaacaaacagtgccttttagggaaattttcaagtatactggctttggggtcagacaaatctggtttagaatcgtggttctctcacttatgtggctgctggatctttgggcaactctttcttcttttcttttctttgtattttattttattttattttattttatttccctcccttccctcccttccttccctctctccctccctccctccttttttccttccttccttttttttttttttttcaggctatggctattgcccaggctagagttcagtggtgcacaatcctggctcactgcagcctccaccaccagggcccaagcaatcctcctgccttagcctcctgaatggcccggtctataggtgcataccaccacaccaggctaatttttttttttttgagacggagtctcactctgtcacccaggctggagtgcaatggcgcgatctttgctcactgcaacctctgccacccgggttcaagcaattctcctgcctcagctcctgagtagctgggattacaggcgcccgccaccacgcccggctaatttttgtatttttagtagagacgaggtttcaccatcttggccaggctggtcttgaactcctgaccttgtgatctacctgccagggccttccaaagtgctgggattacggacgtgagccaccacgcctggcccaggctaattttttgaaattttaatagaggcagggtcttgctgtattgcccaggttgctctcacattcctagccttaagccatcctcctatctcggcctcacaaagtgctgggattacaggtgtaagccactgtgcctggttttgggcaagtttcttgtcctgactgtgtcttgggttctcacctgttgattggggatacccttgttgcctacctccaagtaattttatgaggatgaaactcatagcttgtcagtgggaagtgcttaggtaatgagctactagtggtggcagtggctgtgatggtggtattaataccactcctactggatggtctctaatactatctccttccttccctaccagcaacatgtcatggtttagtggcctcctggtccctaaagtggatgaacggaaaacagcctggggtgaacgcaatgggcagaagcgttcgcggcgccgtggcactcgggcaggtggcttctgcacgccccgctatatgagctgcctccgggatgcagagccacccagccccacccctgcggcccccctcggtgcccctggcaggatgacgccttcatccggaggggcggcccaggcaagggcaaggagctggggctgcgggcagtggccctgggcttcgaggataccgaggtgacaacgacagcgggcgggacggctgaggtggcgcccgacgcggtgcccaggagtgggcgatcctgctggcgccgtctggtgcaggtgttccagtcgaagcagttccgttcggccaagctggagcgcctgtaccagcggtacttcttccagatgaaccagagcagcctgacgctgctgatggcggtgctggtgctgctcacagcggtgctgctggctttccacgccgcacccgcccgccctcagcctgcctatgtggcactgttggcctgtgccgccgccctgttcgtggggctcatggtggtgtgtaaccggcatagcttccgccaggactccatgtgggtggtgagctacgtggtgctgggcatcctggcggcagtgcaggtcgggggcgctctcgcagcagacccgcgcagcccctctgcgggcctctggtgccctgtgttctttgtctacatcgcctacacgctcctccccatccgcatgcgggctgccgtcctcagcggcctgggcctctccaccttgcatttgatcttggcctggcaacttaaccgtggtgatgccttcctctggaagcaggtaggtggccagggaggtagggatggagggcagcaggtggggaatttctcacctcataagcaggtgggggcttagtgaggaagggcgggtgagtcatgggtggaagctgggtgcagggatgtctggctgtatctgggaggaggagcaggaggtgggaggctagggttgaggggtctgcctccatgtgggatctggggtagaggacactgctgaggggagggagggccccaggacccaagcctgaactctgtcaccatgggccccagtctccggctctttagcccgctgaaatagtgcagtctgtagagacagaatgtggggctggaggcaggggtgtggtatatagccccagggccaccgtggggctgaaaaggcagtgcaggctgtgtccaggccttagcatctcagcaggcaagttgacaccagagactgaggcgctggtgctatccctgaagagcagctctaggtggtgatctggaggtatagagcaggttttggatgttgtcagcaagagaggagtcccctctttcctggaccaaggccacttctgggaggacagggaaggtgaagagctggggtcagttctctctgggctggatgtggtttgaatggggttggactgttgaagagaggagcgttaagtctgatcgtatcccaccttccccatgctgggcaccagggacctgggcgcctttccttgaggttctctgtccatgcctgttgctgcctccaggctccaagtgtgtgtgaggtgggactccacggctccgtgtggagtggctgtaggctgacctgcttatccagtgggctgtattcttttctgtgggatcttagacaactagcctcacctctcccagccttagtttcccagtctgcaaagctggaataaaaatagcatctagctcatgttgctgttggggccccaccctttcctagagtggagtagaacccgactgggcagtgttcacacctgggggcagggaggtttggggagtgctggaaggcatggtacccagtgaaggggtttctgggaagtccctttcagagagatgttagtttgtggatctgccatctcctgttacccccctgcccagggagcagaggccagggtccttcaggcgctgctgtaggcacagccccgccatcagcacagcgcctgggtcctccactggaccctaactagagagtgctgtcttgctcaaggttttgaaggcttgtggcctgttgcccaccctgcctcaggcacagagaggaagttgcctggggatcccagggtgagaagctaggttctctggcatgatgcccttctccacccagcctgtgctgcagaacagaacttacctgttttttttgtggtttttttttttttttgagacggagtcttgctctgtcgttaggctggagtggtgcagtggcgcgatctcagctcactgcaacctctgcctcccaggttcaagcgattctcctgcctcggcctcctgagtagctgggactacaggagcgcgccaccatgcccagctaatttttgtatttttagtagagacaagtttcaccatgttggccaggatggtctcgatctcttgacctcatgatccacccgccttggcctcccaaagtgctgggattacaagcgtgagccaccgcacctggccagaatgccagaatgccagaacgtaccttttaaaaagtaactttatagcccgtttgtttgtggagcacgtgcccttagggcactgtcagacatcttaaagggccaggtccttctgccccaaagcttctcttccagggtggctctcaaccagggctttatggctggactgccctcctggggaaggagcttagaggtggtgtctcctttcccccttcctctctggccaggcatgggctgggtgggcatctgttccctgctctcgactggcatggtgcccagagccaggcccagtgcctgactggggaggtgcagtcccagggaggccaggactgtgcccgtctccccaggagtgtctggctacagcttcatgtagtggatctcgataggcacattcttggggcagtggcgaaattcactgctgcccctgtgccagtccttggggccagagctgcccatacaacttcctctgggctgagaaacattccctgtgcccatttgggtatgtgggtttctagacaggtggggtttgtggcctccttcctcgtctacttgggcagccccttcccagatccacccctactcacaatcacaggaaggagactttgtcccctaccgacccactcatttagacatactgaacagtgtcacccagtgacccaggcccagcttggagtctcctccggtcccctggcatccattttttctcatagtcagatagggatgtgtgtgtacagagttatttcagtctcgtcccccttccccttccctccaccgtgactcacattttcctcttgggctcctggggccaggaagggaagttgcctggtttgccccccttcccttctcccccactgggggctattcttagaaacccccaagggagatagtgtgcccctctcttcacccctgctgctgggagggggagctcagcctagttgatcctgggcctgtgagctggactgggaagggaagctaggaggcccatcccagaggctggagctggaaatggctaggggtgagccaggcctccccctcagttttacccaagaggaaactgaggtcccaaagtttaagtgacctgcccaattttgcaggactagttctagttcaagttagagcccagaacctctggcttccaggaagtgcttctgctgtttctctcccttctccttaaaccagagccctgccccatccaactctggggtggagccgcaagctccaggttaattcctgagtttccagaaacactgaggccagcttcccttagacttgctctctagccagtgccgctgatgatgattgggggctgaacattcctagggtggggccctaggcctagggcctggcagggctgagtgtcagagggagttacaccttgaggggtggccaggcatggtggaccccatctccaattaggggacatcctttgtatcagtagaactgatgactctcaagccagggctctgaggttgggcttgagagcttgactcagtagagtgagtaggaatcttggaaacctggaatgcactacaaagtatggaatgcagtagatagatagtaggattaggacacaggatttggaatctgattgtcctgggttcaagtctcacactagccactaacagctgtgtgatcttggggaagttacttggcctctctgtgcctcattcccttacctttaaaatgggatattgttacctatttcacagagttttaagaaatgtgttaggggccaggtgcggtggatcatgcctgtaatccatgcccgtaagcactttgggaagccgaggtgggcggatcacttgaggtcaggagttcaagaccagcctgaccaacatggtgaaaccccgtctctactaaaaaaatatacaaaaattagccagtcatggtggcaggtggctgtaatcccagctactctggaggctgaggcaggagaatcgcttgaactgggaggcggaggttgcagtgagccgagatcaggccactgcactccagtctgggtgacagagcaaggctctgtcaaaaaaaaaaaaaaaaaaaaaaaaaatgtgttattcagtgtatagaagacacctacagaatcctggcatatggtaggcagccaacaaactagctaccataataataatgacaatggtgattattgttactaagttatgtcaagtcagggagaggctttagagatcttctcattcttcctctttgggttatagatgagcaaacccaagagagaggaggtgacttgtcctgggtcactcacaggaggatgtagagctcaggtctcctgggtgctgtccttaaggaggagcacctgcaaaaggagcagcgtttgtcttttgtgtggggtgtttgaggagcaggagatacagggtgctggggctgggccccatgacttatctggccctagttggtcttctgcttccagaagctgtgaaaagatctcatttctagtcatggaggattcaggcagttggctgggatctggggtcctgtgggtaatgggagagatatattgcaggggtggcagtggcttggggacagacagggtgcaggaccctggcttccttcctcagagaacctagcaagttgtgtgaatgtgtgtgtgtgtttaggggggcaggcagaggagatggtcactgtctgcctctgccacctcctgcagctcggtgccaatgtgctgctgttcctctgcaccaacgtcattggcatctgcacacactatccagcagaggtgtctcagcgccaggcctttcaggagacccgcggttacatccaggcccggctccacctgcagcatgagaatcggcagcaggtggggctgctccccgtgaccagggcctgcccccaccttacccccaaataacttgcacattggatctgctgccttgtccagttccgtgcagcacagtgtgatggttcccctgggttgtgcgtcacagaggccctgtgatactggggttttgtcctgtccaagggaaggagggcgtagacaggagcacatctgggggctcaatggagggtggtcagagggggctctgatgggggaaggtcaggccacagtccagaagggaaggtcaggtcttcagagaagtctaggagggctctggcgatgtggagagaccaggagggattgcaatgtgagaccaagagtatagtgatgccctattggaaccactgggctaggagcggctgctgctgtcggtattgccccagcacgttgccatggagatgaaagaagacatcaacacaaaaaaagaagacatgatgttccacaagatctacatacagaagcatgacaatgtcaggtagggtgagggtaggaggatgcccagcagggcggggggtctggaagtctttgagggctatgtgttctgttcatcctctgctgtcatctacagcatcctgtttgcagacattgagggcttcaccagcctggcatcccagtgcactgcgcaggagctggtcatgaccctgaatgagctctttgcccggtttgacaagctggctgcggtgagggtgctgggccttgggattgggcctgggtgttgaccgtggtgagagcatagctttgctggcagcagctggggatttgagggcagatagagtatgcgtggagggtggtgggccatgcaggctgggtgggcaagagagtaaaggttacccttccctccaattccttcccattcaggagaatcactgcctgaggatcaagatcttgggggactgttactactgtgtgtcagggctgccggaggcccgggccgaccatgcccactgctgtgtggagatgggggtagacatgattgaggccatctcgtaagcagtgccccattcctaggcttcctggaattgcgggtgccccagactgctcctactttttgatgagacctcaggagatttcctcagttttggctttctctgtctttgaggtctgtctgtcactgggaaggggaatctttctccaacctgtgcaaagacccatgcggacccctagactcccagccagccgagatggggccgggagagcctatgcagtaggggagttgggctagagggaatgccatctgtgcaggccagaggggataacagtgattcctcttctcctagctcagttccataagatgctgctgggcccctgctgttgaacacagccttaacatttgtccttgagccccatgcagccttctgctcatgtccaaccaaggctgtgctcccgtcccctgcatctgggtctgtccttgcccgctgggccctgagaggagtgaagggcctgggttgtgggctgggggaggggaagactgccaggagctgatctggggctgcatcctcccaggctggtacgtgaggtgacaggtgtgaatgtgaacatgcgcgtgggcatccacagcgggcgcgtgcactgcggcgtccttggcttgcggaaatggcagttcgatgtgtggtccaatgatgtgaccctggccaaccacatggaggcaggaggccgggctgggtgagtaggggggtccaggtgggggggatgggggcaaggtgggagagccagggtctcaccctcttggccacatacagccgcatccacatcactcgggcaacactgcagtacctgaacggggactacgaggtggagccaggccgtggtggcgagcgcaacgcgtacctcaaggagcagcacattgagactttcctcatcctgggcgccagccagaaacgggtcagggccagggcagggctgggggcaggggagcaagaagagggacaaatggggaggagcaggccaaggcctcctctgggcccctcttctgagcctgtacccatgctgcccgcacagaaagaggagaaggccatgctggccaagctgcagcggactcgggccaactccatggaagggctgatgccgcgctgggttcctgatcgtgccttctcccggaccaaggactccaaggccttccgccagatggtgaggggccctcagcaccagacctagggcctcattttcttagctccctcaataccctgtccctgaccctgtcctttcttgtgactgccatttccatgtatgctttctggtattggggcagtgagaagatttcatctcgggtcccagtgcccccagaggatatgacggggacaccctcagcacagtgttggggtgggggaaggagctgcagagatgaaggttgttggcccttcacctcactccacactctgtccctttctccagggcattgatgattccagcaaagacaagtaagtcaggttactgaggagggagaaggcacttgcaccctgggatggggctggggggagccgagatcctccttttccctgaccttaggagtgttgtgtgggagcaggagccacccccctggctctccctccctccctcaggtgctgtccatacctttcctttcattgtttctcacatggccatgcccatgcaactggtgaaaccatgtctcctgccctcagccggggcacccaagatgccctgaaccctgaggatgaggtggatgagttcctgagccgtgccatcgatgcccgcagcattgatcagctgcggaaggaccatgtgcgccggtttctgctcaccttccagagagaggatcttgagaagaaggtttgagggatacagggcagaaggacaagggctgggggaggggcaggtcgcagcagggaaggctgagcacaggtgagggcacaggtgtttctgggggatggagaagggaccacagagcagggtgaggatttcatcagttgagccaactgcatctcctccctgttgagacccctggtagtgccctgtccttgctgtccctgccttccttagggagggcccagcactcagctcagcctcctctccctcagtactcccggaaggtggatccccgcttcggagcctacgttgcctgtgccctgttggtcttctgcttcatctgcttcatccagcttctcatcttcccacagtgagagccctgcctttcctctcttagcttctctcttcaccacttcccagaagcttcctaaatacccacacaagcccacaatccctggagcctgcatccctgcttgttccagagggtgggacaagaatgcccagatcttccagaattaaatgatttttctggccctgttctgccccagctccaccctgatgcttgggatctatgccagcatcttcctgctgctgctaatcaccgtgctgatctgtgctgtgtactcctgtggttctgtacgtaaggggatttctgaggctgttggggagggcaggctggactccagacagggaggaggtcacatggggagagggagaaggccatgcctcttccactgggccccatccctggttgccattcctccttggctgatacaaccttcaactcttggtctcttgatgcctctagctgttccctaaggccctgcaacgtctgtcccgcagcattgtccgctcacgggcacatagcaccgcagttggcatcttttccgtcctgcttgtgtttacttctgccattgccaacatggtaagggtccagtgggaattctcccacctctgctctgtgccaagcactgtcctggacactgggagtacagcggagaaaaggacatattttctgccctcagggagccccctcccagaataggggaaggttaactccggttctccttccttgttctcccaacctcttgtcatccctgagtgagtactaaggcccatggggtataaggtacctgggcatagcccaggttagggtacatggcttcaccaggtaccttgcaaccctttccctccttggttaccctgatatacccctccacttttgcagttcacctgtaaccacacccccatacggagctgtgcagcccggatgctgaatttaacacctgctgacatcactgcctgccacctgcagcagctcaattactctctgggcctggatgctcccctgtgtgagggcaccatgcccacctgcagctttcctgaggtgttcgagcagtgctcaggcggtgggggggctgtcctggcacagacattggcccttctgtgccaggcctggtgatgggcgctggggacccaggaactcaccagagtctcccacactaggagcaaccaggggccctggtgtgttgtaggggctgggcatggaaggtggaggatatgggggtttgaggggtgtggtgggaaggttaggtcaggcaggagagtgcagggctctccctgcccaagggtgctgtggcctctgccttcacccaacgctgcctctgccacccccgcagtacttcatcgggaacatgctgctgagtctcttggccagctctgtcttcctgcacatcagcagcatcgggaagttggccatgatctttgtcttggggctcatctatttggtgctgcttctgctgggtcccccagccaccatctttgacaactatgacctactgcttggcgtccatggcttgtgagtttattctcaggtcctttaataccccaggagcttccctcacctttctaggtcactgtgagcctctctggtgcccatgccccttgtgccttggaatgccacaacacccctgtgggggaaagggaggagatggaggagctcccagcatgtgaccccaaatagttacccccaaggaaaccctagtcctgggaaatccttgtgtctttaggctagacattaaaaaaaaaaattccctcttacatttgcatggtgctttcacatccaccatcttaaccacctataggacatacagctgcttggtggcagggctctggttaggaaccaaagcttctgattcctgcttgggggctttgcctgggacaccacactggcttttcctctgcaaaaccccattcctttgatatgtggccatagcttgttgtagtagaaaaagcctctggtctctgctgggtttgaatccctgctctgctgctcattagctgtgtgactttagacaggtgagttagcttctctgagcctcaatttcttcatctgtaaaatggcaatgtcacctaaatcacagggtagttgtaaagattatagtaactaacatttatggaaggctgactatatggcaggcactgtgctaagccttttacatacattatttagatctgatccctgttgtactgatgaggaaggaggcttagagagttaagcgacttgtctcaggtcacatagctggtaagtagaggagtctctaagagcagaggttttcttaacctctactcttaatgagttaattaatgtaagtaaaagccctggcccaatgcctgacttacagtatgtgctcagtaaatgcagtctcttgtctccccttccatgtgcccacccagcaatccaggaagcactgatgactttgtctcttctatcttcttaccagggcttcttccaatgagacctttgatgggctggactggtaagtgagggctccgaggcagcaaagggtagagccattagatgcctccttcagacaccaagcatgtctctgcttatccttagtccagctgcagggagggtggccctcaaatatatgacccctgtgattctgctggtgtttgcgctggcgctgtatctgcatgctcagcaggtggagtcgactgcccgcctagacttcctctggaaactacaggtgactgtgtgggcctttgggggaagaggaggaacctaggggcggagcctgggccaggccagaaatgtatcttgtgctagctggctaaggctcaggccacacctaggcccaccctggttccattccttctctgtgcccatcccttactccctgccccatcctctacctgccccctttacccctttgcctgttctttaggcctcatctgtctgggcctttctttctctatgtgattccctcttatccgcacttccaagccttggccaccacacctaccccttgtgaatgtcgggcaatgggtgatgggtgtggtgtccacaggcaacaggggagaaggaggagatggaggagctacaggcatacaaccggaggctgctgcataacattctgcccaaggacgtggcggcccacttcctggcccgggagcgccgcaatgatgaactctactatcagtcgtgtgagtgtgtggctgttatgtttgcctccattgccaacttctctgagttctatgtggagctggaggcaaacaatgagggtgtcgagtgcctgcggctgctcaacgagatcatcgctgactttgatgaggtacttttccagttggctggtggtggcagagagtggggggtacttggagaccagggattggaatgggtgagtggaactgggaagagagagagagatttgatgggacccagagtcatcaggggtaagggtatgcacagtggaggcagaggcaagaacccatgaaggtgtcagaggcagcaagggggtcagccctagtggggcagggtcatcactgttggggagcaggggaggacttgatctgtagggggataggataggtaccaggtggatgtcactgaagaagaaggcaatagtctgtggacagaacctcatgagaccaaccaagcaagatggtcctctgaatagagaaaattgaagcaaaatgtgaggtagtgtcctgaacatccagatcaggaatgggctgttcactgttctggagggaagtcacttgctcactctgggactcagtatcccaaaaggtaaggattggagaaattgcttaatattgcacttgtgggtctgtgttctgtgagtgagctactggagggaccttctgaagctgtatgcccaagtcctgcctggagtcctaggctgcctgttttcccagctcctcagtcttacactgatagcagcagctggaagggggctcttgagacagggaagtggggaaggcagccaaggcgtggcaagaaatgagtgttggggcagggctgggtctggggtctttgccttgacagccaggtctccttgtgttgttcagattatcagcgaggagcggttccggcagctggaaaagatcaagacgattggtagcacctacatggctgcctcagggctgaacgccagcacctacgatcaggtgggccgctcccacatcactgccctggctgactacgccatgcggctcatggagcagatgaagcacatcaatgagcactccttcaacaatttccagatgaagattggtaagagggctttgttgcttggcgggttttcccaggactttttccaggtgaagctgggattataggctggggatgggatcacagatttcccatcagggctcctgtggggttttcttccctctgacctcctatatcaagtctgatattaagaacagagatcattaggcactgtcctataaatttttgagcatattttaatcctgatactattatcgcctttcattggatagagactgactctcagagagattaaataacttgcccaaggtcaaacaactagtaagtggcagagctgggattaaaaatcaggtttatataaacttgaatacttctgtccttatctgtgaccagtccaataagaggtatttcctctcaaatgaactggtggatgggagtggttaatagcatggctactagagatggactatttggtttgaattctggctgctccatttactggcttatttgagaagtcttctaacttctctaagcttcagttaccttatctataaaatggggataataatacctaccttttagaggtgttgaaaggatgaagccatgccgggcgcggtggatcatgcctgtaatcccagcactttgggaagccgaggtgggcagatcatgaggtcgggagttcaagaccagcctgaccaacatagtgaaaccccttttctactgaaaaaaaaaaaaaaaaaaaaattaggccgggcgcagtggctcacgcctgtaatcccagcactttgggagtccgaggcaggcggatcacgaggtcaagagatcaagaccatcctgactaacacggtgaaattccgtctctactaaaaatacaaaaaattagccgggtgtggtggtgggcgcctatagtcccagctactcgggaggctgaggcaggagaatggtgtgaacccgggaggcggagcttgcagtgagccgagatggtgccactgcactccagcctgggtgacagagcgagactctgtcccccccaaaaaaaaaaaaaaaacaaaaattagttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaatttttgtattttttttttgtaaagatagggtttcaccatgttggccaggctcgtcttgaactagattgttctttacaaccaggagacttgtcctttttccatttttttctctgggtccttctaccagtgccaggaggtgggatgactccctgggtttaccctggagcatccactagtctcttgctgttctctccacctcagggctgaacatgggcccagtcgtggcaggtgtcatcggggctcggaagccacagtatgacatctgggggaacacagtgaatgtctctagtcgtatggacagcacgggggtccccgaccgaatccaggtgagggggatatgagcaggggctgggaggaacatgggcccggagggcttccacaggtgtctctgcagtctgctaggacaggggtagggtggctagtgttctgtgtatggtggggcagggactgggggaagggagctagcctgactagagaacccctgggcccctgcaaatgcagcaggaaggattccaggctaagcgggctcccctcccactcccccaggtgaccacggacctgtaccaggttctagctgccaagggctaccagctggagtgtcgaggggtggtcaaggtgaagggcaagggggagatgaccacctacttcctcaatgggggccccagcagttaacagggcccagccacaaattcagctgaagggaccaaggtgggcattgagtggactctgtgctcactgggtggagctgtggcagggggcactgagcctccagaccctgctaaccacaaaagggaacatcccagcaggctgtgcttggatcatgctcgtctgccctcaagctggaaaacaaggggctacctaccgagaggattatgcaagtgactttctttcttacttggggtagggctgttccctctccaatcttccagcctttgggagcaggggaggggtcagtagcagaagcagagggaggcctcttgcctgagggattaaaatggcagcttgccatgcctacccttccctgtctgtctgggcagcaggttcagggctgagcccttcttttccctcttttttcctgggaatattttgtacaatattttgtacaaagacaggcatgaggagtgcctattccatgcttgcctttgcaatacctgcatccccagcactggtcctgggcacttccccaccccagccaggtgtccctcctatgcacagagcagaggagggagaagctctggggagccagctttggccatatttcaggagaatgtttccatgtgccaaatcttagtcccatgatctgtccccaaaggggaacaaagggacctctgacagcttagatttagccccagttcctgcacgctccagggaacggggtgtctggcctcactggtactgtgaaaaatgctcagagagcaagcctgtgtgtggggatgtcaggtcaggagctggaagttcacctgcaggtgccaaagagcaggccggccagggctggggcagtgccagactctgatctgaggaccccgtcggggtccagatcaggtcactctgccccagtgctctcttgctgtctgctgacaagggggcatggagcatctcttcctcttctgttgccaaatagaaaagggtcagggcatggagaaaggtgaccctgatcccaaacctgccctcccaagtctctggtgttggggagggcccgtgtgtttgtgtaactgtgtgtgcatgttggtctttgtgtgcatatctgttttccaggtctatgtgagtccttgtgctcctgctcctcagctctccaccccaggttgcctctctcctgtgggcctctgtcttctgggaataaagcagggtttcctacttcaggggatgtagagagatgcccaggttgcacaggagtgggatggggtgtggtagcaaaaggagggagaggagtcctttttgtgccaaatccctaagtgccgttcgggggccatgtgtgcagcatgactctccctgtctgtggcagggacccaagcgcttgcttaagccccagtgctccatgccagcacttgaactgtctggggtttgatggacagaggctgaggaatttcctggcttccccagatagtgtcctgggacatggtatgctttggggctggggtagcatggaatccctctgaggacctggatactggtactacggggtggggaagaggaaccttaaacttggctttccccagccttcagcctgagtctagcatgtttctagctccccagtcccttgtgaagccttgagggctggcagaagggttaggaggttgaactctagattcccttcctgtctttgccttccttttacccctttccctgcaacctccttgactctggcctgaatttgttggtgcctcagtttctctgtctgtacctatttaagccaaaggcactagcctgaattttgcttgaagatcactttgtcttggaaatgactagagaggcagaggagaagggtttccagagttgctaggtttgggagtggaaggggcaggcagtgcacttgcccctcctcatgccccttctgacaccagctccctgtggaggcctggtttctgggtaatgcctcccttgggcatcttcatgcatcaaccaaatgggccatcaggtacttcattagtcatggcagaaggaggggaaaagacttgttttccagacagaaaatctactcccctgtccccagccatatccctggataggaagggataggaagagactacttggtgccatggggtaggggtgagggtataagtagatcagagtgggaagacctcagccttgggtggcttgtctctgcttcttgccaggtgggagggcctgtccacaccctggatccccgtaccacagtgccagccatgcccttcccctgggctaccattgtccctttcctcacccagttggtagaggagtcaggaggtgggaggccgtgggctttggttttataatgtaaccactgtgggggtgggggaggatggtgaaccatgtatttcagtgaaatatttaatatatttaaatatcaataaaatcaaactctttgtaaaattctctgttctctgtagctgttctgggccctgggtgggtcagaagtgacagagcctggtgtaggaggcgacctcctgccccagggctccgtgggcctcttgtctgtggtcagaggacttcctgtggctttctccctgctaaggagaagctgcagtatcttcagagtgtgactactcaaggcctttcagcatcatgagctccagtgtgtgccttcccagatttgtgtgtgacccctgccatgcatgaagccggcggttctttccagtgccttggcccctcacagacctctcactccaaggtctggcttattcaggaatctcccacacagcagctctcacaacaatctggacactggaatcactcccatcctgaccccacagctccccccgtgcacacaagcaacttttagtccagtctgtttactgtgctttctccatctcctcctcccattagtcagccatcggaactgggaaacctccttctttccccctctgcactcttgccacaattcatcttgtctttctgcagccatatcttcttaatacagactgaaggtcctgtcattgagaatagagtgatccataaacctggaaagaagagattcagagagagattcagccaggccaggctggagagcaggagatccttaaaaatagctcccaagaggctgggcgcggtggctcacgcctgtaatcccagcactttgggaggccctggcgggtggatcacaaggttaggagttcaagaccagcctggccaagatggtgaaacctcgtctctactaaaaatacaaaaattagccggtcacggtggcgggtgcctgtaatcccagctactcgggagctaatgcaggagaattgcttgaacctgggtggcagaggctactgccaatggatggtgatttgaggggtggagaggtagcgacgaaggcagcattgggctgccacaggattactatggacacttgttttgcactagctcagaagtcacacccacaaagaggaacacaaagacacagacaaatctctaactcctttgaatgtcatcacggcccaaattctggggccagttttctctggtaagactcaaatctctcctaattccctaactgaccggagatgaaataatctctaagaattaaagtgaagggaaggagtacttcccttgacctccccacccttacccctcccagcctaacctggtcatcgcgctttttatgagacaatggcgtgggctccggatccatggcatggtttcctctggacgcactcctggatcatgggaccaccagaagctgaagttctgagcatcagtcaaggggattctgaagacctgattgggaactgaatgggtggggggaagggcaggttatctaattccttcaagttctctgctcactgttctgcctcagggcagcaatagcccagcccagcccagcaactgcttggccggaccaggtgctgagaggtcctgggagtgtggtcaccacaccctgcttcacttccggattctagcatctcacacccttcatggtcaaatgaatcagtcttggttcttcctgctgctagtaagcccatctccaagagagctttccccaagtgctaagatggtagaaaaacaagtggtcaacccacttgggaaatgtgtaagatggggtccactgatctattatttttctttcttcttggcttaatcatcctcattctcttccctcctcttggaaaaaatggcttcctttgctcactccaagtaattctctgaaacctaactaataccacctcacatttagatgctattaatagatgtaatttatctagtgcctattatgttctaaatgtggtattaaatattcttaaatttttgtaataatatcagactttgatgctgtttgaaaaagtacttttgggctgggcacggtggctcacgcctgtaattccagcactttgggaggccgaggcaggcagatcacctgaggtcgggagttcgagaccagcctg

SEQ ID NO: 14627 - DNA, 21914 bp, Human; identical to SEQ ID NO: 14626
  misc_feature (1)...(21914): n = A,T,C or G

SEQ ID NO: 14628 - DNA, 91933 bp, Human; identical to SEQ ID NO: 11855
  misc_feature (1)...(91933): n = A,T,C or G

SEQ ID NO: 14629 - DNA, 7702 bp, Human
gtgggcggatcacgaggtcaggattttgagaccagcctggccaacatagtgaaaccccttctctactgaaaatacaaaaaattagccaggtggtagttgcaggcacctctaatcccagctacccaagaggctcaggcaggagaatctcttgaacccgggaggtggaggttgcggtgagccaagaccatgccactgcactccagcctgggcaacagagtgagactgtctctaaataaataaataaataaaggagaggccagactgggcacagtggctcacgcttacaatcagcactgtgggaggctgaggcaagaggattgcttgagccccaggggtttgagaccagcctgagcaacatgggagaccccatttctaccaaaaaaaaaaaaaggcatggtggtgtgtgcctgtggttccagctactagggagactgaggcagcaggatcatgtgagcccaggaaatcgaggctgcagtgagctgttaccatgtcacttcactgaagcctggacaactgagcaagactctatctcaaaaaaaaaaggctggccgggtgcaatggctcactcctgtaatcccagcactttgggaggacaaggcgggtggatcacctgaggtcagaagttggagaccagcctggccaaaatggcaaaaccccatctctactaaaaaaaaatatatataaaaattagcagggcgtggtggcgcacgcctgtaatcccagctacttgggaggctgaggcaggagaatcgcttgaacttgggaggcagaggttgcagtgagccgagatcgcgccactgcactccagcctgggcgacagcaagactccgtctcaaaaacaaaaacaaaaacaaaaaccctgatctttcacttcgggcctgacagcagcttgactggaagtttgctcccgcagttctgagattctggccttttcttttgtcccattggtactttttgctgccagggtttcctgtccttcaggtttccatccccaatcagttgagagtccgactggagtacccaaggtgcgttgaggaatgaggcacagccctgggcttaactcatccagcctggccagctcagccttcccctgtcaggtgggagcctaggattgctgtcagcccagggagcagagttggaagaagggggcagggccctacctaggctgcggcccatcggggcagcctgcgctggtggcttcggaaggccctggtttgaggatgggtgcggcaggaacagcctgaagatagtggatggagaaggtacctgaggtgttgggagctctgctggtgagctgggcccttcacgtcaatgttagaggttgttacgtgctaggcgctgttcaagcactgggaattagctaaacaaaatgaccattactgtcatggagctcacccctagttgagaaaaataagccgaatcacacggcaagtgctaggaaatataagcagggatagtgagggagttattttacctaagtttgaagggaaagccctctgataaggcgacatttgagcaaaggcccggaagaaatgagatacgtctcgcccagtcgcaccctgtctctacctgacaagtctccggcccgcggactgagtgggggacctgggcggccgccatcccccacttcctcattgttccacggccctggatcgccttcttttctcggtcctcccgaggaccggatgcttctcctctccctggcgtgtgtggaagagatggacgctacgctagagcacatcgcacgggcggtcccattaaaaatcagatgggggagagaagcgagcccaagtcaaccgaggggagcggggagcggaaagggaggagccgtcgggggcgggacagacaccctgcccaccggaggggcgcgccaccgccgcccccgctccactccgccagggggcgctgtgtggctcccgagtaggctcagagcgaccgtggccgggcggaagcggctttctggcctaagctttaacaggcttcgcctgtgcttcctgtttcctcttttaccaaggacccgccaacatggtaggtgttttggctcgaggccgccatcctccacaatcgtcccccatctgcagcttcccgcggtcctcagcccacagagaggccctgggccgggaaggcgcagagccctgtcaggctggagcgcaacgggccggcggcttccgcattaagcccggcgcccggcactgtttagccgggccctctccggctcagcgcagccggcggtccccaaccacaccggccggggctcggcgccgcactcttcccagaaggttgcgctggctcgtgagtgatcctgtcctctccacccgcagggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcagggtgagtcgggccttcctcggcctccggggctccgcgatctgtttgtgtgctctgccgccctccgactcgggaagagacggtgccttggtggtttcgttagcctgagactccctggtgtcccggagaagggctagagctctgcgtgtgcaggatttctgttgtgaacttaggcctgtgtcatgactggccgcggtgaccctgggtcgaaggtagccaccgtcagacctcttgctttgaagctacgttgcttttagttgtcaacttttttctttcttttttttcttttttttttgagacggaatcttgccctggcgcccaggctagagtgcagtggcgccatctcggctcactgcaacctccgtctcccgggttcaagcgattgtcatgcctcagccttcccagtagctgggattagaggcacgtgctaccacactcggctaatttttgtatttttagtagacaacagggtttcacaatgttgaccaggctggtctcgaacacctgacctcaagcgatccgcccgcctcggcctcccaaattgctgggattacaggcgtgagccacctcgcccggctggatgtcaacttctaatgcttacttcacagttgcagttactgttcgagagatttataggcatatggcctggaagaatagtgccaaagtcaacgtattaattgccaagttatgtgaatttgaaattggaagaaaatgaaggctgtgaagggtcgtgaaactgcggggcggggcggggcgagtggggggtggggcgcttgatcatcatgaaggagagtttgaatagagagtgagaaaccaaggggaaggaatgctcaggccagtggaggttctatgtgtaggaggtcccaggatagtgagtcctcttccttctcactgtggaaaagaactaaagcgggtatttatatatccacatgtgctcagtaccaggtgggagttgatttgtcttctcactgttctctttggctgtgtgtgctttgtagttacgtcacgcatctgatgaagcgaattcagagaggcccagtaagaggtatctccatcaagctgcaggaggaggagagagaaaggagagacaattatgttcctgaggtaaactttctggatatttgggcttctggctaatcctcaaatgataaagctatgggttcttggcttccaaagggacctcagctgaatctgagacctttaatccatacattccataaccagctgtgggtgcccataggccccctaccagtttcttagcctccattctgctcttctggaaccagttaagtctattccatatttcatgagagcccttaatgttgatttgatgactgctgtcgtggctcgattgtttgcccctaatatagtattctttggtgtaaacacagacttcaagtgttctgaatactgaatgagggcatgggaaggtaaggccagaagaacaggtcatcggggtctgtaatactgtaagagactgctcaccttgtgagaggaatgctatccttgtgcagctcctcttccccatatttaagaacctggggagaggaggaggagaggtgagtgataatctcattgattggtattttgaccctacctcgtttccttgtaggtctcagccttggatcaggagattattgaagtagatcctgacactaaggaaatgctgaagcttttggtaagtgtttgctggattcctaaagtggtattttcctggtcaaaaaccatcagtaggtcttattatccaaggtcacccagctagtaagtggcagagttgggaatcccatctaaacttgtagccactaaactggactgctttcataaggggtgtagcggaagttgtgtgcattgagttagttcgccacaagatcatgattcccaaatctagtggcttccaggacaccttttctctcttggctgcttctgttcttggttttatagctggcttacgttgccccctttgtgtcagccctggctgaatctgcctgcttttcttctgtgaaggcattcctttggtgtctccatgctaaccactcagaaatgagctttggtccatttccaggtacatacaaggcactacttaggtagttcacgagtatcttcattgcactttgatgttttttctatggcttatcttagtccttttgcatacttgggtgaaagcatgggcttcatgggcggttggtgattttgaacaacttcatttttcctatttttatggtcattaaatgtttaagacactcaaaaaggtagtagcaaaatgaactcacatgtactttcccagcttcagaaaaacatcaccagtacagctacagccccgctgtgggtcttttcttcctgaaataaccactgcgctgaatgcagcatttttgttgaaactaaaatgggtttctgaggaccaaataggacatggagttccaggtataagttgggcccttggcttcttgccctgcctaccagcctgaacttgtttgagggcagggtctgctcttgcctccctcccttctgcttgatgccttgtgtacttgggcccttcacaaatgttgattagattagtaatagctcttacccagggctggtcctggaaagcaagtggcactgtgtattctcaaagggacagagttttgctttagaggacatttggcaatgtccagacacatttttcgttctcatagccaggggatacctgctaacttctaaggggtagaggccaaggatgttgctaaactttctgcaatacacagtacagctgcctataacaaagaatgtccagcccaggatgtctacgttgccaagattgagaaacggtgttttagagtgattgataggaaggggttgtgaaaacagatacaaatggcatggtacattgggtaaaagtcatagagttgtaaatggggataccacatggtcaggtgtgtgttgaaggaagatcactctggaaaagtgggaggcattgagaaccctgttggctcttaaagggtccttcaggtcgcctctggacccccttgagagtgctgtggctctaggggcctgtgttttcttctggggtccactcacagatctcaccagtaactgctcactgaatccattttctcgttccaggacttcggcagtctgtccaaccttcaggtcactcagcctacagttgggatgaatttcaaaacgcctcggggacctgtttgaattttttctgtagtgctgtattattttcaataaatctgggacaacagccttgcctgtgtcatctttgcagttgtgtgtgggtagaggaaaggcaggagctctcgaggcaacagatcagctggcacttgtctgggattcaggtgctgctgcatctggtttatggggagtgggttcaccagagtttagtaaaggagcaagggcaagcctgaacgtgttgagagtggtctgcagtatgagcctggaaagctgctttggcagctccaccctgcttccctgggtcttcagcccctgctgggtacatacaatttgggccaacttgcccatgttcagaaggtagcaacaggattatcgtgtatcagaggttgactttctttcagtgggagttaggatgaatggtgtctttgtgtccaatgttgagcccaatgcctagaacataggagatctcaacaaatgtgaataaatgtgtatgggaggattgatactgggatgcttcagcctaaccggaggcagagctcaccagctgcaacctgggtagactaccctggactctgagctttatttaggctctctgtcgctgtcagttaaccacgtgtgtgtgtgtctcacaggagctgggctgcacttggttggttcatgcccttgcatatgaggaaagctgtgggctctttttctccagtgggacaaggagctgttgcagagccaagcttagctggctgcatgtccaggagaacaggcaggcatggtggctcacacctgtaatcccagtacttcaggagactgaggtgggagggattgcttgagcctgagggttggagaccagcctgggcaataccaagacctcctctctactaaaaaggtagaaaataagctgggcatggtgatgtgcatgtgtagtccagctacacatgcttaggcggtcagagggctgcctaagccttggaggtggaggttgcgatgagccgagatcatgccactgcactacaatctaggcgacgaagtgtgaccctgtctccaaaaaaaaagcagccagcaagtgggaaagctctagccttaaagtgattcttacatatctatttctgtcaagcagataaatacagcagacatttttaatgtgttttgtaacttaatttttgtataatttcaaacttacagagaagttgcaagaatagtacaaagaacacccaggtttaccagttcacattttgcctcaatggctttatttttttgcggggggggagatgaagtctcactctgtcacccaggctggagtgcagtggcacaatcttggctcactgcaacctccatctcccaagttcaagtgattgtcctgcctcagcctcctgagtagctgggattacagacgctcaccgccacacaaagctaattttttttttcttttttgagacagagtttcgctcttgtggcccaggctggagtgcaatggcaggatcttggctcactgcaacctccaccttccaggttcaggtgattctcctgtctcagcctcccaagtagctgggattacaggcatgcaccaccacgcctggctaattttgtattattagtagagagggtttctccatgttggtcaggctggtcttgaactcccgacctcaggtgatccacctgcatcagcctcccaaagtgctgggattataggtgtgagccactgcaccaggccatatattctttatatatatatatatatatatacacacacacacaactttttatattcaagaaagtctattacatttattctttattttaacgatttatttttttttaattattgttatactttaagttctagggtacatgtgcacaacgtgcaggtttgttacatatgtatacatgtgccatgttggtgtgctccacctgttaacttatcatttatattaggtctatctcctaatgctatccctcctgcaaccccatgacaggccccggtgtgcgatgttccccatcctgtgtcccaagtgttctcattgttcagttcccacctatgagtgagaacatgcggtgtttggttttctgtccttgtgacag

SEQ ID NO: 14630 - DNA, 23535 bp, Human
ttgtgtcctggctccttagatagtattatcaagactttccctgggtctgggctgtgcccattgctgcctctggaacaagtcagcctaatacaggaaaacttacttctctttttaattttttctttaacttcccacctcaataggacttgcaaaacatattatcctgagacaaaagggcaggacttttgtgtagcactttgtcctcacttcacttgaacttcacaataactttgtgagaaaggtcttattcccctttagagagatggaagaaaatgatatccaatatccagtgtgggagaggactgtaactctcttcctggagtgcatcttattgacagagatcaaaacctagaaattcctctgcaaaggaattcagtgaaaaaaagaaatcataagcacgtacacagatttatctacaagattgtacactgcaataggaaagaagtgaaagcaagctaactccagcaagaggattggtacatccatgctatgaaaagacatgcactgattgccaaataatgttgcagcatgaaccgttcaagaaatgaaaagcgtcctacatgaaaaaaatacactgagtgcatgacaggagttttctagtccacaacatacttaggttcccagttgcaaatcaataaagtgacactctggtttatgtatcaaaagaaaagaaaaagaaatgaaaagcaaaaaaagggtttacattttatgaagtgaacagagcagaccacaaaacagaatatacaatatgattctattgtgtgtgtatgtaatttttttgtgggcttttctgtatttccgaaaattctaatataaaggaatactgcttttgtaataagatttttaaaagaaggtcctcagtggttaagtacttgtctgtggtcagagataactggcaaagaagaggccaaattttttttgagactgcagtctccggtgtaaaatgagggtgcaaggtgcatccccgctcctgatttttgaatcatcccttccaccaccttggaatgacttcttacgtagaacagccagcaagtggagaaacttgcctcaataatgcaaaactgtctccctaacttacttcctttcaatgttcaagcaaaacaaagccctctctacatccaacatgacagaaacccaacatgacagaaagtatgagaatggttggaaattgctgaaacagcaacagtaaagatttaatgagctctcaaagtacctctagatgtgcaaatatgacaacccaataaaaagaaacacacacataacctagagccttcaaaaatctagatttctgcctttccacaccttaacttggaatcattcaggtgggttcctaagcattctctcggaggtgaagaatcctccaaagaggagactctaggaggggcccaggtgtggcaatcttcaaaaggatgagggatgtccagaggagaggtggcgggagggcgcacttaaaacacgcgaaaattggaaacgtgccttctgcagtcagttccttcggattttccggcatttagaagccagttctactccttcagcccgactgtatctgcaggtctcacccaagaccaagacccccgcccccacccctcctccacccggcctcgagccccgccccggacgctggacccgagcgtaacgggagcaggtgttcacatcaaaggtctggctcgcgaaggcagagactccatgtgccgcagaaaaaactccacggacaattgggagactcctttcaaaaaaacaaaactccggaaccacgcgactccgcgctcagggggcgtgggtacggcccaccacgagggcagggctcggcgccagctctcggcaaaactaacaatatttgttaggccctaaacaaaaaggccctaacagcgctaaatccattcacttcgggagtgtagcaacctgggacaccaagcgccgcccacgccccagctacgcgcctcagggacacatcgattgaggcgcggctactttcgcgcacgcgccttgcatgcccgtgcttcgcccttacagcagagcgcctaaaaccgctacggtgactctgctggggacaaattattcacgtcccactgttctgcaaacccaatccgggaggtatgacctggctgggacagtttaggaagatggccacgaaggcacctgggggagtagatatatgtatttgagaatgagaggagtaaatcgctggacgaccatgagcaggaagaaaattaggcctccacctcccaaccagtggccctgagttggcaacttagacagcgcgcgccagcgccaggagccccgccttgggggcgtggccgcgcgctggtcggctggggcggggcctgcttctggcctcatctagccccgccccaggcgagggcgccgcacccacaccgcgctgcgcagttttgttctgctccagctgttcgaaggtgatccaggtgagtgctagcacctgcgggcagccacgagcaccgggccgccgggggcacttcagcctttgcgcagggcactcctatatttcagcctatgcgagctgaatagagacccgctgtctctaacctccccccacccttatcagtaaattagcgatctgaatttccaccctctctgctctccccttgccttgcatcttttccctggtggagtgggttgggagcgtctaagcgaggcccgacctatttatgtgtaactcaggaaaattctcaaggtcaacccttcctccattccttcctttcctctcctgctgtccccgggctctgcagtctgggggcacctttctgccttccggagaccacccgaccttgccctctgctgttccggcgcagaggatgagcgagccggacactgccgggggagtggttgtgcaggcctgatcagtaacactggtttcagaagtggcctgtgagcaatgcacccgctgcggtggggatgtgttgctagggacggtcgggagagcctctgaaggaattgtgtttgttttcctcctgcctcttagaatcgtttgtccatttgtactgggaaggtggtcatttcctaccgctgacttagagcaagagacgcctctaggcgggtgggggactcttcaggttcttccttggatttcagaaaatgccccttctttatctggggtggcagcacggagccgtagggctacagtagtggggcagttgcagggcggtggaaggcgctggagactccttagtgagtcattccccgaagttgtggcttctgctgatactttccttgagagtcacgagtttacaagctacataatagcgtcgggggcaagtaagtgtggaagacgaggtaaaggaaaagcagatactaggatgggtagaaggagaggcaggggttagaactttaattccttccctggggacaggagatgccctggaggggaaggcgcttccggctctgcaggtatgtgctgttgggcctaggtgtggtcctgcggaattgctgcagattttagattgctggtgggtaggagctgcagcgcttctcttgggaaatctgtagatcacctggagccagcagttctgggaggcaccccaggttattggtcagagttacaggctatattttatttcagtgaattcagagagcacattgagtcagatcaagaatgtttattctcataggagatgaatttaaggagttaaaactaacatataaaatagaaacaaatactttcatccctgggaagactttccgttaagcttccctcctgacacaatgttacggaaatagaaaactttgtcaagtgattttttttaaccaatgttactatatataaatctgcagggagactgtcgccaactatagaaactgcgctacaggggcctccttagattaaggaacaaaactggagaagggcagccttccgctttatttagatttcttcctgttggcttagagttctgaaaagacacaatcctggaagagatcctcctcgcctggagattagcaccgagaaggaacatacaggaaagaagggctttacccactattcagagaaatgctaaaaagcccctggagcagtctggaatgaggtggatgtcaaatcaatctgtcaaaagcaattcagtgcctactgcacatctatctgtatttaaacatattgtgccctatgtttatacttaaatcttctgaatctatatttagaacaccattaccgaccacaattgaccatgaaccatctagcattttaaagcaatatttgtttcgaagaatatactgctacggtttttgcagctcaatttattaatgctactgtaagcttaccatcttcctgaacaaaaaatttagcagttagcagcaagtagattatcgctatgtaaaataaaattcctgagtttctgtcactcgctcttacagtacctacctgcctacctgcctctgaggagaaacgctgtaattaggcaacaggaaaattgtactatctttcaaatgcatttgcaaatgcctttaaggattttatcctttagaatcatagatcttgctgttaccttctgagttatttctagagttgatctgttcattaactggaacttgcgttctacgatttagttgccttatttccacccttcatttttttttatttttttaaagcaaaaattaatttttttatttttttattccaccctttaaaaataagtaagtgatattttattttataaataaatgagcaagcaatgggagcggttgtaccacagcttcattctaagtgtagacaggcatgaaaaggtcgaacccctgtttcaggcaaaagccagcagcctaggtggttccttcctttggggtggttggtaccctaacgggcattcagcagctgctacaaattaactacagtctgcctgcatttcttgtaatagaaaattaccaagtggtgtcaatgtgactcattcgagatttttttttttccttctggaagtcatagcttagtttctcaatgactcttggttcctatgtaatgccagttaagggacagctatatgacatgatatataaatgaagtgccagtttctgtgttactttgctccttgcaaacctatatgcctgaaagattggaggaagttttttccttctcgtaatctctacttcttttgtcatactgcagtgctgacactcattaaaaagaaaacattccttgtttggaactttcccaaagttttttttttttttttttctccttccaatttgaaacatctcaggctttagtcagtggcaaaattgaagttaattgtttgctctctcttcttgttaatgtattttgtactcaggagagggtctggggacatagaaatgtttcaaaagatgtcaggtgtggtcaaacttgcttttcaacctcattgagagacaatatagcaaaaggctgagagcacaaactggagccagactgcttgggggtgtggggatctggctgtgctctgtgatcgctgtgtgaccttgggcaggtcacttaacctttctggtactgcgtttcttcatctgcaaaatgggagtaatatcatagggatgctgtgaggatctaaatgagttaatactgatgaactaactgcttagaacaaggtttgccccttactaaatactgtgcacggtggtaataagtaataataattgatttctcctacttttcttcctctagtctatatcactacccttcagacacactggactcttttctctccttcatacaagtcaagcctttttctgtctccaagtctctgctcttgctgttttctttacctgtgttctctctcacatatcactttatgctcttcagatcctttgtcgcaatgttacccttatgttttatggtatggtcctgctgtgtttttgtcttccctgactgcatgctcactcgtgctctctctcaatcgtgcgctctctctctctctccctccctccctctctctccctccctctccctccctccctcccccccactctcaactgtgtattctagagagtcaggaccttccttctcattcttgatcattctcatagtagccctgccccttgagtggaacatggcatttagtaaaggatgaataagggaaggaatcattctgagaaaatactgaagatgatagctatggacttgaggcaagcatcccatttaggtaaaatgctttgtccgacattgaatttatcatatcagcttcatttaatgcattatgagatgttgtctttatttttccttctgtatcccatggcttctcaccattcccctccccctccaccccgccctctgaggttgctgcctgcagaccatgggaaacatccagtgggttgtccctgggatcacatctcttgggaagctcagctccaaagggtctagcaaagcccagggcttctaggttaggtatctcccacagaaccttctgtgtcaagaatctgggaaagtttgtccttatacctgcaggggaacctggaatttattctgtcttgttataaatctagtattcttagattcctgaagaacagaattaccagttttttctcagaggagatttcatcaggcatgtgtgtttagtgccttattacacagaaggcacactccagagaagaagaaagcaggtaatttgcttatttggctttaacagagtttcaacagagttcgtgtgagtgcaagcttgtgctctataaccaagaaccattcactggaacttgagcatcctgctgatcttccctcccccactcccagccagtgcagccatgtattaagcaattgttttcagtaccaacagtttaccaaagtgttggaataaaaacgacatctaaaacttgaatattttatatggccaaactatggctatttaactatacagttgaatatatttggattataacatatttatctcttaaagggacagatcttccatcctcctaacatatagttagcttccactctccaaatattccaccagcaacattgatgaatattgaagactatggactgtgaggtactgtgaaagacccactctaggacctgcttgctgctatttgccttacttgaaccagtaatcaagtgctggataaataatatgatttctattcaactttttgtttttagcccttagggaacaatctactgaatatgcaatgcaattgtcgggggatagttacttttcattacctaggtttctgttccttcttttaagtgtaatttaaatctggctgtcatgaaggtttggcgctcaaacagattttagcatctgtttaatgtagaagtggactggaactagcattctgaaaatgtagtctgaacccaaagaaatcccatgactctccttttctgtcctatcatagaaacagataattacatttttaaagtttttgtgtgtgggtgtgtgtgttgtcattttgaggtggggtttcaccatgttgcccaggctagactcaaactcctaggctgaagcagtcctcccacctcagcctcccaagtagcagggattacaggtgtgcactactgcacccagcttaagttttactttgtttctaatagatatataatattggatatatttatgagatacagtgtgatgttttagtacgtatatacattgtgtaatgagcaagaggattgcgtttatgggccaggcacggtggctcatgcctgtaaccccagcactttgggaagccaaggtgggtggatcacctgaggtcaggagttcgagaccagtctgatcaacatggtaaaaacccatctctactaaaaatacaaaaattaaccggggcgtggtagcacacacctgtagtcccagctacttaggaggctgaggcagaagaatcacttgaacctgggaggcagaggttgcagtgagctgagatggcaccactgcactccaccctggcaacacagtgagactccgtctcaaaaaaaaaaaaattgtttttatgttacttccctctaggctctttaatttctccattgagcattgtgtgagctccgctgagcattgtatggagggtcagctgccctggctggagatggttttgaggcttgttccttcgtggaaacatctggatgcagaagttaggctgtacaactatccaggggagctttaagtgagccaagtggaccctcagcaccacctcagagtgttctaagctaccgtctggtgtttgggactcagggaagtccttttggtatgatcagactagccctttatgtgactatccttgtgtgttactctcattaaaatattgatttttgccatgtaaggaagattggaatagcacaggcagccgaataaggattttaatgaaacattggagaatggcttcaagttaatctgtgaatgctttgtcattgtcccatccctggacacattaaaaagaaaaaaaagcagttgagaaattgcagtacaatttgaggagagcaatatcatacacagaagtagggactacttttgtcaaagctggattttatttatttgggagcaaagagagagagctgaaagacataatcttctctcccttaagaatctcattgtcatttagtaaaataaaaggtagtgtcacttcatggctcagaagtggtaaattatttgaggcaggtacccaaatccataaagcctgccttttgctttgtttgtggaatgctgattgtgtgctggggaatttctgatgggcagccaagaggaatttgggaagtagtgaaggagacctttaccccaggagtgttctattggatgtagttcaggaagctttctgggtaagccttgcaaccaaaggaaccctgccccagtaagatacgtcaaatggtggcagaagcaagaattagaggaaaggttgagcaacattttggtatttgaatagctgtgttcccaggaaactctgtcagtaaaatttctagaggttaagtaccttagccagatgtcataatgaacccctgtgttgctaactcaaatgctggaatggagcatgtgttttaggagttagaccaacactgcctcatcttaagcccaagtctgatcactcctaaactgaaactttgcaaatgtgtgtgttgtagcttacttaaaacccattgggtgtctgctaactctggctacactgaaaagtttttgctattctaccacccacggacgtcagagccctgctgcttaccagggcatgttagtctcctaatctacccctgaaaacctaccatggcccggggcttttctgctaccccccacgtcctataccctgcttgcttcaaaatactgttcctagttttcttcccctaacttgataatgtactccaaaacaatcatgtttggcaagtaatacactgataaatgtaaaagttacaaatagaagtgctgctgtgtttttaaaacattatagggccaggagcagtggttcatgcctcttatcccagcactttgggaggctgagagaggcaaattgcttgagctcaggagttcgagaccagcctggccaacatagcgaaaccccgtctgtactaaaaatacaaaaaattagctgggcatggtggcacacacctgtaatatcagctactttgaggcagaaggattgcttgagtccagaggtcaagcctgcagtgagccctgattgtgccacttccactccagcccggatgacagagggggaccctgtctcaaaacaaaaacaaaacaaaacaaaaacccagccaggtacggtggctcacacctgtaatcccagcactttcggaggccaaggagggtggatcacttgaggtcaggagttcaagaccagcctggccaacatggcgaaaccctgtctctactaaaatacaacaattagctgggcatggtggtgcatgtctgtaatctcagctacttaggaggctgaggcaggagaatcacttgaacccaggaggtggaggttgcagtgagccaagatcgtgccactgcactctgccactcactctagcctgtgggacagagagagactccgtcttaaaaaaaaaaaaaaacccacattctagaaataattaggtttctaaagtattcttaaaaggggcatctgtggaaaccagccactaataacatatttaaaggagagagactgaatgcttccccctaagatgaggaaagaggcaaggatgtcggcacttgccactggtattcaacattgcattgcccctaaccaggacaatcagtcaagaaaaaaaaataaataaaagacatccacattggaaaggaagaagtaaaactgtctctctttgcagatggtatgatcctctatgtaaagtattccaacgatcgtggatctgtctctccctcccctatgctcttgggccctggctctgtttctctcctggagtagaagcctgtggtgcagcaggattcaattgccttcaattgaacgttgcagaggactttcccctcggtgcttcccgtactgggggaagaggtgatttaacttctgagtaagggacaaacccagtagtgtgttagtagcaaaaagcatggacactggcatcagtctgcctgtattcagacaccagctgtgcactcatcagctgtgggaccttaggcaaattgttgaatttctctttgcctccatttcctcatccatagaatggggataataatagtaactatcatatgggattgttgtaaggatggaaagtgttaaaatatctaaactctgttacagtgcctgccataaaagaagcactctaggcctggcgcggtggcccatgcttgtaatcccagcactttgggaggctgaggcaggtggactgcttgaggtcaggagttcgagaccagcctggccaacatggcgaaaccccatctctactaaaaatacaaaaattagctgggtgtagtgacatgtgcctgtgatcccagctactctggaggttgaggcatgagaattgcttgaacccgggaggcagaggctgcagtgagctgagatagcacccctacactccagccttggtgacagagcaagaccctgtctcaaaacaaaacaaaacaaaagaagcactctatgggaccaggtcttatagttaggtattatatatgtagtagtgatattttcagttttgctgtttctgccagatgggatgaaaaattccatgagaagttggctggaagtcctactgattcattaaataggcctttcatttgaagtcatgtttctaatcattcagaagttgaggtatgcctgatccatggtattagaagggatgatcccagagaggtcattctgtagcataatgagcattacttttgaaggatggagaacctagaactctgactcatttgactatgggaaaatctgatctggtgagtgaccatgaccatgaagtgagatctggtaacccaatggtggtcacaggatagagactctgaagatactgagctggcttacacacttgctttgttgtctcgaacctctgttaaagctgaaagaagaagtcagtcttctgctgggcacactgttagtgtgtaattgtgaagagcttagctggagcttgctcttcacaacagtctctgatctcatcagccccattctgttttcaggggtggtacagaaggagcacctcaggagcctccaaagatagtagtagaatataaccaccaagacaagactgtgactgtggttttgaatcagatagaatcaccacctcctgcaaattttgtttttgctcagaacagtggttcttaaaatgtggtccttgaccaacatcatcagcattacctaggaactagttagatatgataatactcaggccccacctaacatgactgaaccagaaactctgggactgaggtatgttttaacaaactctccaggtgattttaatgccaccaaagtttgagaaccactgatctaggatatagaacagcagcattctactgagtttctgtcttcatgcaagttgctataaaaaatataagcaaggagacacgctctctgtcctcaaagagcacatagtccatctagagaggtatactatattcaatgccacacaaaggaggccttcccagccgggatcctgatgcaacagccctgcccagtctctatgccattgccgtgtgttttccccagaagagttcccattcttggccaggtgcctgtaatcctagcactctgggaggctgaggcaggtggatcacctgaggtcaggagttcgagaccagcctggcctacgtggtgaaaccccgtctctactaaaaatacaaaaatgagcctggtgtgatggtgggcacctataatccctgctactcgggaggctgaggaaggagaatcacttgaacccagggggcggaggttgcagtgagcctagatcgtgccacttcactctagcctggggggaagagcaaaactttgtctcaaaacaaaaaaaagagttcccactccctgaagctgttttttgtttgcatgtttgttgtcagtctcctgtcatcattcgaaggtcagggccttgagggcaggaccctttcttgttcactgctgcatccccacccctcagcagttcctggcatagacagcaagtgctttatatattctggttgaataaatgaattaagtgttctttgattcattatgctgtctacggtaggaaactctattttgcaatctaattagaccagccttttgccaaatttgaattattttaaacaaaatcagaactattgtgtaagagcatacaactgatttgtagaaaaaccagtatatcctcatttaggaactgttgcatatgtggacagacatgtacagttaccagtatttatttcttcatatttggaccaacatttattgtttataccaggtacatatctagtttatctaatttaattcttcaaaccacactgtgatataaatgggtagtattttccctgttttgtagagaaattagatacatcctaaagcttgcaggggctatgtatgaatacaggtctgtctgactcctcaattcctgctatctctagtcttgtagatttcccacaggaaaagatgaatcataaaacagtattgaagtccactaggagtaaaaacatttaggatctctacccttaaataagtgacaaaaactttctaatttaaaaaaatagataattcaaatttcttttaaacctttaatgttctcttgactgatctattttgacttaagactgccaacaaacagttaactaggagcagctacctctgcaattgctaataaggaaagtaagaatagaaactctttcatcctatttctgtctttccctacccatttattttgtttttgttttattgtgttatacctagtttgtgattattgctaggaagggaaaaatctggaattgggtacttgtttacttatttgcctgtgtcccctgctagaaaatgagtttcataaagaaccaacctctggctgttccctgttcgtctccagcactagcccagtgagtggcacatagtgggcactcagtaagcctgaataagtaaatgaatgcacgatcaccctcatgcagtgctgagcagtgtctggctgcagcaagagtttgaatgactgcagcttccggatgtccatagtcagtgctaaaatcctgcttccttctggctgcttctgcctttcacatgatagcatatattttaacatggctggctgctgagagttcagaaaaggaagaggatatatgtggttctaaactttgctattttaaaatggcagttataaattctaaaatgtatattcattatcatttagccaaacatccccgttgagtcaggtcaaggacagttaaccaaacattagcatatgtaacgtaacataatatataacatttactgagtccttcctatgtgtcaggcatcatgatgaatgtttatagacagtatgtccatctaatcctctcaacaaccttccaaggttatattagtatctccatttaacaagtgaggaaactgaggtgctgaaaggtgttaagtaatattcccaaggacactcaactaggaaatatgagaaccaggttctgaatgcagacaatttgattccaaaactgcattcaactgcaaagctgtctcgtgaactgcacttagcagataagtggtggtactcaagccagaagtcaggtctgatctttcggttccatcattccatactgcctgttcctctgtcttctcaatgaataatgattgtcaagccactctaagtttttttagatatgtatttgctcattttggaaattacagaaaattacaaagaaaaatctataatctagccatctagaaataactatgcttatgattttaatactttcttaatttttttctattattaagaaaaccaagattattctacatatacttttattttcttttttccccactcaacctgctgtatattgagcctgttttaacctctttaatatttgtacacaccatttttaacagttgtataatgttctatttaacgggtatattatttatttaactggccctctattattggacatatgtagtatttctggttttgccatcataaatattgctgaagtaaatatctttgaaccaaatttgtttgcatttctgattgttacctcaggatagatttctagtaggattaatgagccaaagaatattaatattaaaaagaatattactggccaggtgctgtggctcatgcttgtattcccagcattttgggaggctgagatgggaggatcactagagcccaggagttcgagaccagcctaagaaacataggaagatcctatctcttaaaaaaaaaaaaaagaaaaaatatacataggctgggcgtgatggctaacacctgtaatcccagtactttgagaggctgaggcagccgtatcagttgaggccaggagtttgagaccagcctggccaacatggcaaaacccccatctctactaaaaaataaaaaaattagccgggtgttgtggcgggcgcctgtgatcccagctatttgggaggatgaggcatgagaattgattgaatctgggaggcagaggttgcagttagctgagattgtgccactgcagtccagcctgggcgacagagcgagactgtctcaaaataaataaaataaaataaaaaaattttaaaaatacagaaattagctgggcatgtcaatgtgtgcctgcagccccagctacttgggaggctgagttgggaggatcacctgagcccagaaggtcaaggctgcagtgagctgtgatagcaccaccatactccagccttggcaacagagaccctgtgttaaaaaaaaaaaaaaaaaattacctattgccaggctgtcctctagatggttctatcttatacttccctcaacagtgtagaagagggaaaactaggtacttttaactacagttatgtgttcactcatgatggagatatgttctgagaaatgtgttaggtgattttgtcattgtgagaatatcgtacagtgtacttacacaaacctagacagtataacctactacacacccaggctatatagtctagcctattgcttctaggctgcaaacatgtacagcatgttactgtactgaataccataggcaattgtaacatagtggtatgtatttgtgtgtctaaagatatctaaaaacttagaaaagatccagtaacaatatggtataaaagacaaaaaatggtacacctgtagaaggcacttaccatgaatggagcctgcaggactggaagttgctctggatgagtcagtgagtgagtggtgagtgtgaaggcctagggcatttctgtacactgctgcagaccttacgtacactgtatacttaggctacactacattcattttttaatattttatcttcaataataagttaaactagattactgaagcttttttactataatttttaaacttttgaatcttttgtgacaatacttagcttaaaacactaatacattgtaactgcataaaaattgtttctttgttttttgttttcttttgtttttttcttgagacagagtcttgctgggtctcccagcctggagtgcagtggtgcaatctcggctcactgcaacctccacctcccggattcaagcagttctcctgcctcagcctcccgagcagctgggattacaggcactcatcacctcgcccagctaatttttttatatttttagtagaaacagggtttcaccatgttggccaggctggttttgaactcctgacctcaagtgatctgcttgccctggcgtcccaaagtgctgggattacaggtgtgagccaccatgcccggccaaaaattgtttcttcatatccttattctataagatttttttttctatgttttaaatactttttttatttttaaagaagcaacaccattcagttcagaacacccatactgactttgagctgatggcctttgtaggtttctaactggaagtgaaattttttctatttttaaaactttctttttatttcatagttactttttaagctttttttgttaaaaattaagacacaaacacacaccttatcctaggcctatacagggtcaggatcatcagtatccgtcttctgcctccacatcttgccccagtggaaggtcacatggacacacctgccatgtgtggagctgtcctctcctatggtaacaaggccttctggaatacctcagggaggacctgcttgcacctgttttacagttaacatttttttttaataagtagaaggaatacactataatgctaaaaagtatagtatagtaactacataaaccagtaactgtcacttatgatcattatcaagtgttatgtgctgtacataattatacatgctatacttttatatgactggcagcgcagtaggtttgtttacaccagcatcaccacaaacatgtggatgatacagtgtactacgatgttacaatggcacagtggctatgatgtcactaagcaataggaatgtttcagctccattacagtcttatggggccattgttaaatatgcagtccatcactgaaacgcatggctgcatgtggtagaaggtttcaattcataaatattaatttatactgctggtttatgactaacccaggaaactgcataatgattaacaaatgctacgatataaccaagtgaattgcaaagtcatctacacctgtattaaagttcagctcagaaaggactgtttggactgtgtgtatctagcactacgtagaagagaaagtcaagggcaaagttcccactctcaagaactttatcttgttgggttcatgaaagggtttctggtgacacagagtaggtatataatcagcaaaatgtggtctgcggttcaaatgagtgctcatgccagagattggttgggtgccagctatcagttcttccaccctgtccctggaagctatctgctacctctggggctggcacaacccagggtgtggctgcgactgcctagggtgtggccactgtgaactgagctgcatccccttcctggtgcacacccgcacacacaaaagtcactctctaaggagtgggaatatctatctcttcgccttggaatcttcagaaaataatgatgtagcaaatgatagtttttttgaatgttgatttaattaagctgattctttctttgaaagagaagatttaatgatttttcactccctattgcatttatgttttccacaactacgacaagagttttctctgtgttctgaattcttctttcttaagatttctctttctggattagtcataaaccagtctttcttaaatacattcagtttcttccctggtttcaatagatattgagggaagaaacggaaacctgaattggttagatgcatactttataccagacactgtgccagatgatagagattatttcaggtgtgtattcaggggacggggtgcgtggtggtggtcattctgaaagacacctgcagttgcagctcaaatcatttattccgtaagtatctatgagcgtgcacactgtgcttgacatggaagatgccagacaaacgtggtcctgctctgttttaagtgaaggttgttatggtgtataaagcaggacacctcacttggtaggagtgcaaggaggtatcagggagggctgttctgctgcccttctcgcaggcagcttttcaggcattgctcctgcacctatgcagacgtgtccatggctcgtgcgggggaccctcagggagaacagtcacgctgctgccccaggcacttgcactgtccctatgactgagtatgcatcctctgcaaaccactgctgtagcatcagactctgggtacccttactgtgaattcactgcctttccaaggtcctaactgttgctggctctgcttgtcatcatccagattcataacgccatacataccttaacaaagtgtgaggagagtaactttcactagggtgcaaatgcccatcaagtttaacctcacagattgcatttatactttaaaagaggagctcagtagtaaatattaatttgtaattatagattctaactgtggattgtagagcagttgctttgctgtgacaggcatctatgcaagaggcacttctcttatcttgccatctacctaccctagcctcttaaaattaagaaaaatagaagtcagtgactaagccaccaaatttgaatgtgttacctgggctagctggagtgttttgggggagaattctaaaacctgctctggtcttagctctgccctcatttactgagcctctatttccttttctataaagtggagctaataggagttttgtgaagagtaaaagtgagctgaaaagtgctgggctgacacaaggtagccctgcacatagccagggagcccagcatcctgtccaaagattagagtctgaaagctcactctactgatttgcaaactttaacctaaagcaaatatgcttaattttattgtccttacatttattgcttctgagagacacctttttttttttttaaggcaaggtcttgctctgttgccccatgctgcagtgaggtggtgcaatcatagctcactacagcctcagcctcctgggctcaggtgatcctcccacttcagcctcctgagtagacatgagagtctccctgtgtggcccaggctgcctggcctcaagtgttccttccaccttggcctcccaaattgttgggactgtaggtgtgagccaccatgcttaggtggcagctttattttaaatgacctgtttgccccagatgtgttgaatttaaggataggctggaggttcagtcatttttatttattttcaaagaggtgttcagaattcacactctgtttttcttttaataactactgtggcttcctcctcatgctgactttctacacttgggaagagaatgtgggcaaggaagcttggagggaagccagagactccttgctctctgcagctgcacagacaggccaggatctgctgacctgtggaaccagcccgctgcagtgtgtgccccccagcccccggaggggcagcgggcatgcctcagagagcagctcagagtgaagacggtagaaggggaaaactgatgagaattattgtgaatcatggtggggaggaggggttttaagaagttaggcctgttaggctgggtgcggtggctcacacctgtaatcccagcactttgggaggccgaggtgggtggatcatctgagctcaggagttcaagaatagcctggccaacatggcaaaacctcgtttctactaaaaatacaaaaattagctgggtgtggtggtgcgcatctgtaatcccagctacttgggaggctgaggcaggagaatcacttgaacccgggagatggaggttgcagtgagccgagatcgtgccactgcactccagcccgggcgacaagagtgaaactccatctcaaaaaaaaaaaagcagttaggcctattttgctgtgctaagagaaacttacttttaatgaactgagctgcatgcctatcccaaattctgttttaaggaagatgctctgaccacagtgtcagtttggctctaaagtttcaagggatactgaaagggaatattggaaccaaatgaatctgaatgggaatcccaggtctgtcactgtctgttttagaccttggaaacattacttaacctcttttgaaaataaggatttaccatcttgttggttggtttgttaggatgattagatacattccagatcagggtaactctcctaggttaaaagcagggactgaagccaggcaattaccagggatggaaattttaaagctgacggcagaacacacaccagagctgctggctcgtggaagcctttgaagtgatgatttgatgggcaatctgagttcctcaggagctgcccaaagcctcataggctcaggagccatgctctgctttcagagtactcaacctgggccttcccctacctgtgtgagatgtctgctgctgcacccgcacgtgccccaggatcgaagggaggcctcagagtcctgccctcacagtgtcccccatgtctgaaggcaaaaaacttggaatcactgtgcatatactattttggatgctcgctttcttgctttctcactttcttgctttctctctctctctctctccctctcctccctccccactccctctctctccctctccatccctctccccaccatgtcctgctcctctcactccctccctccccctccctatgtaatgtatactttagcattttaccatgttaaatattttttcaataatgtgatttttgttggctatattattctacagcaacgactactgcagtggtgtagataaatctcataatgttgatcagaatctcccaggcacaaaagagaaaaaaagatacatgactgtatacttttctgtgtatagactgcatagttgagtaatttttaaattattttatatggtactgtctttgatgacttctcagaaacatcagattgattcatacctttttttggtctctatttactcatttgccagtaataaagcatcttgctccctaaggcttcacaccatgaaatagccacagtgctgggggccgtcccaacgtgttctttcttccacagacgcaagatggctgtcctctctaaggaatatggttttgtgcttctaactggtgctgccagctttataatggtggcccacctagccatcaatgtttccaaggcccgcaagaagtacaaagtggaggtaagtgggaacacaagctggtgcccttgtaggcttgtctgggggccacaggcttagccaagaacttattttcagccatggagggagaggcaaggagctagttgtgagaagtggcagtttcaggactgtgttagcgattctgcttcttcatggtaggaaagaggcaagaaatacagggccctgctagggagtagtttccatcttgtttgactttgtctcttcggtagaaagaccaggaatgctgggattccaatagtacacttctgcttggagctatttgctaggaagagagttactgtattttccacagagggttaaatagcaatattgtttcatggtgtgccactttaaaaatgatgtcttatggtgattttcctgttttccaagtagaaaagaggtatgtggtgttgagattagcctggacttagacataggaaggtggtctattaaacacttcctttagttttaggtgatctagaagggataattaccaaagttgtccctggtgagtggttttaaatgtctgtttctgtttagcaacttaataattaaactcccttactagagcttcttttaagtttttatatttagtttcttcttttttttcccttccagtggacacttccattaagattctcacacactcaatttctgttcttctattaagggaaatcttaaaaggatgtggtatttgatgactcttaggaaggctctatttccctacagtatctttgtaatgcatctgaaatccaccattgatgcttaacgtcaatgaaaagcacggagtttggcgcaaagctgcctctttcccttgtgcaactacagcgcagacatacattcttattcctggatatttaatagaaacattgactctgcttctgagaattgagacccttgtcaccataaatatttaagcagaaattgaatggtcatctatcaagggtgtgaaagaagatactttggaatatattgtttttaaggttcattttaactttcaacactgaatgctcctcttgaccatctgatcagtatgtgctttgttgtgacagtatcctatcatgtacagcacggaccctgaaaatgggcacatcttcaactgcattcagcgagcccaccagaacacgtgagtgtcggccctgccgggcaccaaagacatctgcagagtgggtgttttctgtctaacacctcagcccttagtgcgctgtatttgctgagtcatagtgatggtgacaatcatgggcacctcattaaaagtattcaaaaattatgtatgtgaacacattgactattaagcaaacttaagagtggttggaatggtgggatttcgggatattcttttcaaaaaatgtcttcatggttgcattacctactacagttttgcagcatgacccatctaaaccgatgttgactctcccaggcctagggagtgaagaggttttgaatgctgtaaggaaacccactctgactcaccaggaccttccacttccatttgttagatgtgaggtccttttactcagcatgttccaagtgacctctaatcccatgcagagcaaaggagggtggatgatagtgaccaggtcttctccctgcggtgaatgtttatttttacccccaagcttctaacttggcaaggaagatgtaaagattcatagtgctggctgggtgaggtgggctcacacctgtaatcccagcactttgggaggccgaggtgggtggatcacttgaggtcaggagttggagacaagcttggtcaacatggcaaaaccccatctctacaaaacttagccaggcatggtggcacgcacctgtaatcccagctactcaggaagctgaggcatgagaattacttgaacccgggaggcggaggttgcagtgagctgagatcatgccactgcattccagcctgggtgacagagacactccgtctcaaaaaaaaaaaaaaaaaaattcataattctacacaggcatacttaaaaagggcactttttaaaagtttctttctgtcaattccaggttggaagtgtatcctcccttcttattttttctagctgttggaggtgtttaccacccggtaagttttccaggaggtgttcatctatttggatagtagttcactgagctattatcaggcacagaagaaggaaataaacatttaatgaatatcttcagtgtctaggcactgcatatttaaaaggattttattcaattatttcttacagagttctttaaaggagatgggattttcctcatattttacagataaggaaaagcctctcatatactatttaaacttcacaaggtcaaatagctacagagtagaaggattagaatttgaactcaggtctgtctggttctaagtttcatgtctataagagttcatttgttatagtaattcattcacacaacaaactttcactcaccacctggggtaaagcagtgatc

SEQ ID NO: 14631 - DNA, 5402 bp, Human
attcttatgttaaaaacattaaaactgcagctgggcgcggtggctcacgcatgtaatcccagcactttgggaggccgaggtgggcggatcacgaggtcaggagatcgagaccatcctggctaacacggtgaatgaaaccccgtctctactaaaaatacaaaaaattagccgggcgtggtggcgggcgcctgtagtcccagctacttgggaggctgaggcaggagaatggcgtgaacccaggaggcagagcttgcagtgagccgagatcgcgccactgcactcccgcctgggccacagagcgagactctgtctcaaaaaaaacaaaacaaaacaaaacaaaacaaaacaaaacaaaaaacattaaaactgcaagaacagtgactattaaacccacttttaactttctctttctactctgttcatttcacttggaccgtttgtcctttctgcccctccaaaggattagttcaaattaatgtctcactttaaatactctgatccaccctgattttgttgttctcccaacattgactaactgcatttacagtcaaatgctaaattgtatgacgttaattctctttttttttgtatgacataattttcaggtgcttaaccttacttcccaattaggctgagagcaaactggtgaacaagattcagaccttattcttctgttatgtcctcatgatcctgggatccacaggaaatgctttaaaaagaattcggttaatttgtaccatctacacattgatttcacccatgttcatgtccttaaaatatcatcatacttgtcatcaagtatgactgttaccgaaatggtgctgttacccaatgaccaagaaggggtatgttttccatttcttcccttttgtaaaatgccaaaaaagaaaccaaatagtaaaagcactgagattaaaggaggagaatgggaggtaaacaactacttttgtgctaaaagtgtcctatggcatttatatatattttttccgcaattaatcctattcccaactcttcaccaaggatagtactgtgtcatggttactataccctgggctgacatttagtcaggaggcaacagttgaaccagttgtttccagctagtatccattttgactcggtctctatattatactacttgttaaatatttttagtatctcccctcagtaaagctgatagactggcagattctaaatacacccacccattcttgtgaacaaatatgaactccagaatttttccaaacgcttcagttatgaaagtgatgttaagaaggattttatgaaaaagcattcagtatcatttgattttaaagtttgtaattggttatgctatacctacttgactacctctaatacctattggctaaggcacagtggcatgtgcctgtagttccaccttttcgggaggctgaggcaggactgcttgaagccaggagtttgaggcctcagtgcactatgatcacacctgtgaacagccactgcactccagcctgggcagcatagcaagtccccatctctaagtaatatttaagaataatacctattgcttagcttatcttcacccataggaccctgaattgcctggaagtgttttaaagtgggaatctagtcaggtgaagatcgaaagcaaacagaagtcgctgtgagtaggtaagtacaagaaatagatttgaggtgaaagaaagagaattttggaggctgggagtgaatgactgcagctgctaagctactttgcactttctagtctaggtctttgggcagtgatactacatataggtattcagctgccatccagaaggctatggaatcactccaaaggcttcagtagtgctctgacatcattcatgactctcttctctatcatcttatatctatatagtcttataaaaaccctaccaaactgttcttgttaagagtacagtacttggtggtagaagcagaaaacctttcctcttaattaaccatacattcataattgttaaagtcagagaaaaataaattattcaacactgacattttattttctgaagttttatcatttttacaaaacaaaacaaaatgaaacaaaaagcaggtatcaaaaacagcaaagagtttatagaatttctgcaccagtttgcacataagtcagtgattacaaaactggcatccaatgtaaatactaagcacaagctcacttccctcttggtcaggtggtttgttttagagctactcgatatttataactttttataagcaccggtcattttttgagaactgatttggtttgtccaacaaagtaaacaattttttgctgtgtggcagtttctttttttagaaaacactgagctaaaacacagaatgtgtatttgtttggatctgaaccaaatcttttgagatcccaactaccctgaagaacactgaagacatttacggggcatattaaatggtatcttaaatactagttgtatacctcataatgtctaaggcagctattatatttctaaagaaagtagcatttcattcagaggctgcccagagtttaaattacaccatagtttttctttctttctgcaaatcattctttctgatttgcagttttttccaaacagagccatattagtggaacaaaagtttgatgttcatgcccaacaagctctgatattttatggatacatttgtataaagcaagacttcttgctctgaaccctgggtgaccacaaataaattgaggggccatgattattggatgctgagagaaagtagcatacttaaacccacagtacagataatcaggaggcaagcaaaaacaaagctataacttagcagtggtattcacccaccacttattccaaaaacatattttgcttattaaataagggaaatatggtccagttttgcaatgttaatagctgccagtctctcatattttttataaatatcatttcctgactagcaatgagctaggaaactggcctcaaattctgaccaaatctctcagtattagttaaaaataatacaaaacaaaacagaacaaaaaaccagccaacaggggttaaaagttgcacaattaaacttgaatgtaaattatactatatacagattggtataaacatcactgaaatggttttgaaaggatgaaacacttctattttaacacaatttcttctatattatcccaattttcattaaaggacaactgatatgtaatttttttctttacagatatgaaaaagcaagaaggcaaagctgagagaaacagatgctacccacagggcagcggtggcatttggttgttttggtctttgtaccagcaattcccactcccgaggcagataatccacttcctgccagactacacagtttttcttgcagtcaagacacgaacaatggaccctactcctccagcagcaagtgcctaaaaacaaaccaagatgtaaatgttgacagaataataaaaggtcaattctcatatttggtaaaacatttttcttaaagaaggaatgggcactgctatagaccctgaatttattagttaacaaataataaattcttgagcaccaattatgcaccaggtactgttcttggcactgaggttacagtaataaacaaaaccttgaaagtccctgccctcatgaagttacattctagtgagatactagtttacattttagtacattaattctaaataatgttttaaaaaatctgcagcataggccgggcgcggtggctcacgcctgtaatcccagcactttgggaggccgaggccggcggatcacgaggtcaggagatcaagaccatcctggctaacatggtgaaaccccgtctctactaaaaatacaaaaaattagccgggcgtggtggcgggtgcctgtagtcccagctactcgggaggctgaggcaggacaatggtgtgaacccaggaggcggagcttgcagtgagccgagattgcgccactgcactccagcctgggcgacagagcaagactccgtctcaaaaaaaaaaaaaaaaaaaaaaaaaaaaaatctgcagcatagtgttcctgctcaaaacaggtggacattctgcatttctcattctcaccacatagtcagaagaaaattcaaactgggatcaaccatcccaacttccacttcgattagtcagcctttgtcagattttttttctcccaaagaaagaaggtattgtttaatagctaagaacttagaaactttaactctgactctaatttgaaaaatagagagtaatgatcaagtattaggaatctgagctctggtttctttctgttcaaaaaatatttatggaatacctttgtatactgagtactgtgctagatgctggggatacaaaagtgaacaaatacagcattttctggtctagcatgaggagacagacatataaacaggtaattttaatctaatgtatgaaatgagagttgtgctgcaggtgctattaaagcaccagggagaggcttatacccagattaacagtatagaggaatgtttcagctaaggcttcatggaggaaatgacacattaaaagaatgagtaggtgacaggctaacaccagaaaatcatgagcaaatgtatggaggtgtgaaacaatatggtgcattcaggaaaaaggctggcattgctatagcctgaggggaagaatgacatggaagatgaagctagacttgggaactttgactttatcctgcaggtgactgacaagggcaattttgattttaaagatatcattttgatggctgggtggagaacagatttgaaggaggcaaaactgttaactgggaaaccagtcaggaagctatggcaacagactgggagagatgctgtgaacagctgcattagatacgcttgaacagatagatttcagaaatacttcgaagattggtaaaaactggtgactgacatttggaagaaatgaagacttcacacatgcctcagtttcctcagtgacaaaagaggaataatagcaagcatttccctccatttttatgaggattaaatgagttaatatttataaagtcctttgaagaatatgtggaatataataagtaatcaatgttcactgcaatcttgaggctatgctagaactacgctgcttgggttttaaagctagcttttcatctgtaaattgaggatgataaagatatttatatacttcacagggttgttgtaaaggttaaataaaacattaatagtatggtacctggcaacagaaagtgttccatgaatagggtgccatataaattactacccaaattggtgcattttagagtaaaagggggaactattgttttactatgtgcttttttcttatgtttgtgttttcactcagatacacttcaaacactcaatatttttatgactggttctatttacatgttatccagttttttacccaaagctcaaaatca

SEQ ID NO: 14632 - DNA, 12445 bp, Human
  misc_feature (1)...(12445): n = A,T,C or G
caggacacagccagtcgcagcagctcgcgcttgtacagctgtttgaaggcggccaccacgccctgctccagcggtgcggggatatgtgcccggctgctgcctttggacaggaacagcacccgcacagcgccatccggtgtctgcagctcctccgggggaccgaggggctccggcctgcaccgcacgggggcatcctcgctgtccagggcgggcatactggcagctgggcttgggcagggcgggtgggccaccagcagcacggccttctgctgcaggcagcttcggcgcaggtagcgtttgacgcctgggacaaattcctcaaagaaccagccccgcagcagcgggcggctgagccaggcgtcggggctgtagcggtaggaggccgggaacttgtcctggttgtggtggcgcaggctgggcgggtccggcagccgcccgatgaccagcggcttcagcttgtggctgccggtcaggtttgcggccagcagcaccgttacgcggtcgccccgccagcgccggccacagccccccgccccggggtcccctgcgcccgggggcgcagcctgctccggaagcagcttccagtagaggccggtgacgctggcgctgtaaatctgctcgtccccgtagccgccctcggccgggggcggcggggccggggcgcggtcgggcagggggccggcgccggagggcagcgcgggctcctccttgacgggcgggccgggcgcggggctcggggctgggggcccgcctcgccgtagaagcgctggctggagatgccgtggcgcttctgccagcgccagaaccagccgtggctggccttgaaggtgcactcgggcccgtagatctggcgcgcgaaggcctcggctgcgcctggatgagcgggccagacagcggcaccccgtcgtggcgcagcgccaggaaccaggcgtacacggcgcggtcgatctcctcctcgttggccagccgcatcttcttgcgctgagtgcccacctcaccgcccagctgctccaggaaccagcgcatgtgggcatcgtccttgagccagccgcgcatgcccgcgccggcacgctgaatgtcgcggcacacgtctgggccttgcgctcgccgcccattgacgcggctcgatggcctgcaacttgtccttggatgtagtaggcttttcggaaggcaatgtttcatggcgacgcggtgcggggcggtgtgggtgtgatgtgcgttggtttaagggtggttaagtgtgagttggtggcgtaaggggggatgtcgtgcaggatgaaagggttacggttcttaatgtggggttttctgggggtgctcttgggatatatttcattctgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgctgacctagcccggcccggccccgccccgctcctgcgctgcgccgcctcgtgcgtcactcggcgcttgccgctgccggacccgcccccaccggcgacaccactggccgcgaagcaggggggcggcgcgcgcctgccgcccgttcccagcacttgtgcaaactcctccggggaagagcggcctccgggtgcatctccaacggaattctgtctttgaagcgtcggggcacggcgcgtcgagggtcctggcggccaggcggggcgtgtgcaagggtcgcgtcccccccccgggcccccggcccgtggctcttggtagagcccagtgcttcatttcccgtgcgcggcccgggcggccctccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgtactgtgactgggtcaaaatttctgtctcttgatttggatagggtggtcgggcagtctctgaagggggcggggatgctgttgctaagaagtagtactttcagaggctttaagtggaaggaagaaggcaaagggggcggagtgggttggggacctgatgagacgtcaggattggtttccagaatgaaggaccgcctggcagcagaagaactgtgtagctaaacttggggttgtccctgcccgacagggcggggtgcttcttaagttgacactgcctgcggctcacctcccagggaggcaggccaggccatctcacctgagcagcctccttctacagctccgcccaccccgtcatctggaccccatgagccttaagcagctggctcgcaggcagttggttacttccggagcccgtgtgtgcccagccccgttctgggggtgggggatgcagctgaggggctgggcaggtgtggaaggagcccccgagcgtcctctgaggaagtagacgctcaccttcgccttctcaccacatgcctcaggcccagccaggctcctagacctgcctctgtagaggctttctgggcgcagtgccaatcctgtgagacagcagcatctcccctgggctgctgcagggttcacacgcagtcagtgctggcagagtgagcgcccagccgacagagcccccgctgcctcccgcctcctctggaggactaggccctctgggctttgctcccgggttgctgggtgaggctgcaaggtttagcacaggtgggcacacgtgcttgatgatggacaaagagtacctgggctgtgccgtgcactggcgtcagccttctgggggctgaggacaggaaatgtggcattgaggatttgtgggtcatcatcctgtgccagtgtgttaaggtgacatcagcgtgttggaagctggtggcagtgagttatgctaagtgctggtgtaggagcctgccacaggtctccagctctcccacctcgctgacagccaagggtgccgtgtgaggtgtggcgtgggtattgtctggggttccagaaagcctgtgccgtgctggagtcacccaggaggcacgggggctgcgccgggcgggcaggtcggccagagcccctcaagcagggctggccatggagctggcctgcagtggcatttaagaaaagacgtggttggggcggggcttggcctggggcagggtgggttgggtagctacagtgagtgctctgagatatgcaggacaggctggcgtttcccagtggggctggaatatccaggggtcagacaggaaagtggctgagtgggaatgtggaactgtggagttttttctcttaaaaagaccaaaggcggctgggcgtggtggctcatgctggtgatcccagcactttgggaggccgaggcaggcagatcatgaggtcaggatatcgagaccatcctggccaacatggtgaaaccccgtctctactaaaaatacgaaaattaggccgggcgcatggctcatgtctgtaatcccagcactgtgggaggccaaggcaggcagatcacctgaggtcaggagttcgagaccagcctggcaaacatggtgaaaccccatctctactaaaaatatgaaaaaaaattagccaggtgtggtggcacacgcctgtaatcccagctacttgggaggctgaggtaggagaattgcttggacccgggaggtggaagttgcagtgagctgagatcgtaccactgcactccagcctggtgacagagtgaggctccgtctcaaaaaaaacccaaaaattagctggccgtggttgcgcgtgcctgtagtcccagctacttgggaggctgaggcaggagaatcgcttgaaccggggagttggaggttgcagtgagccaagatcgcgccactgcactccagcctgggtgacagagtgagactccgtctcaaaaaaagaccgaaggcctcactcccgcaggaagacattgatctgtcctgtggctgctctgccgtgcggtggttttgcctaaagacccgcttcctcaggggctccagcctcttttaagggctagtcgtcgcgccctttgggcactgaaggtactgaaagttctatcaggcagtgccagtccacagactcaggccagccaggtgggccggagaggggtgctgctgggagggatgggcgtgcacaggctgagccggtggctgaccccgtcccctgcccacctccctgacttctccctgtggagggtggacaatctgggagcctgtctgtgtgtgcgactgtgatggggtggcgtggagagcagggcctgggagccagctcctcccagaaagcttccgtttgcccagatgtgtggagacctccaggccgtgcagcaccttggtggccacagctctccaggatgtcctcaccttcctcagggccctgccctcctgacctggagtgttctgggtaggagtctttgccggggctgctcccaggacagggacaggggaggctgtgagggccatgccgctgcagtgggtcttgctggctgccacctgtgtcacaggccctgttagctgggtggagccttccagagccaggaccccagggcactctcaaactctgggcagctgccagaggctcaggtgctcggcagacactgtctacccctcagggaagagccttggtggtgagcctggcctgcttccaggagcagagtagggacacttgggccacttccccctggggcctggctctggcgtttccaagactgcttctctggcagccagctgtctccctgtgttctctttagaaagctcctcctgagcttggataaactgcaggagcgaaggggctgaccgtttgtcgggacgcagttgaaagagtcgctgtgtcctgctccgggctctcctgctggagaggagaggcttgcacgtgcctgtcgtctgcgcaagcgttgaagctcagacttggtctctgttaggagagatggtgcgctgcgtccggcaggtcctcccatgcttgggaacgcgggaagcggggaaatgaggaggtgggctcggacgtgtggggggctgtgctggctgtcctgggaggctctctgcccgctgttagtggccagctccccaggtgacgggcctggcctccaggtctccagcatggcttactgtggtgtctcctgagggcttcctctctgcagggaagcccacccaagatccctcttactggtcccatggggcagctgcctccgtagcatcctcgtctccaccagacccctgcagggtgcccagttcctccctgcagggtgctccctgctgcagtgtggggtgcacagaggtgggcagggccctggggccggagctcccgttggtgaaggaagacggatcccagccagggctctcgggttgatcagcagtaggaggtggcccctcctgcccagtcccacccaggacatgggctggtggctgggctttcagctgtgcccagctgcccttcgcagagcttgcagggtttatgaggtggctctggtgagattaggggcaggacacctagtgtctccagccgaggagtgaactgggtggaggtcctgtccttgtgtgcacattgtgggagagtcagtctgggaggcctttgtagcttgtgctggggcccttgggtgccagccctgtcttgacggtggctcctgctgagagagaggccctgtattaatgtgagccctgggctgcctcccccttgagggtccttgtcatcttccgggcctccttcagcagaccggacacaggggcagtgcaggtgaggggcttgggggagctccttggcagctccaggggatgcttgtgggcgctggcttatcttgtctcaggctaccttgctcaggtgacgacagggtgggtggatttgggaaaggttggctcagatagtggtccctgcttgtcccccagggcctgcctaggctccaactgacagtaatcccaagagctcccctttcaggggatgacggagtgatgtcacctgtgtggactcagctgccacctgggattgtggtggcggcgggtctgtctggcgctcagcttccatctccaccagtgtcacctccacaccacctcgccaagcagcttctggaaaggcccccggccgccccgggctgacctgctgctgtgtctgacccggttagtctttctggctgcctctaaccttgctgcttttccttcatgctgtcctaggaggccaaagcaaagtaagtactcgcctgtcctcatgccccattccccttcatttgactggggaacccccagccctcgctgcacctgagggaacccagcaccacctgcgcatggcccagtctgcccagagggcctcagtttcccatctggaaagtggaggaattgggttttctggatggggcagcagcaggtgggcaccctgtgtggccgtgagcagggtcctgtcctgggctggcgggtcagcagctgacatgcggctccctgcagggaacgggtggcagtgccaggtctcggtaggagccttgaagtggcttaccctccctgagcggcggcttctgcccggagcccccaagaacatagtctgaggccactttggccaataaagtctggtagggcatcaacactgggggccagctcagtggcactgctgatgggacctgcacggctccatgggagcagagagactggtgggggtaccaccgcacgatgtcacaatgccctgtctcctgggctcttgctcccaccccacccccaacccacaacccctgcctctgcccatcagcctggccttggtaagtgctgccccagcctggggaaggaatgagcaggggagcctagggagcgtcttcatgggccctgtggcctcccatgggccccggttcctcgttggtgccattagaacttgttgctgggactgcgggattcgggccacatgcccgcaaagaactccatgttccacttagaggcttcagagtgcagtgccaggggtgccttcccaaaagtcctccctgcctgggtggagcgtagacagctcagcaccccacggggggcgttggagccagccttggttttgttgggtaaggatgttagaagaggggcgaagacccatagccactggtgtgaagggtctgctcttgaccgaaggctgcctccctctgggtgcagaccaggcaggtggtcccagtcacggtgccctggggccactgggtctgtctgccctcaggctccactagacacacctgcggaggcagcagactagcagcggtgtctgtgaggggcagctgcacagccccctcttgagggtgctcctaggcgttggttaggcccatgcgtttctgcttttggggagcagagcctggagtcgggcatggctggggaggaagctatcgcaggctgagcgcgggctggggtgctgacctgcatcccaagagcagatttgcccctggccttctgggcctgtcctttctgtaacaccacactggacacctgggagcagagcgtgcccccggcaggatcccacatggctgctggagcactggggcagcaggtgactgaggtcgcccagagcttgagggaacacctcatccagggaggaggctgaggctcccaggccacagtagcaagtggggagtggagcctcacaacctgcctcccaccaagatggtccctcttaacattacacagaagcaaaaccttagagggggccctgatgtcctgggactgtgagagccccatgattcccctttagcttggatggacccaaaggtatggactccagctgggaggcgggggcagctgatagagagcctagagccgtctcagtgctccaggcgcttggcccctcctttctacacagtggtcaccagcatcctccctggcgtctccttcatgagtgggcactccaccctctgcccggccacctggccccctcctggggaggacagtcaggcccacaaagaagctccctctttttttttcttttcccctgctctgttgtccaggctggagggcagtggcgccatctcggttcactgcaagctccgcctcccggcttcacgccattctcctgcctcagcctccctaggagctgggactacaggcgcctgccaccacgcccggctaatttttatttttatttttagtagagacagggtttcaacgtgttagccaggatggtctcagtctccagaccctgtgatccgcccgcctcggcctcccaaagtgttgggattacaggtgtgagccaccgtgcctggccgaggctccttcttttgtaagaactttgagggtgctctgggtgtggcagtggtgtggccaggacagccacagagaccgttctgtagaatgggaacaccagccaccatggtggggtggccaggcctggcctgtggaaaaatgcagggaaagctagttagccagttaaagcttatttcagataaatgacgaaaaatttttagtgtaagtatgtctcagatacttcatgggccatacattcactaacaaaattatgtattgttcatgtattgggaggcacttggcctcccagagtactgagattacaggcatgagccactgcgcccggcctgttttctcttcacaacaaaacgtccccacatgggcttgacttcgaagtcctcgaatgtcatctcatggaagccccactggggagcatcctcagcccctgcccagggagggcagccacggggagggcgggcacggggagggtgggcacggggctgcggccacccgctgtgttgcaactctgccctctgcttgctttttatcgctgtgtccggaagatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaaggtggtgctgcgcttgtgggttccagggacactgcttgaggttacaaaattccaggctgcctggatgagggcagggaagggctcagcacagggcagaatctctgccttgcccagggtccctctttggctgggaagctccccaagtcccctgtggctgtcacatgccagggctgagaagataaggctacttataggggcgggaagcattgaagctggtttctggccctagcgctcccctgcgatgagatgtgggagccagtgtgtccctgcctgtccatcctgtgcacccccagctttccttgtcacctgaaaccacctctgagggaaggtggtggcgtctcagatgcatgggcatgtgactggtcaggtggcctccatcccagggtgccccgtctgtgtgacctccctctgggtgctgtgggcttgctccagggtgcaggtgcaaccccagcagcggtctctggggccaggcaggtgggtggacgattggacttggaggggaatacagagggcatggaagtggcgaggctggcctgttggcgagggtatcctggtggtggggcgggctgagtcagggaaggactctgaaggtcccaagcagctgctgaggcccccaaggaagtggttccaaccttggacccctaggggtctggatttgctggttaacaagataacctgagggcaggaccccataggggaatgctacctcctgcccttccacctgccctggtgttcacggtggcctggtccctccttgccgagagagtgtcctgggtcagggacgcagaggacgctcacagactccagccctttgttaccgagaggacacttggcaaggtccagcgatggtccggagtccacacacagactggcggcagggcaggagggggacagttctgttgtgcttggttggacagtaagagggtcttggccagtccagggtggggggcggcaaactccataaagaaccagagggtctgggccccggccacagagtcatctgcccagctcctctgctgctggccagtgggagtggcacgaggtggggctttgtgccagtaaaaccacaggctggatttgcctgcgggccatggtccctgtctagggcagcaattctcaaccttcttgctctcaggaccccaaagagctttcattgtatctattgatttttaccacattagcaattaaaactgagaaatgggccgggcacggtggctcacgcctgtaatcccagcactttgggaggccgaggcgggtggatcacctgagatcaggagttcaagaccagcctggccaacatggtgaaaccttgtctactaaaaatacaaaaaattagccaggcacagtggtgtgcactggtagtcccagttactcgggaggctgaggcaggaaaatcgcttgaacccaggaggcggacgttgcggtaagccgagatcgcgccgctgattccagcctgggcgacaagagtgagactccatctcacacaaaaaaaaaataacaaaaaaactcagaaatgctaagtgtacttatttgttgaagaaacttgttacatattactaacatcttttttttttatgagaaatacttttcccataaccaaaaaatttagtgagcagaatggccttgcttgaggtttttgcaaatctctcgggtgtctggcttagtgggaggcagctgggccctcatacctgcctccgcacttcagctgtttgacataaacccagcttcgtgtgagtgaaagggaagggcctggggaccctcagaggttctcggaccacactttgagaactcctcgtctggaagacaggcctggggatgccatgtggggtgagggcttacgggc

SEQ ID NO: 14633 - DNA, 57280 bp, Human; identical to SEQ ID NO: 11796

SEQ ID NO: 14634 - DNA, 57280 bp, Human; identical to SEQ ID NO: 11796

SEQ ID NO: 14635 - DNA, 57280 bp, Human; identical to SEQ ID NO: 11796

SEQ ID NO: 14636 - DNA, 57280 bp, Human; identical to SEQ ID NO: 11796

SEQ ID NO: 14637 - DNA, 57280 bp, Human; identical to SEQ ID NO: 11796

SEQ ID NO: 14638 - DNA, 57280 bp, Human; identical to SEQ ID NO: 11796

SEQ ID NO: 14639 - DNA, 57280 bp, Human; identical to SEQ ID NO: 11796

SEQ ID NO: 14640 - DNA, 57280 bp, Human; identical to SEQ ID NO: 11796

SEQ ID NO: 14641 - DNA, 7585 bp, Human
agatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctggggaggttgaaattactcatgcaagacactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcaatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttcttccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagaagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgagaaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaacgtcactgcatacaaacatcactttgttcaacatggattttgtttttatggagtccaaatgcagaccctagttcaccttacagccttgggtttgtctgctttgggagatatatatccagttgatagacagacaagacagatacattttttccctttcttaccacaatgtcaatgcctcatctgaatatcatcattactcaagagtcaagggaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtaagactctttacacaggaaagtgagtcaccccagtgagaagggttgccagcggaaatagggcatgaaaatcacagataaccatgggatttcttccaagtggtcagtgtaaaataaaccaccaccaccaccaccgaaaaca

SEQ ID NO: 14642 - DNA, 13016 bp, Human
aatttgagcctgagaattccaaagtctggaggagtttttctgccatgcttcaattcaacatattgaacggtttgaacagaattgtggatggcaactccagcagttgctgctgttgcagtaaccgcaattagtcctgcaatgatggcaataagagtaaaaataaatctctttgttcttttgcggatacctttaagaacttcattgactatgtgaatagagggggaagactcccatggacgatgtaaagaaactggtatccataccccctccctagcccttaccaagagagtacttgtagtgggattaaaagtagcatcaatgcacgtgaacagcttacagttatcacattctatagtttgtgtattgggaatgataattatatttccaaccaacagcatgtaagggggtttgacatagctcctgatgggtatcacccgttcagatatgagggtgatgttgaatgtgggtgttttggtattagtgtgaaggagttgataggtagtgttccatatccttattcctgtcatagctgcagctaattttcatagttgaggatgttctggggtaacaaagggatgaatcatttttggtctaggaggagtaatgcctgcatccatccatttaaataggtaaggggacacccattgtctcagcctgtatgactgccatccatcctctacataatctaacaaataattaaactctgagcatgaggtatttttgctggagcaatcttgccaataatgcccttttggagcccaatcaataacaatacctgcggctagactttggagcacaacggccttaggagcattacaattattccataaaattgaagtcactataaaaggtccctttgtaggtttctttaaccaaaagagaggctgggcacagttgctcacacttgtaaacccagcactttgggagaccgaggcgggcagatcacgaggtcaggagttcaaaaccagcttggccaacatggtgaaacccctgcctcagcttcctgagtgctgggattataggcatgtgccaccacgcgcagctaattcttgtattttttcagtagagacgaggtttcatcatgttgcccaggctggtctcgagtacctgacctcaacctgaggtgatccaaccacctcagcctcccaaagtgctgggattacaagcatgagtcaccgcacccgggccccagtcactttagaatagcatgttgctttgtattcggagggtctctctgcaaatagcccatcaacactgagcgtgcctggaaagacctggttttcaaataactggcttcgtctgtgtaaaacgagtcttgttgtatgcattaaaaattatcttggctgggcgtggtggctcacgcctttaatcccagcattttgggaggctcgttctgttgccagggaggctgcaaaaggaggatgcggctatttctgcttccatcatggaaggctgggattccacaggcacagaaaggaaggagggagagatgggaatgtgactgtcctccagacacagcctctggcaggatcggatgtgggagagtgagggtcccaccccagctggggtctacccaggtccatgtcttggacatgttgagagtttttctggaaggcagggatacagtgtggtccaaaaacacacaaatgcccctactggcccaggggttgtcacaatagactggaagggtgacacatcccaggcgcttgccacccatcacacgcacctcctacccactggcatccttccaccccaggcacacacaaagcctcagtccagagatcaactctggactcagctctgaatttgcatatcctgtgtgtagattcattcttcataacctctgcccagcctagcttgtgtatcatttttttttctctattaggggaggagcccgtcctggcactcccattggcctgtagattcacctcccctgggcagggccccaggacccaggataatatctgtgcctcctgcccagaaccctccaagcagacacaatggtaagaatggtgcctgtcctgctgtctctgctgctgcttctgggtcctgctgtcccccaggagaaccaagatggtgagtggggaaagcaagggatgggtgctggagaggactggaaggaggtgaggaacaggacatgtggctgggagacaggctggatgcagctgggataccctggcatacggcaggaatgggtgcccaaggctgtcaactccctcagctcacacacttccaggagcattcagggagcctctgcgctggcccgaaataagaccttcaggaatctgaatctaaaacccctagtttacagtgaaaacaaagactccaaagaccaagcgacctgcttggggtagacagtcaggacggagtaggaaccatatgcctggagctgcttctgctcctgttccttccctccttccgatggctgggtacacctgcctgacgctgaggaaaagagagagcagccccaaggggaaagtgggaaggcaggttggctggagggatggtgctagaaggaaacccgtgcccaaatcccacactcagacaccactgcagtgggtctggaaggcgagtggctggaagagaagagagtgggagctccgggagatcaagagtcactcctaggataagggaaggaggctgtttgtggcatgagaatgtgcaggataaagacatggaagcgaatggcttctcagttgtgtgagtttaaaattcatgacatttacaaattgtcagaaaaggtgttatatgtttgttatataacaatcactttggaatgttaatctgattctgtgccaaaatctgaattactcagggttctccagagaaacagaactaataggtggtacacatatacatatatatgtacgtacacatacatacatacactgtatacacatggatacacacacacataggaagagatttacatatatgtatacaaaagagagagagagtagagatttattttaagaaattgactcacactattgggaggagtaacaagtcctaaatcttcagagccggccagcaggctggagacccagggaagagttgatgtcttagtcttgattccaagggcagactgtaggcagaattctttcctctttaggggacatctgaggctttttctcttaaggccttcaactgattggatgaagcccaccactatggagagtaatccactttactcaaggtctactgatttttttgtaaattaaaaaaaaaactgtgggtgcatagtatgtgtatatatttatggggtacatgagaggttttgattcaggcatgcaatgtgaaataatcacatcatcaaaaatgaggtatccatcccttcaagcttttatcgtttgtgttacagacaatccaattatacttttttggttattttagtttttaaaagtatttgattatttatttatttatttatttttgagacagagtctcactctgtcacccaggcaggagtgcagtggcatgatctcggctcactgcaacctccgcctcccaggttcaagcaattttcctgcctcagtctcctgagtagctaggactacaggcacctgccaccacacctggctaatttttttgtatttttagtagagacgggtttcatcatgttggccaggctagtcttgatatcctgacctcgtgatctgcccgccttggtctcccaaagtgccgggattacaggtgtcagcaactgcgcctggcctctcttttggttatttaaaagtgtacaattaaattatgattattattattatttttgagatggattcttgttctgtcacccaggctggagtgcagtggcgtgatcttggcttactgcaaacctccgcctgttgggttcaagcaattatcttgcctcgggtgtacactgccacacacggctaacttatgtatttttaatagagatagggtttcaccatgttggctagactggtcttgacctcttgacctcaagtgatccactcacttcagcctcccagagtgctggaattacaggcacgagccaccacacctggccccagttaaattattattgactatagtcaccctgttgtgctatcaaatagtaggtcttattcattcttctttttttttttttttttgtgacagagttgcccaggctggaatgcagtggtgcaatcttggctcactgcaacctctgcctcccgggcttaagcgattctcctgcctcagccttctgagtcgctgggactacaggtgtgtgccaccacgcccggctaatttatgtatttttagtagagatggggtttcaccatgttggccaggctggtttcgaactcctgacctcaagtgacccacctgcctcagcttcccaaagtgttggaattacaggcatgagccaccacacctggccccagttaaattattattcactggagtcactttgttgtgctatcaaatagttttctaactattttttttgtacccattaaccaccctcccaatttccccccaaccctgccactacccttcccagcctttggtaaccatccttctactctctatgtccatgaattcaattgtagggtctactgatttaaaggctaatcacatttagacactcaggagcaagaataattttagtaattgaactaggattctgccatatgacctccaacatcattagcacctgtgtaaattgtatcataaaataattatggaactattatggaaatgtccctctctcccagatcccaccttgtaccaaaatgcaaggtacaaccccgggaattctgagctccatcctagtcttaccctgtgctaattcagtctgggtcatttcttgaattttctggtaaattctcctttctaccctttctaactatatgtatttgtcaggttaagctagaagtgttaattttttttttttttgagatggagccttgctttgtcacctaggctgaagtgcagtggcatgatctcagctcactgcaagctccgcctcccgggttcatgccattctcctgcctcagcctcctgagtagctgggactacaggcacccgccaccatgcttggctaattttgtgaattcttagtagagacggggtttcaccatgttagccaggatggtctcgatctcctgacctcgtgatccacccgcctcggccccctaaagtgctgggattacaggcgtgagccactgagcccggacgaaatgttaatttgttttttttgagacggagtctcactctgtcatccaagctggagtgcagtggcatgatcttggcttgttgcaacctctgcctctctggttcaagtgattttcctgcctcagcctccagcatgactgggattacaggcccgcaccaccatgcccagctaatttttgtattttttaatagagatggggtttcaccatgttggccaggctggtcttcaactcctgatctcaagtaatctgcctgccttggcctcccaaagtcctgggattacaggcatgagccacggagcccagcctagaaatgttaatttctaacgcatgtcagattccatgcacactgggcaaggttccattcctccatggggtgactcagggatccaggccaattgcatattgagactctttcatattatcctgtggccttcaaagtcgtcacctctagggatgagaaacaaaagggacaagccagctggtagggtcttggacaagaagaaagacatcacttctgctcacattctcttttgacaaaactcagtcacatggtcccaatatatcttcgaggtggctgagtaatgttatcttcctatgtgtcaagcagaggaaataatgtagtgaagacacaggatggtctctgaaatatcatctcaggcatgaaagtagagcatattcacttgagtgagcctccagtggtgtgaagttgatggcaggagaaagagctggggaagaaaaggccagtggcaggtctcccctcctagccctatgcagccccacagtgggacccttgcatggacctcaaccatcagaatcttttcttttgcaggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacggtcagtgaataacagaccacaggggtggaaggtctaacccaagaggcagcccccccagtgtgagtggcaagggatcagcaggatggaaatagtcccaatcccaggggaagaacaggagacacagcagaaacacagacatgtccacatcccacccaccccacagcacaggtgctccccgcttccccatcaattgccccatcctcatcccaggcctcaggtcacacaggaagtgatggcagagtcacttcctatccaggcacctatgacctctcacctccacaccccacccatcggaggctgatacccccgtgagaaggcatcagactcacccctgtccagggaggttgcctggagagtgagccactctcaaagtcactcagacctgggctcacctggtggttctgccagtcctagctgttgacagtgaaacgttcccaaaatatctggttgaaatctgcaaacattggagcactgagacctacctccaaacaagtctgtaatatttaactatgtctgttctatgaaggatgtcacagtctgtcctgatctcccttgcagctccatcacctagcacagggtacagccaatattggctcaattgaaatttgtggaatccacagagaaaagcacccggcacacaccgtagcccatgctgggggctcaggaagtgctggattcaaaactgtgggctgttagagttccttggagccctaaagttcctccttaccatacgatgcagacccaggaagggccacctgcgctatggtcagaggagctggtggcagagcccgtgcagagatggtccctgtgcccccggcccagtgctctttctcctaaaccacactgccagccccaaggcagccaacctcaggtctggtgaactgctggtgttaaattatcatagagtgggtgtcaaaagatgggctactaagtacaaaaatgcccaaggtgctacatgggatctgaagattttcaaaaggaggcaagaaagagataggcagatgtttcaaggatgtggggtgggggaggtcttggtaaggaaaatggcccaggctgtgtgtcagcaataggagaggagggggcacaggtgatcagaaaagacactgggggaagcattgatggacaggaatagaaatggcaaagtggataattaagaggaaggaggatgaggagatgaacacagggtattagaaaataatagaaggcagggcttggtggctcactcttgtaatcccagcactttgggaggctgaggcaggcagatcacctaaggtcaggagttcgagaccagcccggccaacatggtgaaaccctgtctctactaataatacaaaaatagcctggcatggtggcacacgtctgtggtcccagctactcaggaggctgaggcaggagaattgcttgaacccaggaggcagaggttacagtgagccaaaatcctaccattgcactacagcctgagtgacaagagtgaaacgttgtctaaaaacaaaaaacaaaaaaaggaaataatagtagctgacatttactgagcacttactttgtgccaggcccatctatgagcatatataatgctcagaatagccccctaaaacagtgctcttggcattgccatttcagaggtgaggaaatagaggcacagggagttgagtggctccagttcaggcaacacaccaggtgggggtggggggctggggagagacctgggacgtgagcccagacagcttgagagctttcagagtctatgccaacagcaccaaccagtgctgggtaaacacctgcttttatcatcagaacaaagaggctgtgtcccctgccctatgaggtccatttctgagagttgtggctaatgggcaagaaggttggggctttagagatttgggataaagatatcaaacaccagaaaggtagaaagaagtgatcagattagggttacttaggtgatgatatgaactcttcctagaactgagagaaaaagagagccttcctttactcatatgaaatcacaaataatttctatccaatttggaagtacactttggtgtagttgtgacagcttcctcaggactcagcataaattcaaacaaataattgtccttagaagagatgctatagaagagatagaaatatattcatattctgtagcttttttttttttgagatggagttttgctcttgtcacccaagctggagtgcagtgatgcaatctcagctcactgcaaactttgcctcctgggttcaagggattctcctgcctcagcctcccgataactgggactacaggctacaggcatgtgtcactactcctggttaatttttttttttttttttaagactgagtcttgctctgtctttcaggctgatgtacaatggctccatctcggctcactacaacttctgtcccccaggttcaagcgattctcctgcctcagcctcatgagtagctgggattacaggcatgtgccagcacacccagcaaatttttgtatttttagtagagatgaggtcttaccatgttggccaggctggtctcaaactcctgacctcaggtgatcctttggcctcagcctccctaactgctgggattacaggcatgagccactgcgtccagcctaattttatatttttggtagagatggggtttcaccatattggccaggctggtctcgaactcatgacctaaggtgatccatcctcctcagcctctcaaagtgctgggattacaagtgtgagccactgggcctggtgcttttttttttttttttttttttttttttttgagatagggtctcactctgtcacccaggctgaaatgcagtagtgtgattttggctcattgcagccttgacttcccaggctgaagtgatcctcccacctcagcctcctgagtagctggggctacaggcatgcaccaccatgctgcgctaatttttatattttttgtagtggtgggattttgccatatcaccctggctggtctggaacccctgggctcaagcgatccactcgcttcagcttctcaaagtgctgggattacaggcatgagccacagcgcccaggctgtagctctcttaaggaggaacatatctcatctgagacaaacctgaaatgccaaaccaaactgagttagcccctctctgtctgttgtatatattggagtaataacctatttgtcttgataaagggattgcatgcttgaattgcaaaaacctttatttcttttgggttgcccaatgtgcaagactaagagttattttgataaatttctcaccaggctgactgtctctctgtggggtcgggggagttttcagggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaaggtactcactgcttcctgctccccagtactgagcccagaataaaagacgatctcaggctaggagctcaggcaacatcttagtccggtctcatctgttcctggatgtccctcagacccccagctttcatcttttaggatttattccttccctgggataatataatttgtggtccaaaaagaacatcatcaaaatttcaggcagaatgggccaggaaggccattctttcttgatgagtgtccccaaatcatctccaattaacagacaaggagcttgaggttagggaggtgagggtaacactgtctgtaagaggcagagctgggactcaaattccagatttcagattccaaatcccatcgttttttatctctacaatgatgcctcccatctgggtggtggagagaagggaggcgtgtaaaatgtcagccccagaaggacaagagcaagccagtgtgagcggaattgatggctgcaagctgagacttggattggagacgtagtgagactcaggattgtgcagtgctgcagggaagtggttgctggatagaggcatgggctgaaccaagcagctggactgagactgggggacagaactccaaagcccactgagatgtgggaaaacatggagaagcacacggagcattcacaacttattgccgtcagagtcaatacatgggtgaggtggggattgggcaagagggaaagcgtcagccttccctgatattctggaaagtctcccggggctgggggtgggcaggtacagagcttcgagctctgctgatcgctgacatccaggggtgggggtaggaagagacctgggccgggagaagtccacctcaagcctgcagtgtcacactctatccctccacagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagcataacagagaatcctttttttaacggtgatgcgctgtagaaatgtgactagattttctcattggttctgccctcaagcactgaattcatctgaaactcttggtttcccctggaggccatggttcctgggcaccttgacctgggcaatcccaagtgtggcctgaaccccctttcccttggggattgttcaggtgtccctagacgccttgtggtattgtacctaatacccatgaagggagaggatgatattacttgccagtgtacacccccctgtgatattgttcataatgtccagagtgaagaaagatgatattactcccaatatcacagaaggtgtacacccccccttgatattgttcctaatacccagttggggaggggagaatatctctctcaatatacaaggggtgtttaaactctctgtgatattgttcctaatattcaggggggacaaggatgatattacccaaatattgcaggggttgtacaccccccctttgatattgttcctaatatccaggggtggagaggatattactcccaatattgcaggggtctacatcctccccccgtgacattgttcttaataaccaaaaggtgagaagctgacattactcccaataccacagggggtgtacaccccctatgagatattgttcttaatatccaggaggggagaaaatgatattactctcaatagcgcagggaatttacatcccccgtcgtaatcttgttcttaatattcaggaagggagaggatgatacgactcccagtatcgcagggggtgtgcacccccccgtgatttttttgctaatatccagggtgggagtggataatacgcaggaagtgtacaggtctctgtgatatttttcctaatatccaggggggagaggaagatattacttttaatagtgtacggggggtgtacacccctctgtgatagtgttcctaacatcttgggagggagaggatgatattactcccaatatcgcagggggtgaaaacttttttttgatatttttcctaatatccaggggtggagacgatgaaattactcccaatatcacagaaggtgtacactccttttgtcatattgttcctgatatccagggtaggagaggatgatattacttctaatatcgcaggaagtgcatacgcccttgtgatattgttcctaacatccaaaggaagagagaatagtattacttccaatatcgcagggggtgtacagccccccttgtgatattgttcctaatatccaagatggagaaatttctattattctcaatatcacaaaggatgtacaccaccaccgtaatattgtttgtaatttccagggaggggagaggataatattactcccaatatcgcaagggttgtacacccctctgtgatatttttcataatatttaggggtgaagaggatgatataaatgcaaatatcacagggggtggtcactgtcttgtgatattgttcgaaatatccaagaggggagaggatgaaattactctcaatatctcagcggggggtacacccctctgtgacattccttgtagtattcaggggaagagaggataatattactcccaatgtcgctttgggtattcattcccctgtgatattgtttgtaatatccaggaaaggagacgatgacattacttttaaaatctaaggggtgtacacacctctgtgatatggttcataatatccaggggaagagaggataat

SEQ ID NO: 14643 - DNA, 9622 bp, Human
cctttgtttgccattgttctctaaccactcacttccctctccttgtactgaggcagcagctcttgtacggcatcagcaaagagcttcgcgtagcgcctggcattctcacaaattgagtccaccaactcggggtcatcctcggctacgtcgtccaggtccacatacagagccacctgttcccgatgagccagccgaacctcaagtggggaagagacagaaacacctcagagccacattcactttgctcaccagtgttcatatgtgaaaatgcatcactgagaactcagcacaggctctgggcatccacaggggagaacgcagcgccacacagagcgatactcgcttttcagccctcaaaccctctaattgttatgtctttaataaaacaagccaagctgctgcttatggctccttaagcaccccgctccccattccctttacccaatcttagacttaccaactggttcccatacttgaactgcttcttcccgagttcatcatcctggtagaactcttgtaagaacttcttaaccttttctgtaacatgaaatgtaaaaccgtaagacacaaactttaagacaaatcttagatacccattttcgcttaaaacacgacctatgaactaattaataatatgagcatttaaataaacctaccgaagtctccccaaagtgggcataactctttttcacaagtctgtttctaaccagcgaagaataaagagcccgtggcagtgcacagggccatccaacatctccccaggggaattccggtccctactttagtttaaaattctagcgcccttccccgttggcccctcacactccggtctcaaggttctcagctttctttccacccctatgatcccccgccttctttgggtccccttagcccctgatttcaccgggacctccgccaccgcaccccgccaccgcaccccacccccgctcccgccatcgcttccgctcttagtaaacaaagaagcacatgggcccggattccagccgcttcacagctcgggattcctccgcccagggcgggagccagtccagccattggccatcacacccagagacaccgcgatcccagcccactgccgcctttcccgggcccgagcgaagctccggatcccaggcacgcccccccgggccgcagctctctccgcggccgccgcgcggaaggacactgtttacacgacactccctccagcctcctcgcgccacttccgcccggctccacttccgctcggagggcggcctcaaacggccaatcccggcgcgcagcggccccggcctgcccgcccccggggcctacgcgcgcctggggagggcgcgggaacctgggaatgcccaaaagcgcgaaggaaagcgggcacgggagcccagagcccttaagactctcctgaggtcctgggcgcgacttttccctgtgcagcccccagccgggttagcgcgcccccaagcccccaaccccacgaccctaacacctttaccaggtgggattactagcttttcttcaacatcgatggccccccgcacgcttcccaggccccgtgggccttagccaggccgcagctcgaccctgcctctggcctcgcgcaccccagaacccgccgaccccggtcccccaagaccccagctcacaccaacaggtgttccccgggaggctccccgcgcaggacgccctcccgggctcgtagacccgtacccttctctagcgcgtagtccttcagtgccatcgctgccgagggccgtgcggccgcgcttggcgggctcagaggtcttgctcctggggaagctgagaatctccgcgcggtggactgtggccggccaaccgaaattggcgcgaaacgtcgccccccacgtgaccggcgccactgcgtgcgggccaatcggacaaggcggccttcttcacctcccgctagccgcaagccaatcaccgtgcgggcctagaatgagtgacggggaggcggtgcgggcgtcggaagggaatctccgggcggggtagtgcaggcgccgggtttcccgcggtccgagctggcgcgggcggaggagaatcgctcttaaagggccagcgcacacgcgttcttttgttccggggccgcagggcggggcaggcccgactttcgccgtcttcttgtctactctccagaacggccatgatttcccaattcttcattctgtcctccaagggggacccgctcatctacaaagactgtatcctagacccttggggctgggaaggggcggaggggccgggcgggaggggcgcccagggccagcctgtgtcgcaggatccttcactgagtccttccacccgccagtccgcggggacagtggcggccgggatgtggccgagctcttctaccggaagctgacgggactgccaggagacgagtccccggttgtcatggtaaccagtggcgggaggcgggtgaggagcggggtcccgtcgggccgggtgggcgccagctccctcccaggactggttcattggtagattccacttggggggtgcattccgccaaataaagctaacgtgaggcccggcgcggtggctcacgcctgtaatcccagcactttgggagaccgaggcgggcggatcacctgaggtcaggagttcgaaatcagcctggccaacatggtgaaactccgcctctactaaaaatacaaaaaaaaaaaaaacatagctgggcgtggtggcgggcgcctgtaatcccatctactcgggaagctgaggcttgagaatcgcttgaatccaagaggcagaggttgcagtgagccgagatccggacaccgcactccagcctgggagacagagcgagactccctctcggggtaggtgggggtggggaaaaaaaaaaaaagagtcaatcgggcgccagcaacacaccaggcccagctccctgcgtgactccatcctcagcaactcggggtagttagtgtaattaaccccctttccacattgggaagctgggcccaggcatatgtcatgtatctcccaaaggcactgctgttgtgactagtaagaggcatcgggatccgagctcaggtctcctgggttctgatcactccacctccctttttttaacgcctctcttctccctgcctgtgtctcagcatcaccatggccgtcatttcattcacatcagacacagcggcctctatttggtggtcacaacttcagaaaacgtttctcccttcagcctcctagaactgctctccaggtgaggagggttgggctgggcacctggtagctaggaggggtctgagaggaggagaaaatacacgctccaagtgtttcctcaggttggccacccttctgggcgattactgtggctccctgggcgaggggaccatctcccgcaatgtggctctggtatacgaactcctggatgaagtgctggtgagaatcaacaatccccttctgtggcccctacccaattcccctgaagatacatctgctcttctactgtgggatgccgtggttaggaggccaagtctaccttttttttttttttttttttgcttttagagacagggtcttgctctgttgcccaggctggactgcagtggtgcagttatagctcactgcagcctggaactcctgggctcaagccgtcctcctgccccagcctcccctgtgcctagctaattgtttattttttgtagagactagagtctcgctgtgttgcccaggctggtcttgaactcatggcctcaagccattctcctacgtctcggccttccaaagcgctgagagtacaggagtgagtcaccatgcctggccccactccccctctttaccccttccctccactgatcactcagactgtccttcctttaccactaggactatggctatgtacagaccacatccacggagatgctgaggaatttcatccagacggaagctgtggtcagcaagcccttcagcctctttgacctcagcagcgttggcttggtcagtagagggaaagaggagggtgaggaaagaaaagaggggttggctggggttgtcagacctgatgattgattgctttggatgctttacagtttggggctgagacacaacagagcaaagtggcccccagcagtgcagccagccgccccgtcctgtccagtcgctctgaccaggtgagggaaggatccatggggtcagacgctctggttttgctctgggatccgggagtccaagatcttaggtcgggcacagcggctcacgcctgtagtcccagcactttgggaggccgaggtgggcagatcacctgatgccaggagtttcagagcagcctggccaacatggtgaaaacctgtctctactaaaaatgcaaaaaaaaaaaaaaaaaaagaaaaagatcttggcacatctcccacccccccagatgtgggtggaggtgggagatgatcccttccatcacccatgtcctcaccctagagctgtagctttgactgtcctgttctttctccctgtctgtccatttcagaacataggctattctgcttccaaccacccaaattctctctctttctcagagccaaaagaatgaagtttttttggatgtggtcgagagattgtctgtactgatagcatctaatgtaagtttgagctcccaaacctggagctgaggacagatgggacttgggaaacatggtggggtggctaagactcccagcaacggccgggcacagtggctcatgcttgtaatcccagtgctttgggaggccgaggtgggagaattacttggggccaggagtttgaaaccagcctgggcaacatagccagaccccgtctctacaaaaaatacaaataaacaaattacccagacatggtagtgtacacctgctgtcccagctacttgggaggctgagccaggaggatcacttgagcccaggaggttaaggctgcagtaagccaagatcgagtcactgcacgctagcccggatgacagagcaagaccctgtctcttaaaaaaaataaataagtaaaaaaggctgggcacagtggctcatgcctgtaatcccagcactttgagaggccgaggtgggtggatcacttaaggtcaggagtttgagaccagcctggccaacacagtgaaactccatctctactaaaaatacaaaaattagctacttatggtggcaggcatctgtaaccctagctacttgtgaggctgaggcaggagaatgtcttgaacctgggaggtggaggttgcagtgagccgagatcacgccactgccagcctgggcgacagagcgagaccgtctcaaaaaaagaaagaaaaaaagactctaaccttgacgcccctgcctctcagggatccctgctgaaggtggatgtgcagggagagattcggctcaagagcttccttcctagcggctctggtgaggcatctgcaggcaggaccaagggttggggttagggcgggttccttggtgtcttaaaccatggcattgctgagctctcctgatggtctctcctccgacagagatgcgcattggcttgacggaagagttttgtgtggggaagtcagagctgagaggtgaggagaaagtgggtctttctccccttggagtaggtcattgccagagttcatggagagaagtcagacagagcctcccctctccttgctcctctcccaaaacaggagtcaggagagaagtctctctctctctctttccaggttatgggccaggaatccgggtcgatgaagtctcgtttcacagctctgtgaatctggacgaatttgagtctcatcgaatcctccgcttgcaaccacctcagggcgaggtcagggttggggtggcctcataaattccgtccaccatggggaagggggcagtggggtcgtgagaccaaactaaccttgttgctctctggtctctcagctgactgtgatgcggtaccaactctccgatgacctcccctcaccgctccccttccggctcttcccctctgtgcagtgggaccgaggctcaggccggtgagacaatttcctgggttctagaactaccttggaacccaagccaagacctgtatgttcccaagactcactgcagagtgggggtggtggtagtggtgatggagtgcaaattggaaaaaggcttgggttgcggccggtggctcacacctgtaatcctagcactttgggaggctgaggcgggaggatcacttgagcccaggagttccagaccagcctgggcaacatagtgagaccccatctctctgaaaaaaaaaaaaggaaaaagctttggctaatggagttgggctgggcttcagcccttttccctcttgggagtacagcccacacccacacagccccacatggaggtccctggtggggaatggtgagatgccagtagaagatggcctgagtcgtggtgttttaccctctcatccaggctccaggtttatctaaagttgcgatgtgacctgctctcaaagaggtaagagtgaggctggcctggctgagttcagctctatgggacggaagacagggccagggcacctgctgcttctcccttcagatgcagctgccagcctcagaagccagttaaggtagaggctgtagaatttgggaaggtggggggcacctgtgctgaaatcctgttatgacattgaagaggaacaggacaagggactgtgccttcctggggctgactttgttcccgtctcctctgtagccaagccctcaatgtcaggctgcacctccccctgcctcgaggggtggtcaggtgagtgtgtgcacccaccacggggagattcctggggagagagtgagctcagcatgacgggtctgcctcaagaaggtgccaagcccagcaccttccctttccaaactccagcctgtctcaggagctgagcagcccagagcagaaggctgagctggcagagggagcccttcgctgggacctgcctcgggtgcaaggaggctctcaactctcaggccttttccaggtattcgctgtggacccccagcccctctcctcccacattcacttgcagcccccaccccaccctcccgaagcagctgctgcctggttcccccagcgtggtcagcttcttgccctccttcctctccctgcctctgcccctcacagatggacgtcccagggcccccaggacctcccagccatgggctctccacctcggcctctcctctggggctgggccctgccagtctctccttcgagcttccccggcacacgtgctctggcctccaggtccgattcctcaggctggccttcaggccatgcggcaatgccaacccccacaagtgggtgcgacacctaagccacagcgacgcctatgtcattcggatctgaggctccccaaacgaggacacgacggccaaggtggcagtttgtcccacgggaggacagtcgtttcttttccagcctcctggccttcggactctgaatctgggcaggaagagtcctcagtcccaagaccaggagggggcaatgggcccagcctttctgtggtatctgatgcaggaaggactgcagtggatcagaacttacaaaccaaacttttattctgagaaactggctgtacaatatctaaaaagaaagtgacatgaaggaagcaatctacaacttccttccgcttagcgtgcatgcatgtgtgtacgtgcacgtgtgtacgtgtctgcatgtgtgggaatccgggggctggcaggtggagcatcacggagcaggctgaggggagccggagttgggctgggagccattggcttttggagtccctggagctggagggggactgtccccagcctcctgcttccccccacaaagggcactgccgctgagtggggacggggacgatgccgggggaggaactggagaaggatgggaggtggggcctcctttgccctcccctgttgggggaagtgagaccacgatgtacttctggacactcccaggaccagagggagcagtgctggggggtgcggtggtggcggtggagaccaacttgacgatgggctgcacgctggggacggtggtggtgacgggcgaagtggtggtggaacctgagccgggggccgaggtgctgagggacaggacctggatagaaaggaaaggcaggccgcttgccctgtgccctccctgccccccagaggcctggcgaggacgcttcactcgctccctgcctgaacaagttgttcctgtagttcaccctgtagacagctatggctggagaccttgttcatgcagggcagctacagccctgcaggaccctggtgggcgcctcttccagctcttgacttggggcccagaggggactgtgctctactcctgggcctccccagggtgctctgaggtaacccaggccctccagatgctccctgtcccacagctctgcatacctgctgggtggatggggcgctggaggacgatgacattacaataaacttggttggaggaggggaaggctgtggtggggcagccgctcgtgcagacaccagtgtctggacaggaagtgcgatggagccaggaaccttcagcaagccaggggtgcgagggccaggctgtggggcctgcgagagggtcagcgtgggccggggctgcggggagaagaggaaagggggaagtggcaccatctactaagaagaggagtctgaagggagaggcctgggctcccctcgctcttcctcagtggctctcactagggctggggcatcctcactcagggcctggttgccctgagactactgactgagggcacatgtggctgtgtgcaagtgcctgtcccacacaggggttctcctctgcttcctcctattcctcctccccacccggccacggacctgcgtgatggtcagagtggtcctgttgacctgctgagcctgcagagcagcctgggcccgagccttgaccacctgggagcagaggaggggcccaagggacccgaattctgcccgataggcgtcctgattgtcaggcggtgggcgcagctttgccagaacaggagcacagtgtttctgcagaacagaaaaaaagccaggtagagggagggctggggaaaaaagccaggtagagggagggctggtgacactcttgagaagaaccttggggatggggtaaaaaaggacattccttatcatctcagtgcccctgttggaggccaaattatgctgaactattagtgtgtgtacagaacactgtgggctttctcataagaaaagatgggcacggggccaggtgcagcatcttaggcctgtatcccagcacttgggaggctgaggtgggtggatcacttgaggtcaagagcctggccaaaatggagaaacctcatctccactaaaaatacaaaaactagccaggcatggtggcacgcacctgtagtcccagctactggggaggttgaggtactagaatgcttgaacccaggtggtggaggctgcagtgagcagaggttgcatcagtgcactcccgcttgggtgacagagtgagactgtctcagaaaaaaaaaaaaaagaatggctgggtgtggtggttcatgcctgtaatcccagcactttgggaggctgaggctggcagatcacctgaggtcaggagctcaagaccagcctggccaatatggtgaaaccccgtctctactaaaaatacaaaaaattagc

SEQ ID NO: 14644 - DNA, 9622 bp, Human; identical to SEQ ID NO: 14643

SEQ ID NO: 14645 - DNA, 16347 bp, Human
  misc_feature (1)...(16347): n = A,T,C or G
tgagaccatcctggccaacatagtgaaaccttgtctctactaaaaatacaaaaattagctgggcatggtggcgggcgcctgtaatcccagctacttgggaggctgaggcaggagaatcgcttgaacccgggaggcggaggttgcagtgagcgagattgcaccactgcactccagcctgggcaacggcatgagacgctgtctgaaaagagaaaaaaaaaaaaaaaaaaaaaaaaaaaaaaaatatatatatatatatatatatatataaaattaatacaattggataataatagtatgtccctcataggagtgtgatgaagattaaataaatcaacatatataaaggctggcacatagtgagcactgtataagtattcactgttatcctgcagttatttattgagctccttctgtatgcatactaacaatatagacagcaataagacctattatctctatctacaggtctctgtcagtgtagttgggacagataaaccaaggatgacaagctgtggtgaagctgggcctgaactcatgggctcaagtgatcctcccaccttggccttccaaagtgctgggattacagatgtgagccactgtgcccaggcccgttggctgtattctgatagaaggcctgcagaggtgttaaagcaaggactgatacaattaggtgattaagtctgtttaaaaagattgacaggtcaggggagaagagcggcacacggaggtgaaaggagacagagatgaggaccaagtcatgagactgtcatgactgcctttcatgatactggaatacagttgagggggtgaagcgaagagaaaaggaatccagggaagaaacgtaaagtcaggagggcagcaaactagggcatcagggccagccccctttctcaactgggccccacgctagtgcagctatggaaggcgctgcttgctgaaaaatccatatagtacgcaccgtctgcaaagtctcaccggatggggacactctcctagttgtgtggcttccttttgtttatgagcttcaaaggctgaattactcaccctcaaaccccctcagcggggtgtggggcctgtaatttgggagcgtctatgctagggtagggcagcggatgtccacaaggcctgagcctcacacccggctcctgcagcctctgcagattaaggtctggtgacatgaggtaaacactcactgaagatgctctaaaagttggcagtcccgggccgatggtccctgaactacaattcccacaatccattggcgggcggggggttccaagccagccaaaaaaatgcaggctctctctggatgcagtttgaggtggcactacacgttcgcttccttgaccccatccaaattcagccaagctccaccagaacctccctcaagccttcaaggaggtcgggtgacccacccaatacaggctaggatgtccggcctagaagaaggaggtgtggccgggcgatgcctataggggctacccccttcaaataccttcgcatttgctgggcaagcgttctgtgtcatcgtcctcctccttcaacatcccagcccaagcctcgtgcacggccaaaaaaaggaaaagcaatattcccaaccgcacaggtcccatgacaaagcgccgtctacaaacaatcaccgcttgccttcaacttcgggaaggtagtgtgggtcccttaaattcccaggcggctagcggcaaccttaaatccagccgaggaaggtcggcgcatgcgcaggatcagcccaacaagggtggggcctcgttgctacgggtttccctgcctccgttttgtggcgcctcttgaaggtcctggcagccgggtagtgaaggaataaattgcagtaattacaccaagagggagtgctccttatatatagatgtagaaacaaacttttaaaatataatttcattctgcgagcctagaggacttattctggtacggggaaggggcagtgacttgctcttaggctctgccaggacctgctcccacgagggggcggggccaagatggcgccgagcgccgggtgagcagcgtctcggctgccgctagagttttcctgctccccgcgctcggctggcgggggcgggtctgagtggtaccccggaggagaccctttgaaggtcccttgtggggactggaaagaggacggttggttgtgtgtctgtgctcgtggggaccccgtgtgtgtgcctgcattggagagatgttgcaggagatggggtgggctctctgaacctcctttcgcgctgcccggggatcttcgacctgcttctctgctgggatctcgcttaagttaacccttccctgggacgccttcctgccgcctccactgatctgaggagatcctgtgactgtagcgtgttttatgagcctttactggcagagggtaccgccgggtattgaaggattcgtaggagttcgccagggaagtgggacacgaccccctcttgtaaacccggcgccaggcacagagtatgtctcgaatagttgtgttccctatagataagacttataaaagtcggggaggagatcagggatggtttgaaaagaaccaatttgtttttcggcctccctcttcccatccttccagcacggccccaccctacctgtactactcctaagcagtattgatatgttaatcttcctaatgtccaactgcaagtgtgccactttaatttttttttgttttttttttgagacagggtttccgtctgttacccaggctgttgtgcagtggcaccatcttggctcactgcagcctccaactcctcagttcaagcgatcctcctgcctcagcctcctaagtagctgggatgacaggttcacaccaccaggtccgtctaattttttaatttttgcagaaatgggggtctcactatgttgaccaggctgtctcaaactcctggcctcaaacaatccccccacctctgccttccaaagtgctgggattactggggtgagttacctctcttggctccaatttgctttttttttttttttgagatggagtctctctctatcgcccaggctggagtgcagtggcacgatctcggttcactgcaacctccgcttcctggttcaagcggttctcccacctcagcctcccagatagctgggactacaggcgcccgccaccatgtctggttaatttttgtgtttttacaaaaagacagggtttcaccatgttggccagggtggtctcgaactcctaacctcaggtgatcttcccgccttggcctcccaaattacaggcgtgagccactgcacctggctccactttgctttttttgtttttttttttttttttgagacagagtctggctctgttgcccaggctggagtgcagtggtgcgatctcggctcactgcaagctccgcctcccgggctcacgccattctcctgcctcagcagcctcccgagtagcagggactataggtgcctgccaccatgcctggctaattttttctattttttagtagagacgaggtttcaccttgttagccaggatggtctcaatctcctgacctagtgatccgcccgcctcggcctcccaaagtgctgggattacaggcgtgagccaccacggccggcccagtttgcttttaactacagtgtaggctcaaagcttgggcctatgacctattaataatagtgataccaagtatttactgagcaccaatatctctaagccttacaactaattcatttacttcacaaatatttatgatgtcccaggctgggctcctggaatacatcagtgaacataataaagagctctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgaaactctagctcaaaaaaaaaaaaaaaaaaaaagagccctgtctagatggtggacggagacggggtctcactctgttgccaggctggagtgcagtggcacaacctctactcactgcaacctccacctcctgggttcaagcaattctcctgcctcagcctcccgagtatctgggactacaggtgcacatcaccacgcccagctaatttttgtatttttagtagagatggggtttaaccatgttggccaggatggtctcgatctcttgacctcgtgatctgcccacctcggcctcccaaagtgttgggattacaggcgtgagccactgcgccatgcccaaaagatgttaaatgctatggaaaagaaaaagtgggctgcccccactctgagggcagagtgcagagttaaatagggtggtcagggtaggcagccaattagatatttgggaagaacattccaggcagagggaatgcagcaaaggctattaagcaagtacatacctggcaagtttaaggagcagccagaaggaatgtatgtgtctggatcaaagtggaagaaggaagggcgttcagagatataatggggagaaggtaattttgaagggctttgtaggacattataaggatttcgtctgttttttttgttgttgttgttgttgtttttgagaagaagtcttgctttgttgcccaggctggagtgcaatgacacagatctttgctcactgcaacctccgcctcccgggttcgagtgattcttctgcctcagcctcccgagtagctgtgattacaggtgcccgccaccatgcccatctaatttttttatttttagtagagatagggtttcaccatgttggccaggctggtcttgaactcctgccctcaagtgatccgcccaccttcgtctcccaaagtgctaggattacaggcgtgagccactgtgcctggcctgagatggggttttgctatgttgcccagggtggtcaggaattcctaagcccaagcagtcttcccacctcaccctcccaaagtgcacagattacaggcatgagctgagccactgcacctgcccattataaggatttcaggttttactttatggcaagtggagagccattatgagggtttgagcaaagaaatgacaatctgctttacagtttgacagaagcattttggctgcaacgttaggaatagatgtagagaaaggcaagggtagactccggttgacattgttaggaggtttttggagttacccagtggatagatgatggtgacctgggccaagcagtgggagcagaggagtcaggttggactacctggtggattgattgatttttgagacagagtctcgctctgtcgccaggctggagtccagtggcacgatcttggctcactgcaacctccacttcccaggttcaagtgattctcttgcctcagcctcccgagtagctgggactacaggtgcgtgccaccacgccaagctagtttttgtatttttagtagagatgggatttcaccatgttggccaggatggtctccatctcttgacctggtgatccgtccgcctcggcctcccaaagtgctgggattacaggtgtgagccaacgcgcccgaccggatttatttttttaccttttttttttttttgagacagagtccatctgtcactgaggctggagtgcaatggcgcaatctcaactcactgcaaactctactgccgaggctcaagtgattctcctgcctcagcctcccaagtagctgggattacaggcacgcgccaccatgcccagctaatttttgtatttttagtagagaaagggttttaccatgttgctcaggctggtctcgaactcctgacctgaagtgatccacccaccttggcctcccaaattgctggaattacagacgtgagccaccgcacctggcctacctggtggatttgatgtgaaggctcagataaagaacaagtgtctggatggatggcattgctatgaagataaggaaagctgagcctgggccagacacttcggctcacgcctttaattccaacactttgagaggccaacgctggaggattgcttgagcccaaaacttcaaagtggtgggattgaagccctgaggtgtaacagaaaaagataaaaatctgggctgggcctggtggctcaggcctgtaattccaacactttgggaggccgaagcaggaggactgcgtgagcccagcagttcaagaccagcctggacaacatagtgagactctgtctctgcccctgcccctgcaaaaaattggctgtgtgtagtggtacacacctatagtcccagctacttgggaggctgaggtgtgaggattgcttgagcctaggagctcctgggctctatcagttttcccacctctgcctcctgagtagctagaacaacagccctgtgcctgcatacccagctaatttttgtattttttgtacagatggggtctcactgtgttgtccaggctggtcgtgaactgctgggctcaagcgatcctcctaccttgggctcccagagtgttggaattacaggcatgagccactaggcccagtccagattttttttttttttttcctgagacggagtcaccctggctggagtgcagtggcgtgatctcggctcactgcaacctctgccctctggtttcaagtgattctcgtgccttagtctccctagtagctgggattacaggtgtgcactaccacgccctgctaatttttgtatttttagtagagatggggtttctccatgttggccaggctggtctcgaattcctgacctcaagtgatccgcccgcctcgtcctcccaaagtgctggtgggattacaggcgtgagccactgaacctggccccagcccagatttgtatctttctctgttacacctcagggctgactcacgtggggatggacataagacactcggagttcctcccctgtctccactgtcctccctttgttggccctctccctgtgtctcacgtttctttttcttctgcctgccccgttcctctgccagggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggtgacccggcccttctgtccagctctacattgggtccatgtcacccagggccccgtccttaggattttgggctgatgtctgttctgtcaccgaccccaggatgccttgaagttcatgcacatggggaagcggcagaagctcaccaccagtgacattgactacgccttgaagctaaagaatgtcgaggtgatttggggagacaggcgggggggggtgagacgccatccttcagccaggtctcctccggctcccttcttacccatgcccctctctcctgccacagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaaggttgggggaggggagagcagggtggcagggaggagggaaaggaggacagatgtgtgtaggtgtgaggagcctcacaatagaagaaaagctcagtgtgagatccctggtgagttgcaaggggagcaggagtggaaacacgcttccatagcatggggcaactccccaatgtccatgcgtggcaattcaccttgacacctgccttccttgcagctcattggctgagcatcgagggctgccagccagctatccccgagaacccgcccccaggtaacctccatgccccaccctctgggtctctgggtccctttccccttccttccaccttttttttttgagacagagtctcactctgttgcctgtgctggagtgcaggagtgctggagtgcagtggctcaatcttggctcactgcaaacctgtgcctcctgggttcacgcgattcttgtgtctcagcctcctgagtagctgggactacaagcacacaccaccacgcccggctaattttttgtaattttagtagacacgaggtttcaccatgttggccaggctggtctcgaacttctgacctgaggtgatccacccgccttggcctcccaaagtgctgggattacaggcatgagccaccgcatccggcctcctcccaccttttacttttctactatgctcatcacccctcccgctgtgcctgctttcccaccagctcccaaagagcaacagaaggctgaagccacagaacccctgaagtcagccaagccaggccaggaggaagacggacccctgaagggcaaaggtcaaggggccaccacagccgacggcaaaggtcagtcctcctaggctaggcctctctggactcttgcccaaagccacatggccgtttgttttgtttcctttttttttgtttttgagacagagtctcactctgtcacccaggctggagtgtagtggtacgatctcagctcactgcaacctccacctccagggttcaagcgattctcctgcctcagcctcctgagtagctgggcttacaggtgcccaccaccacgcccggctaatttttgtaattttttttagtagagacagggttttgctatgttggccaggctggtttcaaactcagcctcatgtgatccgcccgccttggcctcccaaagtgctgggattacaggtgtgagccaccatgccaggcctccatgtggccattggtgaagtggctgaggtcagggccagagccccagaaaggatgggggagcctaagaagaagccaggtctcctgggtctcaggggaagtggagggttaaggttcttctgttactgaggtttcttctggagctttctttgtcagacccacctttccaatcacacagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcggtgagggccccaccagcttgccctggccctgagacgcctcctcctgggggccctatgaattgctccccacatcccacccccacctgactggcttccctcctcccacaggaagccctgcaaagcattgccacggaccctggactgtatcagatgctgccacggttcagtacctttatctcggagggggtgagagcatgaggttccacagtgcagggacggcagtggaagctcctgtgagggtctccctgccccatgcccagcacttctccctcccacaggtccgtgtgaacgtggttcagaacaacctggccctactcatctacctgatgcgtatggtgaaagcgctgatggacaaccccacgctctatctagaaaaatacgtgagtgatcctgcccatcctcccttccagggactagggaccctgctgccaccaacaggaagtcagtggtcagcagtggctcacacctgaaatcccagcaactttgggaggccgaagtgggaggattgcttgagctcaggagtttgaggacagcctgaggacagtagtgagactgctatctctacaaaaaaaattaaccaaaacaaaattagccaggcatggtggtgcacacctgtggccccagctacctgggaggctgagatgggagaattgcttgagcccgggagattgatgctgcagttagccatgattgtgtccctgcacaccagcctgggtgacagagcaagactttatctcaagcagacaaacaaaaccagaatcagctgtcccgccctttctcccttaggtccatgagctgattccagctgtgatgacctgcatcgtgagcagacagttgtgcctgcgaccagatgtggacaatcactgggcactccgagactttgctgcccgcctggtggcccagatctgcaagcattttagcacaaccactaacaacatccagtcccggatcaccaagaccttcaccaaggtgagccaggaaaacttgagcgtcatttgcttcatcactggccacctctggttgggggaagtcacactggaaacaagggggcagagggaagagggactggaacttgtgggggtctaagggtcttgaggcttgtctgtaataccttttttttttttttttgagatggagtctcgctcttgcccaggctggagtgcagtggtgcaatctctgctgaccgcaccctctgcctcctgggttcaagcgattcttctccctcagactcttgagtacttgggattacaggcacctgccaccacaactggctaatttttttgtttttgtttttttgagatggagtttcgctcttcttgcccaggctggagtgcaatggtgcaatcttggcttaccacaacctccgcctcctgggttccaatgattctcctgcctcagcctcccgagtagctgggattacaggcatgtgccgccacacccagctaattttgtgtttttagtagagacggggtttctccatgttggtcaggctgctctagaactcccgacctcaggtgatctgcctgccttggcctcccaaagtgctgggattacgggtatgagccactgcacctggccacaactggctaatttttgtatttttagtagagacagagtttcaccatgttgactagggtggtctggaactcctgacctcaggtgatctgcctgcctcggcctcccaaagtgctgggattacaggtgtgagccaccacgtctggcctcattgtaatgtcttaatgatttacaaggaaagtgtctatgaaagacttaggtccctatcaatcatcctttcagaccccttcatcttagtttatttccttccccttacagagctgggtggacgagaagacgccctggacgactcgttatggctccatcgcaggcttggctgagctgggacacgatgttaggcctctgggaggaagaaatgggggaggggacacagtcatgaggttatagagggcactgtacccccatctgggagaccctggtgaccctccggcttttgcttgtccttttcccttctaacaggttatcaagactctgattctgccccggctgcagcaggaaggggagcggatccgcagtgtgctggacggccctgtgctgagcaacattgaccggattggagcagaccatgtgcagagcctcctgctggtgactgaagcccctgtccccacacctgcccactgagacacaggcagtgtttagcaagcatatggcatattttattcacttactcccatctttgcctcatgttttcagaggacattgcagagtctgatactattttacagatggaaagactgagattagactgagtaagaaataagggggctgggcatgatggcttctgcctgtaatcccagcactctgggagcctaggagtatgaggccagcctggacaacgtagcgagatcccacctgcaaaaaaaaaaaccaaaaagccgggagtggtgacatgtgtctgtggtcccagctactagggaggccgaggtgggaggattgcttgaacccaggagttcaaggctacagagagctatgatcgtgccactgcactccagcctgggttacagagggagaccaccgccccccaaaaaagaagggtttaacacgctcagcctgtggcatttggaccatccttccccaatgctcctgttactctgtggtcttctctgtacaaggcaaatgcgctcttgattaaccatcctgccacagtatttagcaagttcattcacacattagtgcccatgttttctttttcttttctttttttttttttgagatggagtctcactctgtaacccaggctggagtgcagtggtgcgatctcaggctcactgcaacctctgcctctcaggttcaagcaattctcatgcctcagcctcccaagtagctgggaccacaggcacgcgccaccatgcctggctaattttttgtatttttagtagagacggggtttcaccatattggccaggctggtcttgagctcctgacctcaggtgatctgccagcctcagcctcccaaagtgctgggattacaggcatgaaccaccacacccagccattcttttttttttttttctgagacagtctcactctgtcacccaagcgggagtgcactgatgcaacctctgctcactgcagcctccaccacctgggttcaagcattctagtacctcaacctccccagtagctgggactacaggtgcgtgccaccatgcctggctagtttttgtatttttagtggagatgaggtttctccattttggccaggctcttgacctcaagtgatccacccacctcagcctcccaagtgctgggatacaggcctaagatgctgcacctggccccgtgcccatcttttcttatgagaaagcccacagtgttctgtacacacactaatagttcagcataatttggcctccaacaggggcactgagatgataaggaatgtccttttttaccccatccccaaggttcttctcaagagtgtcaccagccctccctctacctggcttttttccccagccctccctctacctggctttttttctgttctgcagaaacactgtgctcctgttctggcaaagctgcgcccaccgcctgacaatcaggacgcctatcgggcagaattcgggtcccttgggcccctcctctgctcccaggtggtcaaggctcgggcccaggctgctctgcaggctcagcaggtcaacaggaccactctgaccatcacgcaggtccgtggccgggtggggaggaggaataggaggaagcagaggagaacccctgtgtgggacaggcacttgcacacagccacatgtgccctcagtcagtagtctcagggcaaccaggccctgagtgaggatgccccagccctagtgagagccactgaggaagagcgaggggagcccaggcctctcccttcagactcctcttcttagtagatggtgccacttccccctttcctcttctccccgcagccccggcccacgctgaccctctcgcaggccccacagcctggccctcgcacccctggcttgctgaaggttcctggctccatcgcacttcctgtccagacactggtgtctgcacgagcggctgccccaccacagccttcccctcctccaaccaagtttattgtaatgtcatcgtcctccagcgccccatccacccagcaggtatgcagagctgtgggacagggagcatctggagggcctgggttacctcagagcaccctggggaggcccaggagtagagcacagtcccctctgggccccaagtcaagagctggaagaggcgcccaccagggtcctgcagggctgtagctgccctgcatgaacaaggtctccagccatagctgtctacagggtgaactacaggaacaacttgttcaggcagggagcgagtgaagcgtcctcgccaggcctctggggggcagggagggcacagggcaagcggcctgcctttcctttctatccaggtcctgtccctcagcacctcggcccccggctcaggttccaccaccacttcgcccgtcaccaccaccgtccccagcgtgcagcccatcgtcaagttggtctccaccgccaccaccgcaccccccagcactgctccctctggtcctgggagtgtccagaagtacatcgtggtctcacttcccccaacaggggagggcaaaggaggccccacctcccatccttctccagttcctcccccggcatcgtccccgtccccactcagcggcagtgccctttgtggggggaagcaggaggctggggacagtccccctccagctccagggactccaaaagccaatggctcccagcccaactccggctcccctcagcctgctccgtgatgctccacctgccagcccccggattcccacacatgcagacacgtacacacgtgcacgtacacacatgcatgcacgctaagcggaaggaagttgtagattgcttccttcatgtcactttctttttagatattgtacagccagtttctcagaataaaagtttggtttgtaagttctgatccactgcagtccttcctgcatcagataccacagaaaggctgggcccattgccccctcctggtcttgggactgaggactcttcctgcccagattcagagtccgaaggccaggaggctggaaaagaaacgactgtcctcccgtgggacaaactgccaccttggccgtcgtgtcctcgtttggggagcctcagatccgaatgacataggcgtcgctgtggcttaggtgtcgcacccacttgtgggggttggcattgccgcatggcctgaaggccagcctgaggaatcggacctggaggccagagcacgtgtgccggggaagctcgaaggagagactggcagggcccagccccagaggagaggccgaggtggagagcccatggctgggaggtcctgggggccctgggacgtccatctgtgaggggcagaggcagggagaggaaggagggcaagaagctgaccacgctgggggaaccaggcagcagctgcttcgggagggtggggtgggggctgcaagtgaatgtgggaggagaggggctgggggtccacagcgaatacctggaaaaggcctgagagttgagagcctccttgcacccgaggcaggtcccagcgaagggctccctctgccagctcagccttctgctctgggctgctcagctcctgagacaggctggagtttggaaagggaaggtgctgggcttggcaccttcttgaggcagacccgtcatgctgagctcactctctccccaggaatctccccgtggtgggtgcacacactcacctgaccacccctcgaggcagggggaggtgcagcctgacattgagggcttggctacagaggagacgggaacaaagtcagccccaggaaggcacagtcccttgtcctgttcctcttcaatgtcataacaggatttcagcacaggtgccccccaccttcccaaattctacagcctctaccttaactggcttctgaggctggcagctgcatctgaagggagaagcagcaggtgccctggccctgtcttccgtcccatagagctgaactcagccaggccagcctcactcttacctctttgagagcaggtcacatcgcaactttagataaacctggagcctggatgagagggtaaaacaccacgactcaggccatcttctactggcatctcaccattccccaccagggacctccatgtggggctgtgtgggtgtgggctgtactcccaagagggaaaagggctgaagcccagcccaactccattagccaaagctttttccttttttttttttcagagagatggggtctcactatgttgcccaggctggtctggaactcctgggctcaagtgatcctcccgcctcagcctcccaaagtgctaggattacaggtgtgagccaccggccgcaacccaagcctttttccaatttgcactccatcaccactaccaccacccccactctgcagtgagtcttgggaacatacaggtcttggcttgggttccaaggtagttctagaacccaggaaattgtctcaccggcctgagcctcggtcccactgcacagaggggaagagccggaaggggagcggtgaggggaggtcatcggagagttggtaccgcatcacagtcagctgagagaccagagagcaacaaggttagtttggtctcacgaccccactgcccccttccccatggtggacggaatttatgaggccaccccaaccctgacctcgccctgaggtggttgcaagcggaggattcgatgagactcaaattcgtccagattcacagagctgtgaaacgagacttcatcgacccggattcctggcccataacctggaaagagagagagagagacttctctcctgactcctgttttgggagaggagcaaggagaggggaggctctgtctgacttctctccatgaactctggcaatgacctactccaaggggagaaagacccactttctcctcacctctcagctctgacttccccacacaa

SEQ ID NO: 14646 - DNA, 16347 bp, Human; identical to SEQ ID NO: 14645
  misc_feature (1)...(16347): n = A,T,C or G

SEQ ID NO: 14647 - DNA, 15125 bp, Human
  misc_feature (1)...(15125): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtggcgcgatttcggacttgaaacaacctccgcctccctggttcaagcaattcttgtgcctcagccacccaagtagctgggactacaggtgcacaccactatacctggctaatttttgtatttttagtagagatgggatcgccatgttggccaggctggtctcgaacttctgacctcaggtgatccgcccacctcggcctcccaaagtgctgggattacaggcgtgagccaccgcgcccggcccctggggtgtttttaagtgaagagttggtgccctgttctgaggcccttggggtcctcgctgtgggggttgctgacccccaagcctctctggtgttttgtttactaacgccgtcatcgggtcacgcagcacagcaacaaacagaccttgtagaacttgagacactgtcttctctgagagctattctggtgatgagatgggcggacctgctgtggggccagcagggttggggggctgcccatctgctgaacctggccttggttgcagtggctggacctgcacctgcatcaggagatccccacatcgctgctcatcctgtcccgggccatgtacctcccggacaccctctctccagccgaccagctcaagtccacactgcagaccctcccagagattgtggtacgtgctgtcggagaccccttttacctcatctcttcataggtggctccgctcttctggggtggggggaggtgtgcaagcgcactcattcctcaaccatgggcgaggagcctgcctcccaccccctcgcgagtgcccccacccagccacctgtccccttccttccatccctcctcaccagccccttgcctgccatcccccgtgtggcacagttgccagtggtcccgacctggccacgtgttggctgctgtggatctgggccgcggcccttggagctgtgtcagcagcgcctatgctccttcccacatgtcaggagtcatcgggcgagcgcagagggcggcccaggggcctcccagcaattgcgggcagcacctcggcagtgccttctgtcctgtgtgtgtgaagcccaggtggtgacggggcaggggacacaggacacaggacagaggtgaggggcagcaggggcctctggtggcttctgggctcacccacagatgtaccctcttctgaaggcaaaggaagcacaggtgaaagtggccgaggtggagggcgagcaggtggacaacaaggccaagctggaggccacgctgcaggaggaggcggccatccagcaggagcaccgtgagaaggagctgcagaagcgctcggaggtggcggtaagcggtggtcctgctccgtgccgcgtggggctgtcctgagccagcctccctagaaacccccgcacgcccacagtcttggcctcccgcatgcttgccctgcagctctgtcctgcatgtttatttcctcctggagtggtcagggaggcagggtgcccgggtgtgagggctgcaactctgacatggggactccccgatggccacagtggtgctcatgggagatataccttagccgtctcagaggggcaagcttagcatatggcagtgcccaccctctcctcagggacttgctgtgaggggcgctggcagaggagctgcaggctcccccagcctctgggctcctcttcaacacgggccctgtggtcctcttgggtcacatgcatggtgcccacccacaggctcagcctcctgctctgcaagtgacagggcagcttgggggagtcttggggagaccagagatggataaggtgctctagcctgttctggagagggccccaggtgacctggcagctgcatggagcctccctagggaccttctgtggcaggtgtgctgcccaatgtcacctgcaggcctgctcccagtgtggcctctgccatatgttctgagcttcggggagcaagaagactgcttctgtgtgatggcgggcgctgggctggtgtcgccttgcctttcagaaggattttgagcccgaacgtgtggtagctgctccccaaaggccggggaccgagccacagccagaaatgcctgacacagtcctgcagtcagagaccttgaaggacactgccccggtgctggagggcttgaaggtaatgaggcaggttctggggccctggaggctgaggagggcatggcctggctttgtggacagttgtggggcagggatggggacaggttagctggggcatctatagccctcagtgagaggagatggtgcaaggggttgaggatgaggccactgggcccctaggaggcttggtggttaggaaaagagtgagtccggccgggctccgcactgtgcctgggtgcacagcagctgacgctgccgtgaacttagcaccctggcccacagtgtggcaggtagagatgccagtcggcaggtttcagggccctttgccagcttgcccagacagtgaaggggtgtggaagccaatgtggcccctcaaggtagagcctcctccacaggcccaacctgctgtcacctcctgtggggtgatctgggcttggagcatcttcagactccccatgcgagcctgtgaggtgcagcctccaggcgcctgtgctgcctacctggggcgcctcctggtaccttccatcttgaactcgcgggctgaagtgcagtggcgccatctcggctcagtgcagtctcagcctcccaggttcaagcaactcttctgcctcagcctcccaatatctgggagtacaggcgtgcaccaccagacccagcaaatttttgtatttttagtagacagggggtttcaccatgttagccaggctggtctcaaacccctgacctcaagtgatcttcccgcctcagcctcccaaagtgctaggattacaggtgtgagccaccacacccagccataaaaaaaaaatttggccaggcgcagtggctcacgcctgtaatcccagcattttgggaggccgaggcgnnnnnnnnnnnnnnnnnnnncaagaggaccacagggcccgcgttgaagaggagcccagaggctgggggagcctgcagctcctctgccagcgcccctcacagcaagtccctgaggagagggtgggcactgccatatgctaagcttgcccctctgagacggctaaggtatatctcccatgagcaccactgtggccatcggggagtccccatgtcagagttgcagccctcacacccgggcaccctgcctccctgaccactccaggaggaaataaacatgcaggacagagctgcagggcaagcatgcgggaggccaagactgtgggcgtgcgggggtttctagggaggctggctcaggacagccccacgcggcacggagcaggacctccgcttaccgccacctccgagcgcttctgcagctccttctcacggccccattttctactaaaaatacaaaaaattagccagacatggtggcatgcacctgtagtcccagctactcaggaggctgaaacaggagaatggtgtgaacctgggaggcagagcttgcagtgggtgacagagtgagactctgtctcaaaaaaaaaaaaaaaaaatttcactttttagcaaatcaaatagaactattctgtaaaaagaatcatgatcacatgggatttgtccaaaaaatgcaaattggcttgaattttttttcttttgaggtgggatctcactcttttgcccagtctgcagtgcagacatgaccttggctcactgaagacttgacctcccaggctcaagtgattctcctgcctcagcctcccgagtagctgggattataggtgcccaccaccacacccagctaattgttgtatttttagtagagatggggtttcaccatgttggccaggctggtctcgaactcctgacctcaagtgatcctcccacctcgacctcccaaagtgctgggtttacaggcttgagccactgtgcctggccaaaatttttaaaatgtaatttccatattaacagactaaattagaaaagctgggaatgtttatcttggtagctgcagaaagagcctgtggcagaacccagtatctgttcctgatatgcagatgtcctgcacatgcaggcagctttctcagcccaatcaaaagcatctgcagaaacacctccagctgccgtcaccctcagtggtgagacgctgatgaggttgtctgtcctcactctgagctcagcatcagcttgggggtttcagtcagggcagttgaatacagaaaacaaaaccatatagatcagaaaggaaaaaggaaaactctttattcacaaatggtgtgaacaatcaattgtgcttcactatggtaatgagtagtcagagaaggtttgaacagtatggcaccccccaaaatgaactacttagggataaatttggaaaaagatatgcaagtgctgtccacggagtactgtaaaatgttgctgagggaaagaaaaaccaaacagagaggctgggcgcggggcccacacctgtgatatcagcactgtgggaagccgaggtgggaggatcgtctgagtccaggagtttgagaccagcctgggcaacatagtgagacgccgtctttacaaaaaataaaaagttggacagatatgtcagtgtgtgcctgtagtcccagctcctggggaggctgaggcaggagattgcttgagcttgggagatcaagcctgcagcaagccatgattgcaccactgccctccagcctgggcaacagagtgagaccctgtctcaaaaaacaagacaagaaacacacgaccacaggggcaaatctcaaaataagtgagtgagagaagtcagacaaaaagagtgcttgctggatgatccgtctatctaagatgctagaaagtgcacccgagtctgcagtggcaggacctgaggttgcctgggggtcggtggcgggacccagtgggggcacaaagatgcatttggaggtgactctttgactgtagtgaagtttcacagtacacgtgtcaattcatagatgacgcgctttaaacaaatggggtttggcatatgagggcagacagtgactgcgtgcagcagccagcgcagcagtgaacctgaaccccgcgggtctcttgttaccaatgactgtccagtgagactcttgccctgggctgcccgtataatatgaacagagcagctggtcacttgggaacaggccagttctttcccttggctcaggctttgttgtttgcccatttttatcccaggaggaagagatcacgaaggaggaaatcgacatcctcagcgatgcctgctctaagctgcaggagcagaagaagtcactcaccaaggagaaggaggagctggagctgctgaaggaggatgtgcaggactacagcgaggtgggtgggatttgctccctggactctgagactgcaagaagagtaaaatcgctgtactggccccaaaagtatacataatacttccgtcagatacttgataagctggccaaagagtatttggagaggaaagcacgttataaataaaccttattcagtaacctttccacagccattccggctggaccaatcctctgtaatgtggctgtgtgccgttctggccacagatgtgtgtgcacctttttttttttttttttgtaagaaggtcttgctctgttgcccaggccagagtgcagtggcacaatttcagctcattgcaacctccacctcctgggttcaagcaattcttgtgcctcagcctcccgagtggatgagactgtaaacatgtgccaccatgcccagctcaattttttgtatttttagtagagacggggtttcaccatgttgaccaggctcatctcgaactcctggccccaggtgaccgacctgcctcgccctctcaaagtgctgggattacaggcgtggccaccgtgcctggccacatcttttagtttctaaacatgggaaggtgtctcatgaagagtttggtcacttgacgagatcttattcatgattacgtgaaagtggcttttttcttttcttccatggtggtttgtttccctttttttgtaaatattacttcctaataacgattttttttctttctttctttctttttttctttttttgagacgaagtctagctctgtcgcccaggctggagtgcagtggcgtgatctcgactcactgcaacttccgcctcctgggttcaaatgattcttctgcctcagcctcctgagtagctgggactacaggcatgtgccaccatgcctggctaattttttgtatttttagtagagacagggtttcaccatgttgaccaggctggtctcgaactcctgacctcatgatccacccgcctcagcctcccaaagtgctgggattacaaacatgagccactgtgcccggcccctaatacgattttttaaaaactgttttcatagctctgttgggaatgataactgatttttcaattggcaaaaataattggccatttctagatttatgacagccctcatgccatgtgggttctccactggatgtgaggtgcttatcaccagctcagcctgttccttccctcccctcccctcgccttccccattcttcctcatggtgtttactcgtgggaaaaaaacaacttggaatttaaaaagacacttaaggctgggcactggtggctcaggcctgtaatcccagcactttggggaggtcaaggcaggaggatcacttgagctcaggagtttgagaccggcctgggcaacatggtgaaacaccatttctgcaaaaaatacaaaaattagccaggcatgatgttgtgtgcctgtactcccagctactccagagactgaggcaggaggattgcttgggagtgggaggctgggagttggaggctgcagtgagctgagatcatgccactttactccagtctgggtgacagagcaagaccctatctcaaaaaacaaagacacttaatttccttgattaattagttcacttaatttttctttaacaaatgtgaaggaaattgagattcagaatagattctatgtcttttgcttgcaaggcagtgtacaaaaataagaaatttgtatgatagaaatacaattttataactctctggtttgaattaatgggtttaattacctttacaagttaatttattacctttttttgttgttgtttgagatagggtctcgctctgtcactcaggctgaagtgcagtgatgtgatcttggctcactgcagcctccacctcctgggctcaagccatcctcctgtctcagactcctgggtagctggcactacaggtgtgcaccaccacgcctggctaattttttgtttgaattttggtagagataaagtcttgctatgttgcctggtctggtttcgaactcctgtcctcaagtgatcctcctgccttggcctcccaaagttctgggattacaggcatgagtcactgtgcccaaccagattcttttttttttttttttttttttggagacagagtctcgctctgttgcccaggctggagtgcgttggcatggtcttggctcactgcagcctctgcctcctgggttcaagcgattctcctgcctcagcctcccaagtaactggattacaggtgcctgccatcatgcccagctaatttttgtatttttagtagaggcggggtttcaccacattggccaggctggtctcgaactcctaacctcaggtgatccgcccgccttggccttgcaaagtactgggattacaggcgtgagccactacacctgaccccctttttcttttaagacaaactttttacaaccaaaataattttattaggacttgcaggagatcaagaaggaactttcaaagactggtgaagaaaaatacgtggaagaatctaaagccagcaagagattgacaaaaagggtgcagcaaatgatcgggcagatcgatggcttgatctcgcagctggagatggaccagcaggctggcaagctggccccggccaacggcatgcccacggggtgagtggggtggtgggcgcgggagagggatcggagactcacatagggaggctggtccctttgctggatccgagctgggcccttctggctccaaagggcacattgtagcctctgcctggctgcctctccacctttgaccagcagtcccagccaggaaccctctggcatgtcagtctctgcctctccgagagcagttcgtcccttcctggcccctcttcctcttcccacagccccctctcctcccgctccaacctccacctctgttggcttctgtttcctctaattaccaggctctctcttgcctctccctcttcctgaccccacccacgctcagtaatgacaccagctcgggcagtcggccttctctgtgcccgacatgtcccagattcctgcgcagcagtggctgagggagctgccgttttgtgagtcccttctgggcgaatgaaacagctgttgggtgactgctggtgccctgcaggttcaaatctccacctccacacccacagtgttgtaggtgggctgcacgtggcaccctgctcatgctctcgtccctgctcttggaggccctcatctgcccagggcaccacagcccccatgatcgtgaacgtattgccaagtggccacaggcctgaggacaacagcccagcagccatggccccagaggggcagccactgaggggcagacatgcccgtggaaaccctggacctggtggtgtttctgtgtttgtgtccacgctggccctgggagctcttggcattgtatgcaggatgggatcataccttgggggtccgtgctggaggttgcctggctcacgcggagccgcctgtgtcagtgctgaccacttgcagccacaggtgtgggcagtgaggccctgtgtggcaggacgcctgcccgtggccacatgcaggctgtgcttccacagggagaacgtcatcagtgtcgctgagctcatcaacgccatgaagcaagtcaagcacattcccgaaagcaagctcaccagcctggccgcagcactggatgaaaacaaggatggcaaggtcaacatcgacgacctcgtcaaggtgggcctcgctggggaccacgcaggccatccgccacctgctctggagtggggtggggcagggggactgttcattgcatgtccggcaccctcctgggcagctaccccctcctgtcaggggtttgggtctgtcactgcgactgctcctttaagccgctgctctcatttgaaacatcagaagtgagaaattattgaagttacaactcaagtgttgagagagaaaacgcacctagtggctacgcatgtccctggaccccgcccccagctggtggcactggggagccgggggggtgcagcaaacacctctcaggggcccccgacgctgaggggcgactgcacagggagcctgggggcacttcacacctgccgggggcccccaaagctgagaggcaactacacaggggagccgcggggcagcttgggcaccgccccaaggctgagaggtgactgctgggctgagctcccaagtgcagccactcaggttccagggtagccccggagaccctggcccaggatccagtctctggagggaaggcagggctctagcctgagtgcgcacaccaattttcccaatcactgacatctctgaggggaagctgcctcgtggctcccggtgcatgcatcaggttagtgattttccagacgtctaacagaagtgttggctggtttcttgcagttcagtttggaagcaaggatcatgtgtctactgcacagctgcccttcccttccctgctagtctgggtggcagagtggggacaaggtccctgcatgtcaccccactctgccctgggaagccatggcccaggttcctggccagagcaggaacttgaccctggcagccccattgtgctgtctgccacctgtcaaggcagccccctggctcctttgtcctcccactctgagccccttccccagggtctgtggcaccccttgggggaattggtgctctgaggaccctggggcccgcaggcagtgattgcgtgcatgctgctgccaccccagctggggcgactgacggcgctggccccgcctctgcctcactgtgctgtagggcgcagccacctgagcctctccctttcccacgtgtgtaggtgattgagctggtggacaaagaagatgttcacatctccaccagccaggtggctgagattgtagcaacactggaaaaagaggagaaggtggaggagaaggagaaggccaaagagaaggcagagaaggaggtcgcagaggtgaagagctagaaccactggcctgggcacctgtcctcctgctgtgccgtcaccctggcaagggccgtgagggcgattgctttgtggtgattctcagtggctcatctaatattttggctggaataaatcagagacttccataatcaagtaaattttaattttcatcattccatggagattcagtctgtctggaatcccggaacccctccacagaatcgtgtctggatccacactgtggtgtggctgccacggcctcctggctccagaggcagctgggccgggccaaggcaggaaggcgcccccatgtgtgtggcctcagtctcagcatctgactgtgctgccctgtccccagggaagagaatgaggaccacgtggactccgcccacacagagctggctgctgtgcccaccctcaggggcgtcaggagacacagcctggcctcctcagggctgaagatgcctccattcgcctgtggaccttgatttctagatttcagtgtcaatagacctgtcttcctgcacactttcagttggatgtgggtcattgtggagacagaggtgtctgccatctctgtggcctctggagagtgacgtctccctgctgggagtgctggttctcacgtgcggtttcccttgtgtatcggagctctttctcggctttctatttcccccagttctttaagcagtcaattggcacagagtttcccacgggggctgcagtggattcactgtgtcagggatgagcctggcttgggggttggtggggctctgaagcgcatttggggttctttgtagcttctaatgtgaggtttgagtccagtgcgcccacagcagcatgcccttctcaccccttgcagtgttgcaggctcaggcccctgggctccttcagcaagcaggctagtcaatgaggcatgaggatccggcacagggcatcccctggggcttcaagggcaatacccccgtgcttagggtttgccctgtgccctctgggtggggtggcctccccgcactcggcagcatggccaggctggccagggcgtgggcaggtggtgtcctgtggcacctccatcctcctgcccagccggctgtgtcacactcatctttttaaggtcaggttggttcctggcaaaaatgtacctccaggggcctccaagcataggatttggaagacaggaacggcacaggcgtccaggaaagcagctgcactcagacaatgccttctccattacttgaagcttctttctgttcagccattaaagaaacttgacaaaataggaacaggagatatttctcaattgtaaacctttgtgcagggacagttggcttccagaggctttcagctttcagttatttgagaagtttgttttagatccttaactaatatttatgaattctctcaccctgtgtaagtagcctggtgttcgtttgtccaagtgtacttacccttgagaacaagtcttgcagttgccaggtgtgtgcagacgcctctcctgtgagcggcatcgcgggcccagtcagctgccccggctctcatcctcgtcctcactgccttggctgagcactgttgacgtgaacagccactgcaacaggcagcccatcccactgtcccctctgccctggactccgcatggcctccaaaagccagcttgccctccgggtgctgcaggggctttgcaggtggggaaggctctggtgggtgcctttggtggcttccgtgacatcagccgtgctctgatgcaggcttgctccctcgtcattctccctcgtcattctccctcatcgttctgtgtgcatttttctctatgtcctgacctttcttcttgcacctaaaagtggtgtctgggtgcaaatgtaagcagtggtggatccagaaatatgagctttgtgtaataagcttcttaaaacagtcctttcttacacctgcccagggccagaccctcggtcttggcctttttcaggagctaggatatctgcgcctggtgaaaatgaaacgaattcctgatttaggaattcagtgtttcctcctcactccagctaagcactcactttttttttttttttttttttttttgatacagagtctcgctctgtcacccaggctggagtgcagtggtgcgatctcggctcactgcaagctccacctcccgggttcaagcgattcttctgcctcagcctcctgagtaattgggattacaggcatgcgccaccatgcccagctaattttttttttttttttttgagacagagtcttgctctgtctcccaggctggagtgcaatggcgtgatctcggctcactgccagctccgcttcctgggttcacgccattctcctgcctcagcctcccgagtagccaggactacaagcacccgccaccacacctggctaatttttttgtatttttattagagacagtgttttaccgtgttagccaggatggtctcgatctcctgacttcgtgatctactcacctcggcctcccaaagtgctgggattacgggcaagtttttattagagatggggtttcatcatgttggtcaggctggtcttcaactcctgacctcaggtgatccacccgcctcagcctcccaaagtgctgggattacaggcatgagccaccgcgcccggcctgaactctcagttctaacgcagggattcaggaattgggctttcagactccttctgcagtgtcacagtccagactttttttaaatgaaggacaccccgcagtggctcacagtgggtcccagggctagcaggagcgtgctggggagccggctctgtctttgttcgcagtgggtcccggtgctggcaggagtgtgctggtgagccggctctgtctttgtaaatccttcaggggtcctacggctgactccaccggacagcccgtcctgggccgtgttaagcaccttttgtagaaatcgtatttttattaaaacatcaaatctgtgttcctgtaacagtgcagagtaataatatttctgaaccgttgggcacacaggagcgagtggaagccggcagagctgtccacgtggctgcaggggctgggccttggggcgcgtgtggctgtgaggccagttccagaaggagcctcaccatccctgggggtttgagtgctgggctgccctccatgggttcagcccttggcttcacgcttcctgctctgcaggatgggcctgcagggtcaggagacccacgtccccaggtcctgtgacagcgtgagctgctcatggaacagtgtgggacgttctccaggccagtggccctgccacctggtcatgctctccctgctctggggacctcagtgacttcttgggagtcctggggttaggggctgggaccctcgccgaggtgtcacccaggagggccagctcttctgaaagactcctcaggccgctgaggggaaa

SEQ ID NO: 14648 - DNA, 13119 bp, Human
  misc_feature (1)...(13119): n = A,T,C or G
gaggtgaccccagagctgaggagaacctagagacatggtggctggggctgggccagcgcctggagagagtctgaagctgccctcacagggattggggaggtgaccgaggtggggtgcctgtcccccttcccacccctcccaggcctcattggtgtccaccaggcaccttccacgtgtctatttcccgtattcttgagaacctctccgtgaggttagtgttgggtttgcatgtctgtaattgagggaagattttgagcctgggagagtttttgggggaggtccccagaccattactggtgcagagtggagcccctgctgctctggcttctgatcctggtgtgtgctcgctctaagctgccctgggctgacagtgccctgcaccagccgcactgccctctctgggctgcaagccgaggatccccatctgagaaacaagcagcgggtccagagagttccccgcctggcttccagccctgattggtggcttctccgaggctgcaaggcggtggtaatcacgagagccacgtcgttggtgggtgttcccatgttgcaggtaccgtcctggtacttagtatctgttaacacacaaattcacgaggaatgctcccaaagcacagagaggttaaattactcagtctaaggtcacgcagcagtaagtaatggagctggaatttgagctctaacagtctgctccggagctcgggccttgctgctggcgtcaggccatgcacagagagctgatggaagcaggaggagctgatgtgaagttatgcgacacacatggccttttaggtgagctcgggccacccggggggatttgtgtccaatcagcaggggagtttctagtgtgccaggcaagacacgcaggagatcgtgaggctgaatgggcctcgcgcaggtcagctgtttgaattttggactgtaaatggtggtgtggcaccacgctgcggtcagatgatggtctctgtgttgcacacaaaccataggttctgggccaggcatggtctatgctgcagaagcttaggctgcagtggcctcctcaaggcctttctgtgggtggatatggcacaggcggcaactggggccgatgcagcgtggaccgagatgggtctgggttagtgccagcctcccactgctgcctgtgaggcctcgagcctgctctctggccctcggtggcctacattccagttgggagaaagcaaatgtggtgcacacagtgtgcacctggtctctaagacggccagatgtcagcagggcacccgctaggaggcagcactgtggatgagaggcaagagcggtggagtggtcagggaggtctgagtgaagcaagggcatgagctagggatgtccaggcgggggggcaggtgtgaggctctgggcttggagcctgctggtgccggacagagtgggcaggtgggtagaggaggaggagatgggccttggcccttattctttggattttgttgttttgctctggtgcctgcgggcagctagtgtagaggtctgaggtcagcgagcacccttactgatttgcaggacttgttcaagagccacggatctttccagaaagtcacttgttggaggagaggacctccaaagtcaacaaagtctctgctctgcactccattcccccacgaagtgccaaagcaatgcaccctacctccccaagtctctgggagtgggcctgggagacccacccagggatccagcctttgctgattgtgtttgtgtctgacttgcctgcctttctgtggggatcgcccgcccatgctcctgtccgacgtggtgtggggctgagggggctgcacactgtcctggcctcccttccgaagggctccccagcgggcagtgcaaaacgtcaggaagtaggtgggattgtgtgtggttgtgacatggcatggcacggggcatgtgggttttgctgctgttggtgttcggtgctgagctgtcaaaggctagtgctggctcttactactgttttccactcttcccttttcaaggaatgttccatttggctgctgcactcccatccaccctgtgtacacatcctccagaggcgatcacctcggctgttgggctctgaggcccgagtgccttcgcatagtgtcgagagcgccatggacctctacctctgtgggttttgtggctgtgggacctcagtgccttcctgtgcgtggctggcactcttcgcgccctgttcgcgatgactcggtagtagagaagtccctcaagtccttgaaggacaagaacaagaagctggaggaaggcggcccggtgtacagcccccccgcagaggtggtggtgaagaagtccctggggcagcgggtgctggacgagctgaagcactactaccatggcttccgcctgctatggatcgacaccaagatcgcggcacgcatgctctggcgcatcctcaacggccacagcctgacccgccgggagcgcaggcaggtaatggggacatgtctagtcctttcttttctttcttgctctatcacccaggctggagtgcagtggcgcaatttcctgggcatgggcgatcctcctgcctcagcctcccgagtatctgggaccacaggcatgtgccaccacacctggctaattgttttttatagatccagggtcccactttgttgcccaggctggtctcaagctcctgggcttaaatgatcctcccacctcagcctcctaaagtgttgggattacaggtgtgagccaccgtgctgggccgtgcccaaattcttttcactctatagattgcttgaaaaatatttttagtgcttgctttctgtttggtagagaataaaaatcggtaaaacctattgcctaggaaaaacttggtttacctgtgtatttcctctaccctccaccacaacagtcatcaacatagaagaccacgcagcagacaccagctgggtgtcctctgatttagttctgatactgtctacccagagataacatcagatcccacagggtgagggctctgtccccaaggtgccccctaccagtctcaagtccaggcctctcggaacttctgacagactggcttcaagttaggttcccaccacccccgcttcgttttttttttattattattatttttatatttatttgtttatttatttattttttgagatggagtctcactgtcgcccaggctggagtgcagtggtgcgatctcggctcgctgcaggctccgccccccggggtccacaccattctcctgcctcagcctcccgagtagctggcactacaggcacccgccaccacgcccggctaattttttgtatttttagtagagacggggtttcaccgtgttagccagaatggtcttgatctcctgacctcatgatctgcccacctcggcctcccaaagtgctgggattacaggcgtgaaccaccgcgcccaaccttattttttgaggcagagtctcactctgttgcccaggcctgagtgcagtggcacaatctcggctcactgcaacctccgcctcctgggttcaagtgattctcctgcctcagccacctgagtagctgggactacaggcatataccatcacacccggctaatgtttgtatttttagtagagaggggtttcaccgcgttggccaggctgctctcgaactcctggcctcaagtgatccacctgccttggcctcgcaaagtgctgggattataggcgtgggccactgtgcctggccccctctttgtttttaaattgttttgtttttgtgggtacatagtaggtatacgtatttatgggctacatgaggtgtgacacccacccccacccctttgggtttgattaatttgctggagcggctcacagaacttagagaaacacttaaatttatcagtttactataaagcatagtgcaaaggatgcaggtcaagagaccgtaaggcaaggtatgtacggggaaggggcatggatcttccatgcttcccagggtgcaacccccggtgaacctctaccgtgttcagctttctggaagctccttgaacccagtcctcttgggcattccttccctcagggaataggacggaaccctctttagggagggtcttaaaacccatagtcaggaagttgggaagattagtgacctgccttagggcaggtgaaaggagggtagagaggtcagaggcctgcccccaaggcctgacacacctaacattatcacaagactgtaacaagggcagtagagccaggaaccaatacctgtcataactaaccacacctatggaaaggcgcacctcgccactgaattgaattgcaacaccgtctgctcctgcttcaactctttcccagcagcagttttcagcacacagctccacccactctcgatgccttcaccctcttgatgccttgccctggctctccactgctgtttcctgggaggggtctgcatctgcacaggtgcacctctgctgcaggtgcaggccctttctgtcttaactgcttcaacgtctgtctggaggggctgcgcgtgtccctctgggtgagttgtttttatttttgggatccgtgcttctgaccccaaggttccacatctgccatctgtgatagaacctgctcgctcaccagtgcccaggctctcggggctcctggtttgtcctctggtgcaccagctcctgctgtccttcacggttctgaaaagattctccattttctgtctttgtttcagggctgcaatctagatgttttctttctattttattcattctcttttcagctgaagtaatcttgtttaatgcagccaccaaggttttattttcagtgcctatgtttttaactctagaagctcaattagtttattttaaattaattttttaatttaaaagagatggaatctcacttcagaggggtaaaccttgtgtgatgtaggtggtgagctagtttcttcagcacagatattgtttgcttctgtgagagccatgggacaccatgggcctcagagagtgcagccctatgtgggaatcgagtccactctctcccaggtgcagcctcatctcctgtctgctccatcctttcctcccaagaacacctcatggtttctagctcttggggtttatattacgtttttgtggctctactatttatttacttatttttatttttgagacaggttctcgctcccccacccaggctggagtgcagttgcaacctcatggctaaccaaagcctcagccctcccgggcataagggatcctcctacctcagcctccagtgtagctgggaccacagacgcacgctgtcatgccaggctaatttttaaatttttcgtagagactgggtctcactatattgccaaggttggtctcaaactcctgacctcaagcagtcctgctgcctcggcctcccaaagtgctgggaggccttcctttttaaagataatcctggccgggcgcagtggctcacacctgtaatcccagaactttgggaggccgaggcgggccgatcatgaggtcaagagatcgagaccatcctggccaacacggtgaaaccctgtctctactaaaaatacaaaaattagccggtcgtggtggcgggcgcgtgtaatcccaactactcaggaggctgaggcaggagaatcacttgaactcgggaggcagaggttgcagtgagccgagatcgcgcccactgcactgtatcctggagacagagtgagactccatctcaaaaaaataaaaagtaaaaaaaaagataatcctgtgcactgaaatgtgctctaaaaggttgggatttgcagttctgcttttgtgtttacaaacatttaagaagttattttcttggttgggtgtggtggctcacgcctgtaatccagcactttgggaggccagtgctgcagatcacctgaggtcaggagtttgagaccagcctggccaacatagtgaaaccctgtctctaccaaaaatataaaaaaaaattagctaggcgtggtggcgcatgtctgtaatcccagctactctggaggccgaggcaggagaatcgcttgaaccagggagatggagatacaatgacccaagatcaggcgattgcactccagcctgggtgacagagctagacgccatctcaaaaaaaaaaaaaaaaaaaaaacttgtaaatttggattttagtgatggttttgcaatgtataaatttaccaaaaatcatcaaatttatttaaaatagttgaatgttatggtatgtaaattacacctcagtagaactgctaaaaaaattaatgaggcatatcaaaaaacacatgtgccagctttaaggatatgtcctgcccaaatatggcaccgtttgggaataaagacagccgtaaattgtaaatcagtcaaaaaatacaggagtccatgggtccagtgcgataaaaaaacagaaaaatgaatgtttaggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcaagtactagtttgtttatgtcaatgaaatacttgggttttttcctaatgattgctttgtagtatagtcttaggaaacacaagtagaagccctccttatagagcaccctccaagagaaggtgtggctcagcctatcctggtgactctccaccacgctagtaatgcccagtcctcagcctgcagccctcacttgctggcccccgagcccagagtgctggccggtgtcctcggaggactcgatcgctgggagcacccagtggcccttggtgtcagcaccataccctgcttttctggaggctgctggtacctgctttggaccctgagaaagaagtgggttttgggaatggtctgctaagtggttctggaacttagagtcctcagtgggtcctgtgagtcgctgcctgaggttgtgcctataaaccattataggagaaatgctcacaccccttgcccttgttcccacatgtgctctgctcccctctgatggattccgccccttccagtttctccggatctgcgctgacctcttccgcctggtgccgttccttgtgttcgtggtggtgccgttcatggagtttctgctgcctgttgctgtgaagctcttccccaacatgttgccatccacatttgagactcagtcactcaaggtaagggcagcatcccaactgcttgttttagaatgagtctgaaattcattgtgatggcttccttgtttgtgacttttcaggtgctagatatttttgagactttatgtatcttcatattgtccttgtgctgtgcaataattatttagtggatgctgggttttggatttgtttctctttatttcgttatttatttatttatttatttatttttgaaacagggtctcgctctgtcacccaggctggagtgcagcagtgcgatcttgtctcactgcatacaacctctgcctcccgggttcaagcgaatctcctgcctcagcctcccaagtagctgggattataggcatgtgtgccaccatacacaggtctcgccctgtcacccaggctggagtgcagtggtgcgatcacggctcactgcagcctcaagttcctggacttaagtgatcctcttgtcttagctcccgaatagctgggactacaggctaagccaccacatctgactaatttttttttgttttttatagacaagatctgctatgttgcccaggctggtctcaaactcctgggcacaagtaatcctcttgccatgacctcccaaagtgttattatgggtgtgagccactgcttccagctcaatgtattttaaaatacaggttttctagaccaggaacactcccctaccggtgctataggggagtcatgaggtccttctagggcagggtcagccagctgcagcccacaggccagatcaggaccctgcctgttctcagcagagccctgtggggacctgcgatgcccagtcatgtgtcttgtctgtgaggcaccagcagagttaagcatttgttttagaccacacagccatgaaggccagacgccttcctgtctagcccattacggaaagtgtgccgatccttgctttagggaatcacacgagtttgtttgtttttgtttgtttgtttgtttgtttttgttttgtttttgttttttttttgagacggagtttcgctctgtcacccaggctggagagtgcagtggtgcaatctcagctcactgtagcctccacctcctgggttcaagcgattcttgtgcctcagcctcccaagtagctgggattacaggtgtgcatgcctggctaatttttgtgtttttagtagagacggggtttcaccgtgttggccaggctggtctcaaactcctgacctcaggtgatccacccaccttggcctcccaaagtgctgggattacaggcatgagccactgtgcccggcccacacgggtactttttaaaaccatgaaataaaagagtttgagaatgtattgcacttagatgagagtcagtgtgttgtgaaatgtttctgggagtgggggtcgggcacaggcgtgagatgttttccttgcccgaaccacagtctgagcagttggaatgcagtgccctctctgcccttgcaggaggagaggctgaagaaggagcttcgggtcaagctggagctggccaagttcctccaggacaccatcgaggagatggccttgaagaacaaggcagccaagggcagcgccaccaaagacttctctgtgtttttccagaaggtgctgtgatacgtctgagtccctgtgacctcaccagggagccttccctgattttctgtttccctttcgctgtgctcagcagagtggagctcccccaggtgctggctggcgcttgaaagtttacccaggaggctcagtcgggggccagtggagtgtcaggagtctgcccccacgagctcccagtgagttaagctgtggtggctgcgcctcgtcagccttcagaattatgggcgtctgtgtctcatcaccctgcagctgtccaggagcagtagaatctgacccatgaggagcctgagaccctgatggtgtgaggtgtgggtggcttggccgggctcctctgctgggcattgccctctggctggagtcagtcaagaagatcccaggtcccaggggctggtcagaggcctggactgtgggagcagtgggggctggagaggaggagcggcccttgaggtttcctgcggtcatgtggtgagtgaggtgaggatggggagacggcagctgccacggaccgagatccctgaggactagatggggttcacgaggccggtgttgttggcttgagggacttgtgccactttggagtgagaaggatgtgtctgaagtgcaggaagagcttaaaccagggcctagaaactccagccatgcgtgtgcgttgtctgtggggttttcccgctgcagcacagaggcgagtggtttccatggctgcaaagccagaaatacttgctgtctggcccttgacagaaaagactgccaggctgaggcctaaccacggagaagcctctcgggaggaggcgacacagccatggggctgctgagccccccagggagtgggtggtggttccagcaagatgttttagggggagccatgctttgggagcctcacccaggacatcgtgccttgcagagcaggaggggcccgtcccaacctttcctgggccgcccagctgccaagaaggatgtgcttgcagtcacctgcacgggggtgtgctgcatagggccgcccccaggagcacacctgaaattgtgtctcagagctggcatcctgcatgttacgatttgagttgggcaccaagtcagcctcgtcctccctcatctgtcacctctgctaggtaccctcctagcccagctcttggcagagactgagctggtggcttgtccctcaggtggtaggaactgcagaggatcacccaaagggccctgagtgatccacgctaagggactctagctctccctaaagagctagatggccacccctcccccaaggctcaggcagtcatccgtgggagatgtaggtgcacacaggtgcacctcttcctgccccagagcagcagggtcccggccacttctgtggcagagagaggatcacaggacctgcatgcagcagcctgtgggcccgggcgtctcccccagcagacagcagcctcagctttgctggttcaggcaggagaggtccacaggccagacgccacctttccccaggctagcccagcaccggagtcagaagtcagtggtttgaggccaagctgggcaggtgacttgaggtcgggtatttgagaccagcctggccaacatagtgaaatcccatctctactaaaatacaaaaattagctgggtgtggtggcgcagcctgtaatcccagctactcgggaggctaaggcaggagaatcccttgaacccaggaggtggaggttgcagtgaaccgagattacaccactgcattccagcctgggtaacagagcgagaccctgtctcaaacaaaaaaaaaaaagaagaagtagtcagtggtttgagtccctgaggatgagaggcagcaccctttgggaatgtggttggtcgtgggagggagccgggtgggcgcgtgtcccggggatgacccttgtgaccacttccgcagatccgggaaacaggggagaggcccagcaatgaggaaatcatgcgtttttccaaattatttgaggatgagctgaccctggacaacctgacacggccgcagctggtggccctgtgcaagctgctggagctacagtccatcggcaccaacaacttcctgcgcttccagcttaccatgcggctgcgctccataaaggcagacgacaaggtgagcctggccatactccgcgccacagctctggtgttttaccttttcgtttcctgatgataaaagcagcatgtcctcattgtagaaactctggaagatgctgaacgatcgaaaataagctcactaggagtcttgccacttgcagattgcagatcctttgaagatggatgtcttttctctggcaccttctcggatgatctctctgtttggatttcgtcagatttataataacttgcttagttgtgtctgtctttgtgttcatcctgcttattgatgacagtgcctctgtgcctctctcctcacatcagggtcttcatcgagggtccatttgcccctttgccctgtcctgtccatcgcacgtgcttgcctctgtgcttcacgcccttttgtgctttcagggcgctgccctccttctaggtctgattactcctttttttttttgagacggtgtttcgatcttgttgcccaggttggagtgcagtggcgagatctcgactcactgcaacctctgcctcctgggttcaagcgattctcctgcctcagcctccagagtagctgggattacaggcgcccgccaccatacccggctattttttgtattttttagtagagacagggcttcatcacattggccaggctggcctcaaactctggacctcaagcgatctgcccacatcggcctcccaaagtgctgggattacaggcatgagccactgtgtccggctggttactcttttattcatactaggagctcttaagatttcagttctcaggtaaaactgttcctcttgtcatctgtctttttgaatgcactaactctagttcacattgattactctaataactgggtggtccgtaggcctttttcttttgctctcccttctgattttgtttgtagtgtttagtttttcctgaatgcaggcattgtctgtggaagacaaagaggttcagggcagtgttgaactcttccaggaagagcctgcctgcatctctggtgagcaggttgagggccagtcatttccatgaatcaaggcaaggccatgtggggagcctgtatcccgcccttgccgggacacaacaggcaccccagccctggtggtgatggtgtcagagaaggctgagggggccagcccctgtggtgtcagtggagaccaggtggggggcttgagctttcctctcatctgacagtgtatccgccacacttccccaccactggggtggccttgggggcccagcggagagttgggactttgaccactgcccagcaggaacaaggtcacgtctaccatggtgccagtgggagccaggtgggaaacagtactgagatgcttctgccctcctactgggggagacacctgtgagagccagaactcccacccacccgttcccagcggtagcaagcagcaccgctgtcccgcagatgtctgtggaggctggatggggagcctgcacttcttacgaggcagcgctcccaccacttctaaaatatgcctgggatttagcttatggatgtgagtgagtgacaacatggagaggtcaatgccattgagagaaatgtgttacccacagctcccctgtcactcagccccacaaaacctccacacccatggggagcagtaagctgggggggacgatggctgccttccttgtctgcagtaggtggagacatgtctgactgggcaggaagggaaacacagacgttagggtttgtggttggcccatgaaagctggaccatagggaagtggaaacagctttggccttgttagcttggtcctgggattggtagatgccagatcatcaattgcaaactctgtgcaaattagaatacccaccgcccatgccaccatgcaccggaggaggtcagctgcgacacactggaagtcagatctagagtcaagaagcaggaaggtatcagtgaatgagaaaaagcaacgcctggtaccaaccctgagatgacagttagagaccctgcacctgggcctcaaacagccaccagcgca

SEQ ID NO: 14649 - DNA, 9447 bp, Human
tcccaggttcaagcaattctcctgcctcagcctccagagtagttgggattacaagcatgcaccaccatgcccgggtaatttttttttttttttttttttgagatggagtctcgctctgtcacccaggctggagtgtagtgccacgatctcggctcactgcaacctccgcctcctgggttcacaccattctcctgcctcagcctcccaagtagctgggactacaggcgcctgccaccatgcctggctaattttttgtatttttagtagagagggggtttcaccatgttagccaggatggtctccatctcctgacctcgtgatctgcccgccttggcctcccaaagtgctgggattacaggcgtgaggcactgcgcccggccagagcctcataactttgtgaggtgggcagttcaaatcttattaattccccatttaccaatgacaaaatgaggttcagagagattagccctcttggccaagatcgcacagccagtcagtggcagaggtgggacttgaacccgtcccttgctgttccttgaacttctccacacgacagggctgtccctcagcctacaggtcacccctctagccttgcctgttggctcttcctaatcctttcaggcccagcccagatactttttaaacaagaatgatgagagctaactttttttaaaatgagacggtcttgctctttcacccagagaagactgggtgataacagtggctcaatcttggctcactgcagcctctgcctccagggttcaagctattctcatgccttagcctcctcagtagctgggattacaggggtgcatcactacaccacgctaatttttgtatttttagtagagatgcggttttaccatgttggccaggctggtctcgaactcctgacctcaggtgatccgccagccttggcctcccaaagtgctgggattacaggcgtgagtcactacgcatggctgagagctaacgtttattaagcacccgccactttctagatgaggtccttactgacttccttgggttattttaggtaatcatccccatacctcttacgtggcaggtatgactgttacagagggagaaaccgaggctgagaaaggctaagtagcggccacacctcactcagcaggtgacaggctgcggtcgcactcatgacatagtctgactctagagcaggcctttcctgcccgctgttgctgcctccagaagcctctctgaatccaagggtgggaactattcctccttgccctcgagccttcgccaaagccagggcttggagcggccgtgggctcctcctccttcccccaggctgggctcttcaggggcggaaacctgcctggcttgcctgccttgctcgaccctgtagcccctggcacgaagtaggtgcccgtgatgccggattatttcagcaggagggcaggggtgttcccgatgaagccaggagatccagggaggagaagcgactcccggggccacccatgcttagatctcagagccaggcaagagccaggtcccgggggtccaggagcgcgctcggggctcctcctcgcccgcgccccccgcgcccctcgcgcccccccgcgccccccgcgccccactgcgctcgcgtctgcggggccgggaggaaggggcggcgcagccgggccggggcgggcaccgaggcctggcgggcgggcctggggcgctttcgtgcctgccagggaaaggctggcgaggaggctgggggcggacgcagggaggaaagaagcaatggggtgctcttgcgttttgacattttaaaaagaagtttagattcgcttcccggagccgggatggcagcctgcgctatggttggggaccaacgtggtgcacgggcaggggccggggagagaggcggccgcagcgggagcccgggagcgcagggcgggcctggaagagctccgccccaaggggcgcggccaccccggaggcgggcgcacggctgcttctcattcattgtcttgacaagagcatcttcagcgggcgagtccccggctcctccagctccttcctcctcttcctcctcctcctccacctccggcttttgggggatcactgtcctctctcggcagcaggtgaggctgggcctgggaggcgcgggtgggccggggcgagggccacctgtggggcggcgcgcgcgtgggagccgcgggctgcgggggcgcgcggctgtcaccgcgacccagccagcgccggggccaggtagcgggcgcagcagcccgtggggggacgctgcttggagtgggggccgccggggccccagagcgctctgcggaggcgagggctagggaccaccgcggccaagatggaggtgggtggccgggggtcagcacagtgtcgagggcccgactccccacggaattgagtctcggggagggtggggacgagggcagggtggggtgagcggggcagctgccctgggcttggagacaggaaggggttgagagcaaaacaagaaaagaccaagttcccctttccgtggtttccgggcctggtacctgtggtgggggaggaggcagggtggggcgatggcttcctgtcccccacctctggtccggggctcccctctctccagatacaggctgctcctcaagactggggctcttcacatacgctcctcaccgctctttgggcaggccgacctagcagcctcttcgggagtcctggggtggccgggggtgctggagcccccagtgagtaggcgaggctgaggctaggggcagaggctctgggcatggcaccctccaagcggcagcacaggccccttccctgagcaggaaggtgatgcggtggcacaaggtcgcccctggagttccttgctccccacccagacactgggggaaaccatcctacctggacctcagagcagtcggagtggcctctcccttcctgtgtgcagtttacatgggggtggagatggctcttaagggcacctgcttttctgagcggaggcgagaggcagaggtatggggaggaggagatacctggacctgagccagagacctgctggggaagctatcctgccgcctcactcccctcaggcagcccccacgccacttcctcctgtgtccagccccatgccagcaggcgagggaggccagctcctgtccctgcctttaggaagcgctgtgtgggtgtgagggaggtgggctctggacacggtaactaagagagaacccaccctcggagccatctgggctgatgacgcctgagtctgaaccattaggaaggacgggctctgcatccatcagccagtcagtcaacaaacatgcagtggggcaacaccacgccaggctctgttgcagaggctgagggtacagattgagagggtggctcagagtggcctggggccagggagaagggggcttgcaggttagagggaaggagaggctggggaaggcaagcaggcatcagccacagagggaagaatagggagcccctggagatgatgctgggaccttaaaagccagactgaggggtgtcctgggggaggtggggaccactggaagatcagagttgacctgaagggagaaatgctcttatgctgtgtgcccccagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaaggtgagcccctggggccctggggggagcagctcctccaccggacccatggctctgtgcaggtcctgattaggtgacggtcaccaggccttccagggcctgtgttgccatctggaaaactgagctgggccccatgagccttacacttcctccagctcctctgtgctgtggctgtgtggaaactgacgctcagaaggagccaacacaagatgggtcacaccagtgaccaggactacagacagtcctgcagacccatgatcagccctcctgagcctcagcctggggctttctccccatggaaacacagagggggttgggatggggtctgggggccctggcagcgttctcagggttgggagggactctggctctgggcctgtctgaggacctagcaactctgtcccccagctcgcaggcagggatgatgcaagaggtgctctcccccacccgcagccctgccctcccctggagcctgctgccccctccgctggctggctgctgccccgcacccccagcacactcctgtgctctttggggggtaagacaggaaggggagatgggccccaagttgttaccttaaaagggctgatggaagcaaagagaagaggaagtggttgtcggggtgagagctgggcccgcgccccacatggctgtcacacaggaagccctgctgaagcagctgtccccggaagaagccatttccaaacctctgctcctgcctggggccagttgggacaggctccctggcccctctccttttgggaggacccacccctgcagccccaccactcacactcgctctctggggagctgcctccacccccccagcccccatacacctgtcctggctccagggccagttgtgcccatggaagcctcactcggggaagctggggtgggggtgccaaccctaagggcagagacagactgagacagagaccggcgggaactctgccagggtcttgcacggcccccaacctctgccatgcgtggccagccctcctggggtttgcccaggccattttgggactggaacaagagaagaacaacccgcccccgtccccaccccaggccctggtccagctcccagggacaccacagctttcctctctgggcctctctgaaggaggtgtggggaggttggattgggtttgggaggcaaaagcacctccaaggccctgctgtgcctttagactggacgtgtggacaagaatgcgcccacggtctgtggccacacagcccctgtgctagacatcgcctggtgcccgcacaatgacaacgtcattgccagtggctccgaggactgcacagtcatggtgagtggtggtggggacccaggggctgggagaggggctctaggatgggatctgacatttggagtcctgaagactcactggcccctcctctgcaggtgtgggagatcccagatgggggcctgatgctgcccctgcgggagcccgtcgtcaccctggagggccacaccaagcgtgtgggcattgtggcctggcacaccacagcccagaacgtgctgctcagtgcaggtgctgcgggaggaggggcttgggggtggctcgtggcctgcagtggatgagggcaggaggctcatggcttctgacactgtggggaacgtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgtgagtcgccatctaccctgacctttgaccctacagcctttatccttcttatccaccatcagccaggcccttggatgctgccctccctcgcctccacctgggactggccccgtagggtatgtacgggtgcctgacctaccacctccctttccttgcaggagaaggaccgtccccacgaggggacccggcccgtgcgtgcagtgttcgtgtcggaggggaagatcctgaccacgggcttcagccgcatgagtgagcggcaggtggcgctgtgggacacagtgagtgctggggcaggaagccgagggcccccaggctgggaaccaagactggaggtttcgtccctgctctgccactcacctggcaggatggccatgggcctcagtttacccaggcgtgagatggttgttcccactggttggtcgggagggccctcacaggtcactgcccagggaagaccaccatcccagggcctgggatgttacctctcacctgtgtctacagaagcacctggaggagccgctgtccctgcaggagctggacaccagcagcggtgtcctgctgcccttctttgaccctgacaccaacatcgtctacctctgtggcaaggtggcctcgtcgggcggggtgggggtgggaggtgggcaggatgggcctggagagggccagggcagtgggcatccgctggtattgaccctccctccacacctgccacctacagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggtgactgacccccggccctgaccgcagcatgctccttgggcagtgggcagtcccaagcccacccaaccagactgtgggccccgctcaccttccccttcccacaggttctacaagctgcacgagcggaggtgtgagcccattgccatgacagtgcctcgaaaggtgatgctcccccgccccaccctgggctccaggctgggcactgactttgcggtcttgtggggggtgtcctggcataagcgctttcctcactatccctggccttgcccacagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggtgagagggctgggaagccagggaataaaactgggagggtggggtggggctggtgtttggggcacctcaaactcacaacattgggaatctttgtgggtccgggaatggtaatcctgaggcctcagaacacaggtttcagattgataggcctgcaggtctccaggcagcaaccagctgagcgactaaagggcccaaggccagggctctagggatggggctcagcagaggctggggtaaggggagccagggaggagctgggcctaatgcagcaccgggtccccaggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggtacctcccagactctgatgactggtcccctagacacgcagtttgctgaaccaaccagccctagagcttcccctccaccgcgctgaggggactgacccatggcaggggatgtgggatgccccctgacttactacatcacaggaacagggccttcgtgggtagaaaccagccatgctgatgtgggccaggaggctgctctccgtttccgagctccttctcagagctgacacagctgaactatttaaggccctagcttagaacctcaataattcccaaatttaccaaaaatctgcctttcctagtcaaccaaaacatcacgttgcacgtgactctgctggcactgttgcttgtgaggaaatgaaccaaccatcacttacagggtaggcatcttttaaactgcaggtccaaagataaaaataacgagggaggctgggcatggggactcacgtctataatcccagcactgtgggaggctgaggcggcaggatcatttgagcccaggagtttgagacctgcctgagcaacacggcgagataccgtctctacgaaaaataaaataaaaaattagccaggcatggtggtgggcacctatagttccagctactcaggaggctgaggcaggaggatcccttgagcccaggaggtcgaggctgcaatgagccattgcaccactgcactgcagcctgggtgacagagcaagacactgtctctaaaaaatataaataggccgggtgtggcagctcacgcctgtaatcccagcactttaggaggccgaggtgggtgaatcacctgaggtcagaagttcgagaccagcctggccaacatggtgaaaccccatctctactaaaaatacaaaaattagctgggcatggtggcaggcgcctgtaatctcagctactcaggaggctgaggcaagagaattgcttgaatccgggaggcaaaggttgcagtgagccgagatcatgccattgtactccagcctgggggacaggagtgagacttcgtctcaaaaaaaaaaaaaaatatatatatatatatatatatatattttttaaatgtataaatacatcatatatattttaatatataaatatattatatatattatatattttaatatataaatatattatatataatatattttaatatataaatattatatatattatattttaatatataaatattatatatattaattatatattttaatatataatatatattatattatataataataaattatatattatattatatagtaataagttatatattatactatataataatatagtataatatataatatatattataatatatatttattatattatattatattatatattataatataaattatatatattttatatatatgttttatatattatatattttaatatatgaaacaggggaacttcttctaaggaaaagacagaattaaggcaacaggctgatcctagtttaccagagaagaaactgaggccgggagcaggagcccagctcactgaagggcagatcccaagtcagagtccaagtctccccacttttttatttatttaattttttctgagatggagtttcattcttgttgcccaaattgagtacaatggcacaatctcggctcaccgcaacctctgccttctgggttcaagccattctcgtgcctcagactcccaagtagctgggattacaggcatgtgccaccacgtccggctaacttttgtgttttcagtagaggtggggtctcaccatgttggccagactggtctcaaactcctggcctcaagtcatctgcctgcctcagcctcccaaagtgctgggattacaggcatgagccgctgtgcctggccttatgtctccccttttgaattcagagccttcccccgtgtagtgagtgcttctgcctctctagcccttcctgtgggttctgcctgggcctgacctctgtgagagacctggcaggaacaggtctgtcaggcctt

SEQ ID NO: 14650 - DNA, 9455 bp, Human
aaagggtagcatagattggcagggttgggagttgggggcaggctgggcaaactggagtgagcaaggcctacttatattttaatactttaaagttatttttattaaactgtctgctgtccaaacataatacatgttgtaggccaaaatggccatgaagctaccagtttgcaaaccctgaactgtgaaatcttttagccacttccctatcttctctgttggagccatcattagtacttaaaaaagtacctttgagtcagggagttctattctactctgtgtttgtgagaaatacggccctgcccctctgggccacagtttcctcatatgtaaaatggggccactcatgtccacttcccaaccccagtgccttgtggtgagactgttgctccggggatgacggtcccgcccctcctttcaggaacaggcctttgagagcagccagaagtacaaagaggggaagtacatcattgaactcaaccacatgatcaaagacaacggctgggactgacccccgctcccccgacgcatgtggctccagcccggcctggccgccagggagcgccactggcttcccgccacccgaagggagctctggaccctcagagcccctgcagaggacggatctagctcctgtatatatattttattgcatgcactgtgaccttggggggagaacagaagggggacgacgcccccgcacctcctgcgatctggctggcttggatctcgtttttaacccgttcctgccccacctgccctatagttatggcctgtgttctgctctcctggtcccagtgcaccgtctgctctgtgaactcctcccaccaggcccttcttaccccacgcgtgtctgtccccctcgttctgtagcgtttgtacataataaaacaatggagtggagacagctcaggctcgcgtgtaatccgggaagggggagctcaagcggagatttccgcccctatagacctgtgcggttctgagccccggcggggcatggggtaggcacagccgtccaagctgggtctccgggaaccgggacggtttcactgctggcggaggtcctgagcccactctggctgcctacgccgtgacctcggctgatctgcgtctgctcatctgcagcgtttggccgccgcctaggggcagcgtcccagggaggcaaccgcgccgccggcctcgcagccccctcgcggtcggactgcaactcccagcggcccccgcgtggtccgtccggctccttcgggcgcgcctcagcgctgagcctgccgggaagtgtagttccgagggttccccagcgcgggaccttcgggaaaccctggcgcgaggcgtcagaagctgtcggactgtgagcgccttcgaactttggaggcttggctcgggatggaggtttttttagcatggggaccagggaggactacggtgctcgggactgggctgcggcctcctcgcggccccgagtgccctgtgaaatcagctcaggccgcgtccctctagcctgcactttccctctgttcacgctgcttccctccagggcccggcctccaagtgaaggggggcggagggcggtcacctgccagaaggtctggggcgccaaggtgtgtcccgggactcttggctccgtccaggttccaggccccgccccccagcttatccctagccggggctccccaccgtgggaacggggaccagctggccggaagcgccaaactgcgtccctgtccgagccctggggatcaatcaagccgaggagttaattatgtaatgagggggcagggggtcgaggctaatgaagcctcccggggtggggagggaggggaggaggggaccgtacccaggtatccgaccccctctcggaccccttcgaggccccaggggtctccaccccagcccaactccagggccccaaagaggggaggggctgtgatcctggatctggaaggggctgagctgtgagctataaagggggcatctcgcagcaccgggggccctaagcagcgagacctgaggccagacggaactacaacatgtaccatccacgagaattgtacccgtccctgggggccggctaccgcctggggcccgcccaacctggggccgactccagcttcccacccgccctagcggagggctaccgctaccccggtgagcgttgggaccagctcctgggtaggagaataggggggctgtggccctcggctggctcctcattcttccccggcttccagaactggacacccctaaactggattgcttcctctccgggatggaggctgctccccgcaccctggccgcgcacccacctctgccccttctgccccctgccatgggcactgagccggccccatcagctccagaggccctccattccctcccgggggtcagcctgagcctggagaaccgggagctatggaaggagttcagctctgtgggaacagaaatgatcatcaccaaagctgggaggtgaggggctggccagggtccgtgtttctggtgggggtctcttgggaaaggcagagtccctggggagggggctaggactgggtggttcccgaggggctagagctctgcctaggcctagaatctgactatggcctggggcaagggttactctgtggcaggaatcaggagtcactctgtgacaagggttaagggccagtctgtggagtctgtggctgagtttagggaccaatctatggcaagggtcatgggtcagtctggggcagggtcaggaagtccctctgggttataggttagtgtgtggcttagaccagcatccagacaaggacagggggtcaagggccagcccattgaccagcatcagggaaatctggccaggattcgggatcagtatgcaactcgaataggagtcagtatatgactaggtccagggtcaccctagaggcagggacacggtcagtgtttgaccttagatgaggtctttatctggggcaggaactcaagccctagcatggaaagtcctcggccctactgcaggcagggtatattttttctaaagcaaattcatctaagagctgcagattctggtgctggagatcaggggaggagaggagggtggggacaggaagctcctagcaagaaagttagtcacccctgcttctgcaaataggctttgaggggtaggagtcatggctctgttcctaacctgctgtgtgacagatcacttaacccgtctgtcctgtttccccaaatgtaaaatgagacaagaaaaccttccagctctaagattccgccctctggcttctttttttttttttttttttttttgagatggagtctcgctctgttgcccaggctagagtgtagtggcacgatctcgtcagctcaccgcaacctctgcttcctggattcaagcgattctcctgcctcagcctcccgagtagctgggactataggcacacaccaccacacccggctaatttttgtagttttagtagagacggtgtttcaccatattggccaggctggtctcaaacttctgacctcatgatccttccacctcggcttcctaaagtgctgagattacaggcatgagccactgcgcctggccctttttcatttttcagagacagtgtcttgccctgttgcccaggctggagtgcagtggtgcaattgtggctcactgtagtcttgacttcccaggctcaagtgaccctcccgcctcagcctctgtagtaactgggactatcagtgtgcaccaccatgcctggctaattttttaatttttttgtagagatggggtctttctatgttgcccaggctggtcttgaattcctgactcaagagatcctcccaccttggcctcccaaagtatagggattagaggtgtgagccacagcctccagcctgccctctgggttctaattccacctcctttgatgtttctctgacagctctggggagcccgttgttatgtcccgttactggtgctgggcccacccctggccagtgggtagctccaggcctctcctgtcccctcccttgcacaggcgcatgttccctgcctgccgagtgtcagtcactggcctggaccccgaggcccgctacttgtttcttctggatgtgattccggtggatggggctcgctaccgctggcagggccggcgctgggagcccagcggcaaggcagagccccgcctgcctgaccgtgtctacattcaccccgactctcctgccactggtgcacattggatgcggcagcctgtgtctttccatcgtgtcaagctcaccaacagcacgctggacccccacggccacgtgaggcccaggctgggactccaggatagggttggggggtgctggaagggaggccaagggtgaggcgcagggcagggaatcactcccatttcctccctcccagctgatcctgcactccatgcacaagtaccaaccccgcatacacctagttcgggcagcccagctctgcagccagcactgggggggcatggcctccttccgcttccccgagaccacattcatctccgtgacagcctaccagaacccacaggtgagtgaccctgcttgagggggtggtggccccctgcccagaccgcagttgctttgaccctgcatgtgtgtccccagatcacacaactgaagattgcagccaatccctttgccaaaggcttccgggagaacggcagaaactgtaagaggtgggagttgttcattcatttgttcatgcattcaacaaatgtttattaatcactcactgtgtgccaggcaccgtgctggacatcagaaatgcagtggtaagtgaaaacattcattcactgactcagcaaatacttatatagtacctgctatgtgccagggacagttccaggcactggagataaaacaaacaaagcaaaccaaagccccggccctcatgcagctgatttctagtggggagagtagacaagcagacaagagaaataaataaaatgtcatctgttaggaagccattctaaagagaagagagaccaggtgtggtggctcacgcatgtaatcccagcactctgggaggctgaggcgggcagatcacctgaggccaggagttcgagaccagcctgccaacatggtgaaaccctgtctctgctaaaaatacaaaaattagccaggcatggtggcaaacgcctgtaatcccaactacttgggaggctgaggcaggagaatctcttgaacccaggaggtggaggttgcagtgagtcgagatcatgccattgcattccagcctaggcaacacgagcaaaacttcctctcaaaaaaaaaaaaaaaaagaaagaaaagaaaactctgtctcaaaaaaaaaaaaaaaaagaaaaaaaagaaaaaggagaagagaaataaaccaggaaaagataggaaggactggggtgaggtattagataagaggcctggaaaggcctcagtgggaagaagacacttgagaaagagctgaaggaagtacgggagggagccaggtgggcatctggcaaagcacactagggagtgggaacagcacgtgcaaaggccctgaggtggggctgtgcctgtggcgtggctgcagtggagtgactaagagtcaggcaggggaggggaagccaggttatgtcggacagtaaaggttccgtaaggccgtgggaactgttccaagtgcagcacctcagagctggcccctgccctcaagtagcttccagtttgtcagaagagacagacatgaaccaaggagtcactccatcaaatgcaaaagcagaactgtgacggatgttatgagggaggggtgtgtgctctcggaggtcagggaggacttccttgaggaacttgcgcttgcagtgaggcaaggataggtttggtggctcatgcctgtagtcccagcactttcggaggctgagatggaaagatcacttgagcccaggagttggaggctgcagtgagctgtgacctgtgactgtgccactgcactccagcctgggcaacatagcaagaccccatctcaaattttaaaaatgaaaagaaaaaggacaggttcagcccgtgaagaggggacagaagaggattccagagagaggctgagagtggagatggggcagaaagatgagctaggtgagactgtgccctggccttgccactgggaaggagtttccactgatactaaacacaataggaaagcatggacaaatttgagcagggacaaaattccagctctgccactttctagttatttaattttctggccttcagtttcttcatctataaaatgggtataatgatggcccctacctgacagggtccctgggagggtgaaatgcctggcaccgggtaagtactgttaccatcaccatggccatcaccatcatcatcatcaccaccactgttccccagggagcgagacgcccgtgtgaagaggaaactgcggggcccagagccagcagccacagaggcctatgggagcggaggtgagtgtagtcccgatggcgatggggccaggcctgagacagggatcctccctagcccaacctctcccttccctctccccagacacaccaggtggtccctgcgactccaccctgggtggagacattcgtgaatcagatccagaacaggccccagcccccggggaagccaccgctgccccggcacctctgtgtggtggccccagtgctgaggcctacctcctgcaccctgcggctttccatggggcccccagtcaccttcccaccaggtgagtgggacaggggaccaggcggggctgcgggtccctctgccctgctctgacatccctctctccatgtcaggagccccagcttcccggaggctccagactccgggcgctcagccccctactcggctgcatttctggagctgccgcacgggtcagggggctccgggtacccagcggctccaccggcggtaccctttgccccgcactttctccaagggggccccttccctctaccatacaccgcgcctgggggctatctggatgtgggctccaaacccatgtactgaaccactgctgggcccctctgcctccatcacaaacctcccgctcccttcccccagccctggagccccctcacctccaccggccccatcccccacaccaaatggccgccttgggcctgcccacccaccccctcaacttcacaccttgatttcactcccacccccctctggcttcaaagcctaaccaaggctgctgggagtccagctggggccggcttccccttcccggctctcacctccgtgtgaatggaaggggctctgcctggccaaatggggccacagaccagcatccccacttaccaggcctccccatgggctctggaggggctcaatccccacccccccacacacactggtgcaggccacaccagtctgttgttctgggaccagagtatttttgttaataaaactcaaaagccatccatgctcaggaaacattgggctcctgtgtttggccctgggcggggctgggtgagcaaaggctttgctaggagacccaggcccagatctagacctgtgtttccagctgcctgacctagcacaaaatccactggccctctaggcccatctcctcttcaggaaaatggagaaatcagaatcctgtgattctgtgtgtgcctgtgtgtgtatgctgttaataagataaggctgcccatgagaacagagccctctccctagggctggggaagccagcaggcagcggcccctggaggccctgggcaagctgactggcctgagcctggccctcttggcaggtcggggccctgaggcagtcaaggccctgacgtccaccccaggtcccaggccagcaaccctgtgcattcccaaccaagtctggcacaaacccaaaaaccatttttcttcttttattagaattttttcattttttttctcaaaatttttatctaaaaacaaacagaaaaaagaaggaaaaaaagaaaaaaaaattattggaaacttcatggttcaagtggggagagaggaggaggaacatggagctaggtctccaggcctctccagagaagtcctcaccctcgaagcaccctcttgggggacagcagagccaggacagccccccccacgcccagcctccgtctgaggaagatggcagagtcacagtggtgcgagggccagaagggttggagggggcaggggccgggcggggtcacaggaagtagtcggccacgggcttcttggaggggatgccccgtgtctcttggggagcagcctcaaagatgatgaaatctttctggagatgctcgtccagctccaagatggctgccacattcccacagctggaaggcggggcagcagggtcaggagcagctcggctcagatgcccgcccatcccagcccggcccagccggctcaccggtagcagtagttgggtgccgaccacacagtgagcaccgtctcattgaagtgccacttgtaaccttccatcaccagttggtgggcacggcagatcatgtcaatgtcattggctgcgttgaactgggccaccacgtcactgccaaataggtagccggctcctcgggggctcacgccccagcctgtggtgtctgatgcggaaagggagggatggagagggatgtcctcaggcttctctggctgccagcgctgccccttgagggtgagcagcctggcccctccccaagtccaccagaggcccgtgggaccagagcatggggcctgaatatggtctgtgggatggcggggaccaggacagcaaatgtaggggcagataagctccagaggagaaagaacgcccaatgcctggggccccctcataatcacagtgatcatacaatccccgtccaaacagcacataagagtgaaaggggcactcccagagacagaagggcaccctgtgttgtcacagggaggtccggagtgactgtggagcagcggctgcatgtgtgtgtctgcatgtgtgtgtctgtatgtgtgtggctgtgatggagcagaggcctcgtgtgcgtgtgtgtggctgtgatggagcagaggctatgtgtatgtgtgtgtgtgtctgcgctggagcagaggctgcctgtgcgtgtgtgcctgtgacaacaggaactctggctggtcctcagaagacctgactttaaatctcagctctgctctacactagtggaaaacccacaaaatgaggggtctcagggggctaccattctggggttctgacctctgaagaagctgctgtcatgttctaaggccccttcacttcagggagccatgacttggttgtcctccacagccctctgggccatgccccaagccactgtgtgctcaaagcacctgccatgcagacctccctgctcctcctccagggttccagccatttggcaggtggaggacgagtgacagtgaagaccagccctgctccctctctttcccaacccctcctggctgtccctgcctgcccctgcccacatgccctcaccttctgggtcagaccagaggag

SEQ ID NO: 14651 - DNA, 13316 bp, Human
ctaagaagccaggcacggtggctcaagctggtaatcccagcactttccgaggccgaggagagtggatcacctgaggtcaggagttcgagaccagcctgaccaaaatggtgaaaccccgtctctattaaaaatgcaaaaattagctgggcgtggtgacgggtgcttgtaatcccagctactcaggtggctgaggcaggagaattgcttgaacccaggaggcggaggttgcggtttgccaaaatcgctccactgcactcccgcctgggcgacaagagcaaggaaggctctgtcttaaaaaaataaataaatgaaaatacaaaaattagccaggcgtcgtggcacatgcctgtaatcccagctacttgggaggctgaggcaggagaatcgcttgaacctgggaggcggaggttgcagtgagccgagattgtgccactgcactccagtcggggtgaaaaagcaagactccgtctcaaaaaaaaaaaaaaaaaaaaaaaaagaggccgggcacggtggtacacgcctgtggtacagcactttgggaggctgaggcaggtggatcatgaggtcaggagatcgagaccatcctggctaacacggtgaaaccccgtctccactaaaaaatacaaaaaaattagccgggcctggtggcgggcgcctgtagtcccagctattcaggaggcagaggcaagagaatggcgtgaacccgggaggcggagcttgcagtgagccgagatggcgccactggactgcagcctgggcgacagagcgagagagtgagactctgtctcaaaaagaaaaacggaagcaactaagaaatgtcaagagtgccattttggaatcagagaagtcatgctgactgaggcacaggcttggcgtgggaaaagtggactccaatctgttaacttctgaagttgtccacggcaaatatttctctgacggcacaggaagagatctgaacttggcttccctcatccattgaacaagtattaacaagtatctatatatgcctaccgtgccaggccttattctaaccactggggctgcaatatttaaaaagacaaagttggatcctccaaggactgtggtggggaaggctgacaaaacaagtaacaaaaatgtgtaacattaaaaaaaaagtgtaatgttaaaaaaaaaaagtgtaataaagttacaaagcctagccccagctcggcttgtttccctagctgaaatgggggatggccgggcgcggtggctcacgcctgtaatcccagcactttgggaggcccgaggcgggaagatagcttgtgcccaggagttcgaggtcacagtgacctatgatagccccaccgactccagcctgagcgatagagcgagaccctgtctctaatttagaaaaaagaaagttgtggccgggcgcggtggctcacgcctgtaatcccagcactttgggaggccgaagggtggtggtgggtgggggcgcggatcacctgaggtagggagttagagaccagcctgaccaacatggagaaaccccgtctctattaaaaatacaaaattagcccagcgtggtagcgcatgcctgtaatcccagctactcaggaggctgaggcaggagaattgctggaacccgggaggcggaagttgcggtgagccgagttcgtgccattgcaccccggcctgggcaacagcaaaactccgtctcaaaaaaagaaaagacagttgtttaaacatttttatgaaatgatatgggaggggactggtctagggtttctaatagcctccacatcgcccagcggcagagcccacaaaactgccactggccgccaccgggttcctccacctccttcccgatctcaggctggagaagtggtgcaggggtcgctgcgaaaggagaggagcgtgtatgacgccacatccggcgcgcggcggaactggcctcctttgcttccgcggcggggccggaagtaggagcggcggcggcggcggcggcggcggtcgaaagcggagtgaaagagggaggcagggagccggagagccggaaccggagtcgcagcggcggtaatagtgcgagactcctctaagtcaccgtccttagcgcgggaccgcggggttcgacgggagttagcgggggtgcggccaggccgttggacgccggggggtcctggggccgatgtgaggggaggcgggggtgggggagccgggccggctctagaatcgagttgtccgctccgagccccggacggacactgatccgcgggctcgtcttggcctttcccaggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccaggtgagctcgttggccctggggaagggaggccaagccgccgcccacgggttctggcctggggcaaacccaactgagaactttgggcttgcctcgttctggaagctttcccagagaggagcaggatggagccgctgccctcgaggaaaagctagcctgctcggggaagacagagtggataaagacacttaaagtttattagacgatgtgtttccagtggagtaagagtgttacataaagtacttaggaaactcaaggaaacaagtccatctgtcgggggacggaagcttgttggaggggggccgaactgtgggagaggcctcgaataaggaggtggtaaaagagtcagccaaaaaccaaaagtttaagacaggaaagttaaagaccctgtgatttataaaagtcttctaattacaacaacccttaaagattggtggtattgtactcattttacaggtgggaactttcatgttcaaagttacccacaagtaaggaatggggtctgaagccagctcttagtgtcctgtcctttttcaggccataatgcaaaaaggtggagttggatcattcacgttcagggtgggagcctgagaaatcgtagcaagtaagccagggtagaattaagcacgatagggaggccagttcagagttctgtgggaagtaggatgatgtagtggttaaggctctaggttttgcagtgtgagatggctctaggtttgaatctgaactctgccgctttctagctgtgttagtaatcttaagtgtctttatttgtaaagcagaattaatagtacttaataagatgattgtgaagattcagtgagttggtgctggagatgaggttagcacagtgttttggtacagcatacgtgcttgataatcaccaggtattctatttcttttggaagagggcaataatgagatgggctaaagccatcagggagggcttttgagtggaggtaggccttgaaggatgaagataatttggctagctgatggaggcagggccagtgagggaagggcattccaagcaggacgaatgtaacagtggaggccctgagatgcgtggggaacagtcaggggtttaattacctgcctcctctggggaactgtgtgattgtggcttctaccaggctggagaattgtggcagaagagcccacagaattaccctacgtttattgaacagtaaacattggcctttacagggccactatttggcctggcccggtactggcaaaaaacttctatccatctcttccccccagcaatcctatgaggttggaatcatttgctgcattttatcgaataggaagccatgactcgtagaggtctggtgacttaactgaggtcacccactgaggacgtggcagagctgggtcctgaatctgtggccctcaggctctttgcctggccctgcctcacatagactacctgcagccagacagggcctgtgaggggatgatgagcagggtcggcctctttttcgccacctgtctgtggcttttctcttttgccagctgaccagaccagccccatggtgtttttagttgtcccctttccctcagtcctgattggcatttttaggaacttaaacctgttgttgcctggcactattctttaacctcgaagtattgtctccctcacgggccctggatcagtgtggtggtgatggtagacaaagcttagatagcatgctggagtttgcagaatagcaggaagtcgtatattcagtctccatggctccttgcaacagcctaaggaatacgcagggtgggctgagtacttagccccatttcatagcagaggaaactgagcctttgagtagataatgtcttgcccaacatcacgcagctagtcggaggggaagttagttttgcatccaggtctttgactgtgctccgtggtcactgagagccaggcagaggcatttagattttgatgtggggtgtgaggcagcaggaagccatggaaggctgaggggtggagggtcctgcccagttgaaactgagtggaactaggaggtactaggccaaggcctgagttggccgctgttgtcccaggctcagtctgaagcagggccatctctgatacctggttatggcctcctggggacccatcagagacccaggctgaggctggtggtgtcaagagcaccagcttgcctagagggcacagacatgcagatgaaaccagtggaagcacagaggtccgcagtgtctgagctgaaattgctgctactagaaatattagcacagtaggagagctgagcttttgaatcaggtggtcttcagtatgaatctttgccttgtcacctagaagcaatatgaccctcgtcaagtcactttctgattttttgaagtgataatgacatgcagttgagagtccgggtatccgggcacagggcctgctgcgctggtagccgttactgcaggcaggtcctgatagggctggggaagtgctgcaagtggcagaactggggctggaatctgggcctgattcccaggccacactggggttgcgctggcactgaggggggctttgcagagagcacgggccctgcatgtgacctccctgggcttcaggttttcactcagggtctgtggaaggggctggcataaattctcaggaaattgggcttctgggttccaatttagccactctccagcttggtgaccttgaccctcccgcttttctgtaagctttggtttctttttttctttttttttttttttgagacagagttttgctgttgttgcccaggctggagtgccagtggcctgatcttggctcactgcaacctccacctcctaggttcaagtgattctcctacctcagcctcccaagtagctgggattacaggcacgcgccaccatgcccagctaatttttgtatatttactagagacggggtttcaccatgttggccaggatggtctcaatctcttgacctcatgatctgcctgccttggcttcccaaagtgctgggattacaggcatgagccaccgcgcccggcctagcttcggtttctttactgttacgtgaggctgaagagaacctccccagtctgttggaaaggtcactatgagcagttgatggggaaggatgttcagcacaagaagcagtgcaggtgggagagtccgggtactgatgtggcctcttggaccaccgccagtgctgccttctgttcccagaaagccagggcagacctccttcgtgctgcctctgccatacagagcaaggggcataagtgaatcctcctgtccactgagctcaggaaactcattctaagggaagagattggcagaaagaggggggccaggcgagttgggcctcccacatcagaatatcttgataaagagtcagaccccagagccaggcttccctggttcatatcccacctgtgtcactggcaccaagccagcctccttccctgcttcaatttcttcatctgtgtaccgggaatcatcatagtacctgcctgccaagctcttaataacatttgtggcacacagtatgagctcgaatgttcactgctgctattaccaggcaaaatttggaaatacagtgttgcttaaattgggtatctataggctgggtgcagtggctcacatctgtaatcccagcactttgggaggcaaaggtgggtagatcacttgaggtcaggagttcgagaccagcctgggcaacatagtgaaatctcgactctactaaaaatacaaaaattagctgggcgtggtggtacatgcttctaatcccagctactcgggaggttgaggcaggagaatcacttgacccaggaagcagaggtttgcagtgagcaaagatggcgccactgcactccagactgggcaatggagccagactctgtctcaaaaaaaaaaaaaaaaaaaaaaaattgggtgtcttacctggcaaagtgatttcatctcctgctcactcaagtagaagtagactgcactgcaaggagaaataaaaaatatttaagtcctcatagtcataaagaaatactgaacacatggcaagagcacctcacttttttttttttttttttgagatgaagtcttgctctgtcgcccaggctggagtgcagtggcgcgatcttagctcactgcagcccccacctcccaggttcaagcgattctcctgcctcagcctcccaagtagctgggattacaggcacgcgccaccacgcctggctaatttttgtatatttagtagagacagggtttcaccatgttagtcaggctggtctcaaactcctgacctcgtgatctgcccaccctggcatcccaaagtgctgggattacaggcatgagccaccgcacctggccaagagcgcatcactttgaaggcgcatccactgtgggcctgccctgggcacctacccttgtgtctggatagcctgggagaagggctctgtgattggccaagggtgacttaagctctgctgtggagaggatggggagacccgcctcccaggagtgagtcctggatgcggaagagggagcggcagggggagtcagggctggaaaagtcccagcctgctcagaaggcctggaacgctgggataagaggttggactttgtccttttggcagcagggggccacggaagggtgttgcatgctgaagggccgtggtcagcctgttttggggagactgtacgcttcactcctgccccctggagcttccaggactgcctcatatcctcccctccccccaaaaaaggtcaggaattgggctgggctggcctggctgtggtgaccctggtcttctcctgtctccagagagatcttggtagaggagagcaacgtgcagagggtggactcgccagtcacagtgagtacctgctgtccctgcagagccaggcctggtctttcaggcacatgaagtttcctcttcatcttgggggctctataagcccaaccctaagctcttttatctgtcctttccctcaccttcaacggagcactgctaaaagaagtgggggttgctgtgcacgttggctcacacctgtgatcccagcattttgggagggcaaggtgggcacatcacttgaggttaggagttcgagaccagcctggccaacatggtgaaaccgtttctactaaaaatacaaaaattagccacgcgtggtggcacgtgcctgtaatcccagctacttgggaggctgaggcaggagaatcgcttgaaccccagagttggagattgcagtgagctgagatcaggccactgcactccagcctgggtgacagagggagactccgtctcaaaaaaaaacaaaaaaaaacaaaaaaaacaggccgggcgcggcggctcacgcctgtaatcccagcactttgggaggccgaggcaggtggatcatgaggtcaggagatcgagaccatcctggctaacatggtgaaaccccatctctactaaaaatacaaaaaaattagccaggtgtggtggtggacacctgtagtcccagctactcgggaggctgaggcaggagaatgacgtgaacccaggaggcggagcttgcagtgagccgagatcgcgccaccgcactccaggctaggcgacagagtgagactccgtctaaaaaaaaaaaaaaggaaagaaaagaaaggggttatgggaagggactttggatttgttagtggagattcttggccagggcagaaggactcctatttggcgagtgattctgctcacatatctccagggctctgtgttagtaacttgattctgggtactttgtggggagtagagagaggaaggggccgggacatctacctggaaggacttagttctagctcttgcctacagaatagttggtactcagcataggacagtgggtatggttccagaccagactgacttggggtgggagaggagaattttggtcctaggaagtagaagtgcagccaagagtgataaagctcactaaagcagcgggtgtttggagggtagtccctggcaactcccactgcttgagttccaaccccactcttcctgttccccaggtgtgcggcgacatccatggacaattctatgacctcaaagagctgttcagagtaagagtgtggccaacactgtgaaatgtaacggggggatgactggaagacccctgtaattgagggtgggagccttaatttggggcgtggagtgggggcaaggggccccaagttagatgggtggttgtggaagaagggcctccgctggacagaaacaggtagggggtaggggactgtttacgacagggcaaaactttctacttccccacaggtaggtggcgacgtccctgagaccaactacctcttcatgggggactttgtggaccgtggcttctatagcgtcgaaacgttcctcctgctgctggcacttaaggtggcagtccccggcttctgcacccccaacctgggcgacctcgggccgggcctgtcttagtccgttccgccctcatctcctatcgtgaccagccccaccttggagctgtgtcactggtgatggaccgattctgcttttgggggtggtcagagacttgatgggggttgaggccagcggggcagcattctgggaggggcagaggctcactgttgcgaatgtggcaggtcattgatgccactggtgggagaggcagtgtggggccagatgacaaagggcctgggtgccttgctagggacccggtctgtgtctggtaggtgaaagaagagccattaggttcatagttgagggaatgggtcagctttacattctctggaggggtcgtgtgggcctgggaggtggctgatgccacacgattcaggcaagaggtgccaggagtgtgctgggcagtggttgtgaggatggcaggctggcgggcacgaggaggtcagagagggatgtgtggagagaccgtctaggcgccagccctggcttggtggccacccccaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaaggtaagccagcccagggctccatgggacagggagaggaggggggcttcaggcctcagccccgtcctctttccctgctctcccctgtagatcttctgcgtgcacgggggcctctccccctccatccagaccctggatcagattcggacaatcgaccgaaagcaagaggtgcctcatgatgggcccatgtgtgacctcctctggtctgacccagaaggtgagggcatgtgggcaggggcaggcagggacagccaggaggggttgggaaagagagggagcagggctggtcttcactgtcactcgtcctccacctgccaaatggctggaaccctggaggaggagcagggaggtctgcatggcaggtgctttgagcacacagtggcttggggcatggcccagagggctgtggaggacaaccaagtcatggctccctgaagtgaaggggccttagaacatgacagcagcttcttcagaggtcagaaccccagaatggtagccccctgagacccctcattttgtgggttttccactagtgtagagcagagctgagatttaaagtcaggtcttctgaggaccagccagagttcctgttgtcacaggcacacacgcacaggcagcctctgctccagcgcagacacacacacacatacacatagcctctgctccatcacagccacacacacgcacacgaggcctctgctccatcacagccacacacatacagacacacacatgcagacacacacatgcagccgctgctccacagtcactccggacctccctgtgacaacacagggtgcccttctgtctctgggagtgcccctttcactcttatgtgctgtttggacggggattgtatgatcactgtgattatgagggggccccaggcattgggcgttctttctcctctggagcttatctgcccctacatttgctgtcctggtccccgccatcccacagaccatattcaggccccatgctctggtcccacgggcctctggtggacttggggaggggccaggctgctcaccctcaaggggcagcgctggcagccagagaagcctgaggacatccctctccatccctccctttccgcatcagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccggtgagccggctgggccgggctgggatgggcgggcatctgagccgagctgctcctgaccctgctgccccgccttccagctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggtttttgggtttgtgccagacttggttgggaatgcacagggttgctggcctgggacctggggtggacgtcagggccttgactgcctcagggccccgacctgccaagagggccaggctcaggccagtcagcttgcccagggcctccaggggccgctgcctgctggcttccccagccctagggagagggctctgttctcatgggcagccttatcttattaacagcatacacacacaggcacacacagaatcacaggattctgatttctccattttcctgaagaggagatgggcctagagggccagtggattttgtgctaggtcaggcagctggaaacacaggtctagatctgggcctgggtctcctagcaaagcctttgctcacccagccccgcccagggccaaacacaggagcccaatgtttcctgagcatggatggcttttgagttttattaacaaaaatactctggtcccagaacaacagactggtgtggcctgcaccagtgtgtgtgggggggtggggattgagcccctccagagcccatggggaggcctggtaagtggggatgctggtctgtggccccatttggccaggcagagccccttccattcacacggaggtgagagccgggaaggggaagccggccccagctggactcccagcagccttggttaggctttgaagccagaggggggtgggagtgaaatcaaggtgtgaagttgagggggtgggtgggcaggcccaaggcggccatttggtgtgggggatggggccggtggaggtgagggggctccagggctgggggaagggagcgggaggtttgtgatggaggcagaggggcccagcagtggttcagtacatgggtttggagcccacatccagatagcccccaggcgcggtgtatggtagagggaaggggcccccttggagaaagtgcggggcaaagggtaccgccggtggagccgctgggtacccggagccccctgacccgtgcggcagctccagaaatgcagccgagtagggggctgagcgcccggagtctggagcctccgggaagctggggctcctgacatggagagagggatgtcagagcagggcagagggacccgcagccccgcctggtcccctgtcccactcacctggtgggaaggtgactgggggccccatggaaagccgcagggtgcaggaggtaggcctcagcactggggccaccacacagaggtgccggggcagcggtggcttccccgggggctggggcctgttctggatctgattcacgaatgtctccacccagggtggagtcgcagggaccacctggtgtgtctggggagagggaagggagaggttgggctagggaggatccctgtctcaggcctggccccatcgccatcgggactacactcacctccgctcccataggcctctgtggctgctggctctgggccccgcagtttcctcttcacacgggcgtctcgctccctggggaacagtggtggtgatgatgatgatggtgatggccatggtgatggtaacagtacttacccggtgccaggcatttcaccctcccagggaccctgtcaggtaggggccatcattatacccattttatagatgaagaaactgaaggccagaaaattaaataactagaaagtggcagagctggaattttgtccctgctcaaatttgtccatgctttcctattgtgtttagtatcagtggaaactccttcccagtggcaaggccagggcacagtctcacctagctcatctttctgccccatctccactctcagcctctctctggaatcctcttctgtcccctcttcacgggctgaacctgtcctttttcttttcatttttaaaatttgagatggggtcttgctatgttgcccaggctggagtgcagtggcacagtcacaggtcacagctcactgcagcctccaactcctgggctcaagtgatctttccatctcagcctccgaaagtgctgggactacaggcat

SEQ ID NO: 14652 - DNA, 10229 bp, Human
agagcaagactccgtttgaaaaaacaaacaaacaaatagatctaattcttttgaaaacattaaaattgattgggcgcagtggcgcatgcctgtaatcccagcactttgggagaccaaggtgggtttagcccaggagtttgagactagcctgggcaacatgatgaaaccctgtctctacaaaaaaatacaaaaaatgaattagccaggcgtggtggcacgtgcctgtaatcccagctacttgggaggctgaggcaggagaatcgcttgaacccaggaggcggaggttgcagtgagccgagaccgcgccatggcactccagcctggcaacagagcgagactccgtctcaaaaaaaaaaaaaaaaaagtacaaaaaatgagccgagcacggtggttcatgcctgtaatcccagcactttgggaggccaaggcgggcagatacctgaggtcaggaattcaagaccagcctggtcaacatagcgaaaccctgtctctactaaaaatacaaaattagccaagtgtggtggcacatgcctgtaatcccacctacttgggaggctgaggcaggagaaccgcttgaatccagaggtggaagttgcagtgagtggagatcacgccattgtgctccagcctgggcaacaggagtgaaactccatctcggaaaaaaaaaaaaaaaaatggccgggcacagttgctcactcctttaatcttagcactttgggaggctgaggcaggtggatcatctgaggccaggagttccgagaccagcctgaccaacatggtgaaacccccatctctactacaaatacaaaaattagctgggtgtggtggctcacgcctgtagttcagctactcagaaggctgaggcagaactacttgaacccaggaggtggaggttgcagtgagccaagatcgcaccattgcactccaccctgggcaacagagtgagaccctgtctcaaaaaaaaaaaaaaaattaaaaataggtaaattgccattttcaaagatacctgtaaagatttttaaaatcattcatgaatgcggtctgttcgttgcacagagtagatgctcaaaaatggtgaatgagaccctctattttggtctcatgctgaagaagtccataaagcccacaagtcattttcatgatggacagaaaaatgtgtgtgctttctctgtctactgcctcaactgcacagaccccgggactgtagcagaaccatcttttgagcttgacaccgggaggcccaaattctagcacgggacccagggccagttgctctctggtcctcagtctcctcacccataaaatgggaaggagagaaccctgaatcattgcttctagcttctgaactcagttgttcagaacaaggactcactgctgatttttcaacagcacagggaattgcactgttcctgggaatgatggacagtaccctctgttccactgggcaagtgagatttcccaggcctctctgttcccttctccccttagagagcaacagacgtggccccatcccacctccctcaaccctctctctcctccctcaggactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtgagtgtagtgccagtatctactctccttcttaaaaaaaaccagggctccagagaatcagaacagccaccatcaccgcagggagtcaagggaggagggagattagagaaggagccagggagggtggcagggaggccacgtgatccgagtcccctcacccctttccttcccacaggtccctggccaaagatttatttctcttgacaaccaagggcctccgtctggatttccaaggaagaatttcctctgaagcaccggtgagtgggcaggggctccctccccatcaatagggccgacccaagtcttcctcccccttcccccatgccgggccccacgatagtgtgaatgtcaggggcttcaggtttccctaaatataggtccctgccagaggatccgtggcgggaaaagggcaggggtcattagagaagatcggggacacatgtggggcgggcaggagctgccttataaccagcccgggaacccctagctcactcgctgctgaccaggctctgccggctccttcggcctcgccgcaggtgggccccttgcaggaccgggccggggtggggatggggttggggttgggccaacagggtccagatggggtccaggtgaggaggggagatttggacgataggagcagggggctcagcatctgggaggcagatcagttcggggacggattttcttttggagaaggaagtcaggctcaaggaagacgtttggcaggaactgtgaccccgcatgccagaggccgagcagcggccggtgcatagccgcgcattctggttttctgtggcgcagaggactaccagcctggctgcggcggcccggcggagagcgcgcacgcatgcgcgacccagcccggcctgccagcctggaactcggatggggaggtctcgcctccgcgcgccgctagttccgccgccttctcgcgctccctgcgtgtcctctcgatgccctttcctccgcctcccttacgcctgggccagtgacagggtgtcggctccgcgccgattcagcccgcgggcgaggcaggctaacgcacgactgcgcgatgtggcccctatggtgacacgcgctgcagccgcgaagaccggaagctggggcggccccgggccgcgcgcgctgggcctgggaggcgaaactcagcttccttcgtttccgacttttccatccgcgtcctccacttccccgttccgccctcccccattgccaacattctggctgagtcacggcgccccagagcgcgccaggctgggggaaaggagcagaagggagggccctagcgacccgcgggatgtggtccgagtcacgtccgaggggggtggggagggatcgtgttctcggcgcccgccccttcctagcgcggcctctgggctgcgcctctcgggggcggcccgtagcccagtccgtcgcctgccattggacgccgcccgctcctcgtaaaggaaaaagctcggcggagggcggagtggtgcctttaaaaggccgggcgccgccttccgcctgcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggtgagcgcccctcttcacgtgcggggaccagggaccgtggagagggatcttgggggcagtggcgggttgggcgtccgcgtggaggcctcccccatcccatgccagcgtctccccactaccaggcacacacaggctccccggcccctccagcctgaggtcctctaactgcgcaatgcagcggctgcgcgcgctgagtcatggcgggggaggaagccggacgagatgaaggaccattctcccccttttcttgcagggacccctgtggcaaaggattagggccccttagccctggcggggatcctaagaggcagtgaggggtgggggccggcccatgtacagccccagggttctcgcaagtgggagcttggtttctgtcctgggaaacggggcgcccttcgcgaggagggaaacccctccgcggtgcttgatgcccccttaacactttccctgtctctccttatcgggcgaccttgattctgagcccggaacagctgcagccatgcgaagcgacgggagcatttttcaggggaaggcgcttgctcctccacgttcttgccccgtaggaacagtgacgatggcaaagcttaccgctttcctcgcctcgggctagggcttgttccgccgccctttcctgggcttctccttgctctcttatatttttcctaatgcccctttcctaccacccgccccctcccttgtggggaaaagcctgaccttgggatgtccttgaagccttggagcccgggccagccctgggatcttgaggggattggaaggaacaccccagtggcagtcagaagagctgggttctaatctcagatctggctccggggttgctgtgtggcttgaagcacagacctttcccatatctgggccctttcccacgagggtgttgggccctctgcttgattcacgatctttacattctaaaatactccggttcggttttgttttcaggcaaggtgaccccatggcaaggcgcaagccagaagggtccagcttcaacatgacccacctgtccatggctatggccttttcctttcccccagttgccagtgggcaactccaccctcagctgggcaacacccagcaccagacagagttaggaaaggtacaggggcaggcctagcaaagggaagttgggcgtaagagagagctggggaccagaagtgccccagggcctgctgggtgtggggcaggggaggtagggaacatttccctgacctccaggagaggggccctggtcatcgggagatgatgggaaaccctagctaactagtccttcccctctgtttcctgtatccaggaacttgctactaccagcaccatgccctaccaatatccagcactgaccccggagcagaagaaggagctgtctgacatcgctcaccgcatcgtggcacctggcaagggcatcctggctgcagatgagtccactggtgcgggcaggagacagaatgggtggagggtgcagggttgggagtggcaggctgatcccctaattcccatgtgacactcccagggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtaaggggagggcctccggacgtgaggtttgagatggaagtggaggaaggaaatccaggttagtgaggcagggaatgaatgctggattggtggcctagagacttgcatggagcctgcttcaggcttagggcatttactcgacatttttaatcctcacaattctgagagaacagtatcattcccactttacacatgaaaatctcagaagctcagggaagtgaagtgttttgctcagagtaagtggcagagccccagtctgacacccaattcactcaacatttctgttgtcaaataacatcccagtgtatcctgtctcagaggattgttactaagtgaactaagtgaaaatattttaatttaattgtaactaagtatttgagtaactaaacattttaagtaaattttttttttttttttttttgagatggagtctcgctgtctcccaggctggagtgcagtggtgcgatctcttggctcactgcaagttccgcctcccaggttcacgccattctcctgcctcagcctcccgagtagctgggactacaggcgcccgccaccacccggctaattttttttgtatttttagtagacactgggtttcaccatgttagccaggatggtctcgatctcctgatctcgtgatctgcccacctcggcctccctaagtgctgggattacaggcgtgagccaccatgcccggcttaagtaactaaatattttaattgtaactaagtgaaaatatttgccagccctgagatgcagtttaagggattaagtaaatgtgggggaagactggggctaaagaagaggaaagaggggcacgcccagctacctaggaggctgaggcgggaggatcacttgagtccaggaagtggaggcttcagtgagctgagattccaccactgtactccagccggggcgacagtggaaagggtgctagaggtcatttcctgtgtcttaatgttgttaccctgaccccaacaggtagacaagggcgtggtccccctggcagggacaaatggcgagactaccacccaaggtgagaactgtttgattctctgccctacgaacccaaccagagcaggtttgggtgctgggaggagtggaaaccacatgcccctccccaccgtgctctgaccccttcctcttctcttagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcaggtgggcctgcaggtcctcaataggcaacctcctacctcatttggttccagtgttgttaatttgcctattacctgccatgatgcctacctccccaaaagcaagcattagctttggcccgtggaggacactcaagggctgttgaaggcagaggggccaaggagggatggtgggtggatctgaggcggctcttgtctcctgtaatctgagggctttgaagcctgagtccctggcatcatcaagatacggtcttgaccagtggctgtggagagatgtaggtgggactctgggttaggaggcctcacagtgaccctgtccctcgccctgcagaatggcattgtgcccatcgtggagcctgagatcctccctgatggggaccatgacttgaagcgctgccagtatgtgaccgagaaggtaaatggctacctgcctgaccagtgcaaggtggctggccggggaccctggggctaacccctatcctctcctccaccccactacccaccgtgcgcctgctctgctccaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactggtgaggcccacactcatcttgatctctatgcagtagataagctccacccacaaccctatgcccatttggacggatttccatggcaacttccaccagctcctgccagcttcctgggtctctgaccacagcccctctcgcctcacccctgctctacagggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggtaaggataggcaggaggtgggcagggtgcctgggtggatgggactcggagaagagcccttctcactccacccctctccctgcttaggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggccgtccgtgtcttgtggtgtctaatgcaggggagggcctggggaggtagcagagcccagaagaagaaagagcccctgttctctgttttttctgggcagaaaaggagtgaaaggtggaaggaccttcctgctctgttttatacttggccagggcttcaagaaaggctgagagcttgtgacattttcttccagccactgcaggctctgccccttcacctaacagcataagatagggctaacagttggggagtatggttgtaactgctcatgtcttaggaggcttcagcctcagcacttttaggtccagaactcaaggggggcagaagacccctgtgacaaaaacccactaactagctcatgagtgacatgagccaggcaacataatgggtgttttatatgagtagatgctgttatttttaatttatacctaaggctcttttgcccaagattgaactgtttcttggtggaaaggattatcaatgcatatctctttttttttttttttttgagacaatctcactctgtcacccagactggagtacagtggcacgatcttggctcactgcaacctctgcctcctgggctcaagcgattgtcctgcctcagcctcccaagtagctgggattacaggctcacgccactatcgcctggctaatctttgtgttttttagtagaggtggagtttcatcacattggccaggctagtctccaactcctgacctcacatggttcctccacctcagcctcccatagtgctgagatgataggcgtgagccactgcgcccagccaatgcttatctccttaatctacactattgagttttctgttttcccatctttttttttttttctttttgagacagtttcgctcttgttgcccaggatggagtgcaatggcacggtctctgctcactgcaacctccccctcccgggttcaagtgattctcctgcctcagcctccacagtagctgggattacaggcgcaagccaccacacccggctaattttttatttttagtagagacgaggtttcgccatgttggccaggctggtctcgaactcctgacctcaggtaatccgcctgcctcagcctcccaaagtgctgggatgataggcgtgactgcgcctggcctgttttcccattttaacaggagatggaattagagagggcttcttagtctcctttgggctgtggaatcccataaaaaccttgaattgtttccaatacccccttggtaatgcagatacagaagttaagctgtagagctcaggctccaggtgaagaactgtgtctctgtagctgctgctttccatgaagctagaatgagcgtgccatgccattactttgagcctttccccaatgacccaggctggggtgtacagtaactacatcagctctctggacctagagaatctctgcagtgattcaggtagaacggagttacctagaaccttctaggagtataaaaacttggtcctaggccgggtgcggtggctgacgcctataatcccatcattttgggagaccaaggtgggcggatcatgaggtcaggagtttgagaccagcctggacaacatagtgaaaccttgtgtctactaaaaatacaaaaattagccgggcatagtggcgcacacctgtagtttcaactacttgggaggcggaggcaggagaattgcttgaacccaggaggcagaggtaatggtgagccgagattgtgccactgcactccagcctaggcaacagagccagactccgtcccaaaaaataaaaataaaacttggtccttcccttttctgcttattttgcttttattgcttacatctaaaacaaaaccaatcactattatccctctaaactttggattaatttgtctgcctagctcattcaactctgggaaacaaacactgaagtaaagcaaataaaaattgaaggtcggtagaagatggcaaagggggcattccaaaagggaacatgtgcagagtctcagagactgg

SEQ ID NO: 14653 - DNA, 6040 bp, Human
gcacttaacattatctcatttaattcttgcagtcacttcatgaagaaggtggcggtcctagggcattggagaagttatgtgcttgttcaaggtcatgcagctggaagatggtggtggtaggacaggaagtctgtagggcctgattctgcagccctctagtctatactcctttgctcctgtgtccctcatcccccctgcagaatgggcaccccgttacctttctgagccactgtgcgcagaaaagagagcatgttggccaggctggtctcgaactcctgacctcaagtgatcagcctgccttagcctcccaaagtcctgggattacaggcgtgaaccaccacgctcagcctctgaatactttgtactcaagccatttttcagtgctgtgtttgcagtgagcacacccgagggatgaagacacgtctccctgtgggaacctgggcttaccagggcccctagaggaggggaatctctcaagctcagagctctatggctgcggtgcaggcccactgtgtgcatggtgtcagtctgggcccttccatgttgcccccgtgggacttggggtaaggggaactgatgcaaacatcacgctgctgttgcttggtgtgagcaattaattcctgtggctctcacccaggagtctcatgtctttgggtcagacaaactcatcagcttgtagaaatggcacagtcccacgggcctgttagaatcttctattgtgcacatgttgctcttaaaatatacaaatcagttttgattttaaaaaattatttatttttttagtgataggagttttgctacgttgcccaggctggtttcaaactcttgggctcaggaggtcctcccactttggcctggactgccagcataatgtatcaccacacccgggactgattttcgtttttcaagaacaaaaaccaaaaacatacacaaaccgagagtcaaagcttgctaattagaggaaagtcaggaaatgggaaccattcaaagaagaaaatacccccacctcctactctcacctatccaaagacaattaggtgaatcccttagtagatatctttccagacggttttccatatagattcccatatctggccaggcgcggtggctcacacctgtaatcctagcgcttggggaggctgaggcggatggaccacctgaggtcaggagttcgagaccagcctgaccaacatggagaaacctcgtctctacgaaaaatacaaaattagccgggcacagtggtgcaagcctgtaatcccagctactcaggaggccgaggcaggagaattgcttgaacctaggaggcagacattgtgctgagccgagccaagatcatgccattgcactaaactccgccttaaaaaaaaaaaaaaagattcccacatctttactagtttgcagaaataagatcctagcatatgcagtgtgtaggaaccaccttggtttagccacgtctctgtgactgggggccactgtggtgacccccagctccccggacagagtcaagagctcaccagcctgcaaaggttttcacggcccccagccagactcgggggcttcctcttgccctgctacttcctgggagctctgagggcaggaaatggcgccactcagctcctggcctaacagcttggggaccacaaatgcaaaggaaaccaccctcccctcccacctcctcctctgcacccttgagttctcaggctcacattcccaccacccacctctgagcccagccctccctagcatcaccacttccatcccattcctcagccaagagccaggaatcctgattccagatcccacgcttccctgcctccctcaggtgagccccagacccccaggcaccccgctggcccctgaaggagcaggtgatggtgctgtcttcgcccagcagctgtgggagcaggcgggtggggcaggatggaggggtgggtggggtgggtggagccagggcccacttcctttccccttggggccctgtccttcccagtcttgccccagcctcgggaggtggtggagtgacctggccccagtgctgcgtccttatcagccgagccggtaagagggtgagacttggtggggtaggggcctcagtgggcctgggaatgtgcctgtggcttgaaaagactctgacaggttatgatgggaagagattgggagccattgggctgcacagggtcagggaaggccaggaggggctggtcactgctggaatctaagctgctgaggctggagggagcctcaggatggggctgatgggggagctgccagcatctgttcctctgtcatttctgataacagtaaaagccagcatggaaaaaaccgttaaaccgcaggttgggcctggccgttggcagggaagtgggcagaggggaggcccggccaggtcctccggcaactcccgcgtgttctgcttctccggctgcccacctgcaggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctccctggcgatggaggagctgaagtctgggtcaggccccagcctcaaaggggaggaggagccactggtggccagtgaggatggggctgtggacgccccagctcctgatgagcccgaagggggagacggggctgccccttaagtgtcggtgaatagtgaggctggaggccggaatctcagccagcctccagcaccttccctctcaccatcccactgccccctcgctcccatgtttccacccggcaccctgatcctcacccgaatctcctttttttttttcttttgagacagagtttcgctttgtcgcccaggctggagtgcaatgcacgatctcagttcactgcaacctctgcctcctaagttcaggcgattctcctgcctcagcttcccgagtaactgagattacaggcacccaccaccatgcccagctgcttttttgtatttttggtagagatggggtttcaccatgttggctaggctggtctcaaactcctgacctcaggtgatctacctgcctcagcctcccaaagtgctgagattacagacatgagcctccgcgccttgcctcctcacccacctcttcactctgaatcctcatgaggcttctcagccctggatttcctgctgccatcctcacccagcacccacaactagcgcctgggcagggcagggctggcacctctcaacgtctgtggactgaatgaataaaccctcctcatccacccctatttatctccatcaccatttccccctctttcttgttcctggaaacggctgctgagtctccatcggccaaacttatctgccctgtgatttctttgacaattctccttttcccccagaacccaccctgggttgaccagagtctgggaagaaggacaagagaacccggcaaactccctcctaggattaactttgtaaagcacccttgccctgtagctgcaagggctgtggaacctgggcagcccgcaaccacctttagctctgggccccccaggccagcctggagcatggctgggtggggccaccagcccatgctctcaggcgggcctgtgatctttcccagggcacatggactgtaggctggccctggcccacaccaccacactctccccagccatggacagaggcagccagaggcctcacggtttctcctccgagtttctggctgggtgtagttctcagaaaccccagtgcctgcgtgtgtccactcgtgggtgtggtttgtgtgcaagagctgaggatttggcgatgcttgggaggggtagttgtgggtacagacggtgtgggggtgggaagtggtgcagagactgaagagggtcaacctgggcatgggggacacagggactgctgagaacgtgcgtgtcatctttgctctgatggggtggacatagcagaaaatctaactctgtctgtagccccatacagaatgccagggtgagcacagtggctggtgcctttaatcccagcactttggaaagttgaggcaggaggatcgcttgagcccaggagttcgagtctgaagtgagctgtgattgcaccactgcacttcagcctgggcaacagagtgagcccctgtctcaaaaaagaaaagaaaaagaaagccaggcttcatggaaagatcgtatgtgtgacccaaatatgagttcttcagctcagccatggtaatcccttccttgaagtctccatttctgcagtacacatgcatgtgcgctctctctctctctctcacacacacacacacacacacacacacacacgcgcgcgcgcgcgcgcgcgctctcctgcgaacagaggcagggggagaggggtttgccctggtctcggggactggtctggctggcgcttccccactgcacgtttccaggtttagtttgtctgtgtctcctcttccatcccaggggctgagccccttccatcctccaagaggaaccagtgagagtgagtgaaggaggggcctggagccagggacttcccctgtggggcctgggtggagaggggagaactcaatggtgctgcctttgagaccagcccaggctacagcccaggagcacacatgggccagggcagttggtatttcccgaggacaaagaggaaattttcaaagaggaagttgttgagttagagcttgcggtggctgagagcagacaggttgacctgcaaaaaaagacaggggaggcatgtgagtgtgacagccctgctctgtggcctgggcaggagatgggggaaagggtcaggtgggggatgggctcgtgcagtgggagaggagacggagggagggagcgggaaggggcttgcttagtgggtgggaagagctgagctcggatggaaccagcttctaccagccaggctgggcacccactgggctgcatctggtggccttttctgattgctatttggactcactgcagctgcagaatgacagaggccatgtccaaaatcccttagagacactgttgtcttagagttgttaaaataagagcccccatatcaggtttagaaaatactg

SEQ ID NO: 14654 - DNA, 10435 bp, Human
  misc_feature (1)...(10435): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaagaaaagaaaaaaaaagaagagagatcctcccacctcagcctcttgagtagctgggaccacaggcacacaccactatgcctggattttttttttttttttttttttttttttgtagagacagggcctcaccatgttgcccaggctggtcttgaacttctgagctcaagggatcagtccgtctcagcttccccccagcccagacactttggctttgcccattttatgggtaataagtgatatctcagggttttttgtttgtttgtttgtttgtttgttttgagactgagttttgctcttacagcccaggctggagtgcagtggcacgatctcagctcactgcaacctccgcctcccgggttcaagcgatcctcctgcctcagcctcccaagacacataccaccacgcccggcatttttagcagagatggggtttcaccatgttggccaggctagtctcaaactcctgacctcaggtgatccacccacctcggcctcccaaagcgctgggattacaggcgtgagccactgcgccccgccccctacagtgttgttgactttacatttctcttactttttttttttttttttttaagaaaactgtgtctcactgtgttgcccaggctggcttcactcaagcgatcctctcgccgcagtccctggagtagctaggattacaggcacccgccaccactctcggccccatttctcttatttaaaaaaaaaaaaattgccgtgaaatacgcatatcgaaatgtaccatcttcaccatttttaagggtaagattaggtggtgttaggtatgttcacttgtcgtgcaaccagattgctgttttaaataacagcacttagagatgccgacttcgtgccaggcccagtttgggacattagggactcccagatgaatcagccgctccagtggaactccctgctggtgggggaggcactggcgaagcggtgctgagccgagtcctgacggcgctggagctgaggggcagtgcgggatgccccaggaaggctcctaggaagaggggacccacggtgacttcctaaggaagcgcggttcccaggtagaggagcgcatgtgagccaagatccctaggcctgagccgtctaggtgtgtcccaggaactgcaggaaacggttgggtgagtcagtggtgggcagcgagggtgataagccccttcgtgtcttcgggatggtaagtttggggcacaggtgagtgaagaccgaaggccaggggtggactgacactccgtggcaggcgcagggccgggcaggggggcggcttgggggtggcaaggtttgggtgagaaatggcagcccatggggaactaccgcagggctctgggaccttcagagccaagccccgacgccccttcccacctgcggggcagaactggggatggcaggggggagggtggttcccaaaggagataccatccctggtaaggggacatgggcccctgggagttgggttgggccacaaggagagaggcctgaacggccaaagggagggggcgtgggggaagccgcagcatcagacctctgcctcctccctcagatcgtgaggctccccagcctggctcgggagaccccgagatccccggccggtgacagcaggcgaccccctgctcctgtcaacctgtgggtccctacggacgtggggaagggaggagggaggccccagctccctgcgggggaggggcgtgaagacgcgcgggggtggggggagatgagccggcgtcgccatgacaacgaggccggtggtccggccttggggacccgggagggagggaggcgccgtggccgcgcgcgcgggcgggggcggggggccaggtctcccaggagtagttggggaacacccggcgattctggcggctgcttcctggtggcgcagggagcccgcgtgtttgcgagtgcgtgtgtgtgcgaagttctccgggtaagtgtgccagcgcgcgcctgggtgtgtgcaagggtgtgagcgtgcacacgtgggcacgggcgtgtgcgcgcgggggtgcccggttggatgtgtgcacacgagtgtgtgccggtccgcgtgcccctgcgtgagtgtgcgcgcgcgagcacacgtgtgtgtgcgcgctcgcgtgcgctcccgagcgggccccgggtgggagtccgagatcccgccccctccccagccccagcgcccctccccgtcccccgccgccgcgccggctgcatcctcgcctccacctcgctcaccccctcctccccgcactttctcggcgctccctccctctcggctcgcacagctcgactccgcgctctcctcgccggccgccgccgcccagcctgcgcccgccgtccccccagtgcctgggcacctgttggaggcagaggcaggtgcagggggctgggcaggccgggggcgtgagggtgcggggaagcgtgccagcctgtgtgcgctacgggggtgttcggctctcctgcggctgcaatttctggctcccctgaggagccagaggtggcatctgaggctggggtctccaccgtgggctgtggtgagcgagcgggggaaccaggcaggcagacaggtcctggggctgaatgaggggacagtgggcagttggagcctagaggggtgggtgacaccctgactagaccagcgcctggtgcagaggaggacagagcctccgagaaacagaggcggggccctgcagggccccttgggggacaggcaggctcaggagcagaggggagccccggaggagaggaaggagctggcaagatgatacagggacaacctagaagtgggtgggtgaggacggggtggtgcaacctcgacttctgcaaggagtgggttggcagcccagcccctgtggagtcagcttggggtctgcagggcccaggcctcccacctgccaccggctggcacacaccaccctctccctcgacacctaggaagggaggccagtgagggccccacagaccgaggaggccgtcgcctggccctcagccaggatggctaggtatgatgggctcactggctcacacgccctctcctagccaggggtgctgcatgaggggccgcaggggcgatcgcatgaccatcaacatccaggagcacatggccatcaacgtgtgccccgggcccatccggcccatccgccagatctctgactacttcccccggggaccaggacctgaagggggcggcgggagcggcggggaggcccccgcccatctggtccccctggctctggccccccctgcagccctccttggggccaccacgcctgaggatggtgcggaggtggacagctatgactcggatgatgccagtgagtctgggggcttggaggccccatgtgctggtgggggtctccaggcttgccgtggtggggggagagggggatgggccctgctggctgtgcatgtaggtaggggaggagggcagtgggggggtggcaggggacggccaccacagctgcagtcagcgtggagattacagcttcagcaaggctcaatattcagtatttctgctgagacactccaccacccacacagccccagttgcggccgagccagggacccagacgcacacacgcatgggcccactcagcctcttgcactcacactcgcgggctggcaagagagagagacacacagagccagtgcccacctgctggcctctcgcacacacctgtctccataccgacccatgctgcctttcctctctctccagccgccctaggcacgctggagtttgaccttctctacgaccgggcctcctgcactctgcactgtagcatcctcagggccaaggtgggcactccctgccacccaagcccgggcccggtttgcgtgcagcccccagagggggcccattcctccttcccttcccaggcctgctccttcgtcctgcccttgccccctccttctgggctcctccagggtccagctctacaagagggatggagagaggtgccgggagcctctagccctctcccctgccctcctctccagggcctcaagcccatggatttcaatggcctcgccgacccctacgtcaagctgcacttgctgcctggagcctgtaaggtaacagcctcctctcgccccgcccggcccagcccatgactccagcctgtggggctggaggacaggtattgagaacctttcatccccacatcccaggccaataagctaaaaacgaagactcagaggaacacactgaatcccgtgtggaatgaggacctgacttacagcgggatcacagatgacgacatcacgcacaaggtgctcaggtgagggcccccctccccaccacccagcagcagctcggggacagctgacattgtaaccgctggttggttgatctatgtcccattaagcccgtacctctctgatgctcaagaaccatcagcggctccctagcccctttggcagcaggccaaaattcttccctgccattcctgcccctcaatatctcctgcctgccaggtgtggtggctcacacctgtaatcccagcactttgggaggccgaggtgggcggatcacttgaggtcaggagttcaagaccagcctggccaacttggtgaaacccccgtctctactaaaaatacaaaaattagccgggcgtggtggcatgtacctgtaaatcccagctactcgagaggctgaggcaggaggatcacttgaacccgggaggcagaggttgcagtgagccgagatcgcaccactgcactccagcctgggtgatggagactccatctcaaaaacaaaacaaaagtatcttctgcccctcaaacagaggactcccttcttccaactggccagttccacaactcctgaacttttcctgttgttttctatctggaaagctccttcctgccagcctaaattccgctcatctgaggttcagtccaagctctgccccctcccaaaaacgttcctgggttgccgagaccccttctcagagcccttggcttaagccagacctctgcagctttggtctgccccttccgtgccttgagttcccctaaaatctcttaaggagtgaagtcttcagggacagggaacttgctccgtcatcctaggagatggagatgtagggagagtactccctcaagtcaggtggcgggcagcgaaacccaggctctggagagacctctgcctttgtgcttggatttgcagctgggaccttccctgatggtcagggctgtgcagcagagaggccaccttggtgtcagctattcgggtggaatggaggggaggccagaggccaaaaccagaatgagaccaaaaaatgagcgctcaccagggcccagcccaggcttagcattttcacatttctttctttcccttgactatctccatttacagatgggaattgaggcatagggtgatcaagtgacttgcccaaggtcacacaggtggctcagaagtggcagggctgggatctgcccatcctccatgccacagatgcccagcctggtagtgggtcactgcggaggcagggcagggactgcaggaggacaggtggctggaaagcaatcatttcttagtgagtccctgcggggctggctctctgctgcatgcaggaaaaggacgggggttcccgaggaggcgtggggtactcgtctggctgcccaaggctccaaggcccttctagctctcacggcctgtgtctatggccacatccaccgtggtgttcggctcctgcccccaggccctgaatggaggcagtgagcagcgtgctccaagatttctgagggcttcccacaatggctgagcatgtcctgatggaccagggacagccgggtggctgcagagggagggacagaggaatgggcaaatctgcttgtccttctcaagtgccagcctgtcttccagatgagacatagtgtttagggcagagctgggctggtccaaggcccttcctacaccccggaacggggctcaggtaccccaggggccctgacactgcagttcccgaccaggatcgccgtctgtgatgaggacaagctgagtcacaatgagtttattggggagatccgcgtgcccctccgccgcctcaagccttcgcagaagaagcattttaacatctgcctcgagcgccaagtcccggtctgtgtgggggctgcaggggcgccaggggagggggccctggggaggccaggcttccagaaccttctctttgccccctcagctggcgtccccctcttccatgtcagcggcgctgaggggcatctcctgttatctgaaggaggtgaggcacctcatggggatggggatgcatgtgggtgggaggctgcaggggcccaggctgaccctgagtctgtgccccgcagttggagcaggcggagcaggggcaggggctgctggaggagcgtggccgcatcctgctgagtctcagctacagctcgcggcgccggggactgctggtaggcatcttgcgctgcgcccatctggctgccatggacgtcaacggttactcggacccctacgtcaagacgtgagcccttgctctgaccctctcctccccagggagcctgccctggcctgagttgggcctggcctgtccctcacccctcagttcgtctccctccaccccacccccaggtacctgaggcccgatgtggacaagaaatccaagcataagacgtgtgtgaagaagaagactctcaacccagaatttaacgaggtacccaggaggggacgggacgtggagggaggccagggaggggctggggagctggctcacgaacgggtggccggccttgtccctaggagtttttctacgagatagagctctccactctggccaccaagaccctggaagtcaccgtctgggactatgacattggcaaatccaatgacttcattggtgagggaggagctggctgcgggtgttgagggcgggcaagtggcagggaggtggccctgaccctgcccacctgctccccaggtggcgtgtccctggggccaggtgcccgaggcgaggctcggaagcactggagtgactgcctgcagcagccggacgcagccctggagcgctggcacaccctgaccagtgagctgccccctgcggccggggctctgtcctcagcctgagtggacagcagtgtcccggcacaggcccatcgagccgggtccagtacccaaccttcgcacgagtgtgttgcacgtttacacagggtgggctgcccccaccctgcactacctatttttgtgagtctccgtgacccgggtctgtctgctcatgaggggctgcggagttctatattcacatatgcaaacctcctgcctgactcgctagtccctgcaaatatgcaaaccccccatcatctgcacacccgggcagtgctcagagcccggccccaggcccccgcgctcctcactcctgcctctccacgctgccccgtccctctcccccaacagggaggaggtcggattaggggaggttcagaggaggagaatgtctcaaaaaaaaaggacaaaaaacaaacccagagccactcctttaatacagaaacttcattgaaaaaacctagccctgtacagctgcccttttaaagaggtggccattgcagggtctctgcctccccagcaggtggcagatgctcccggccactcgtttaaataactgtcccctggagggggccggggtttgaaggcagggcccctgccaccctcctgggggacacccgtgcatgtttacgccttttctggttgtgtcagtggccggagcatggcagctgggcatcaataaacacctccgaggaagctggactcgtgtgtgctggcacggggagggcgccgggcggggccgtggtgggcatggcgtgatgtcacggtcactccgggatgtcgatcaccaggtcatcgtctccatccaaggcatcgtccccgctacctgcatcgctgaacatctgccgagggaccgtgctcaggatcgtgggggggggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14655 - DNA, 18662 bp, Human
gtagctcacgtctgtaatcccagcactttgggaggccgaggcggatggatcacctgaggtcatgagttcaagaccagcctgaccaacatggagaaaccccgtctctactaaaaacacaaaatcagccatgcacggtggtgcatgcctgtaatcccagctactcgggaggctgaggcaggagaattgcttgaacccaggaggcggaggttacggtgagctgagattgcgccactgcactccagcctgagcaacagagagagactatgtctcaaaaaaaaaaagtgcacacctctctggtttttagtatgtttattacgttacgcagccatcatcactacttcattccaaaatatttaatatttccatcacccccaaaagaaactcgttatatctattgctgtagtgccagctcctcagcccctcaccatcccctggcaaccactacttagatgtcctttttatgtctatgggtttgttactgtaatttttaaattcattaatgtcaactttaatttagtttcacttcacacacagtatatacggccaggcctggtggttcacacctgtaatcccagcactttgggaggccaaggcgggtggatcacttgaggtcaggagtttgagaccagcctggccaacatggtgaaaccctgtctccataaaaatacaaaaattagctgagcgtggtggtgcacacctgtaatcccagctactcgggaggctgaggcaggagaatcacttgaacccaagaggcagaggttggagtgaaccgagattgagccactgcactctagcctgggagatggaagtgaaaccccgtctcaaaaacaaaaaaacaaaaaccctcatatacacaaaacatctttggaggcctcatttttaaaaactgtagtgggatcccaaggcaaaacgtttcagaaacactgatctaagatttgtgttttttgttttgagacggagtctcactctggcgccgtggctggagtgcggtggcaccatctcggctcattgcaacctacacctcccgggttcaagcgattctcctgcctcagcctcccgagtagctaggactacaggcgtgccaccatccccggctaatttttgtgtttttagtagagacggggtttcgccatgttggccaggctggtctcgagctcctcacctcaggtgagcctcccgcctcagcctcccaaagtgctgggattacaggactgagccaccgcgcccggcccgtgttttgttttgttgttcaacagggtggaacataatgtctaaacctgggccctacctacctggtgctcaaaagtggaatgaccgtccctagccaacccttcagaaaggacagagagctactcaacggactgctgtactcttaaggactgggaaccggaaccgtgggtgagtgggactgaatcacagactaagcgttttccacgcttcgccgacgtgctgagtgccaagttataaagacaggaacatccaagctgctctcctgggctgacacggacgcgaggggacctacagtggccttgggcccagcaggcagcgactgcaacgtgactgcccagagtccagcccctggggcccagatctacagaaccgaccagacgtgatagccctttggctggggctgcagtcccacgatccacacaacgaccctggctccgcagacgcgccaaccacccacggaggcaagaaactgcagaaagtaaagggaaagggagcccagtgccgggcggcgctgagcagctcccccagcggccaccgtcgccaacatccctgcgtaggggtttgtatcgcagcgcgcttccagacatcaacggctgcgcggcccacgcgcgcgcatgcgtcctgaccaggggaaccttttcttggggacccggaggcgagcgctggaaggcgggatagtggcgacccacacgcagcagcttccggcggcgcgtagtcttgattggtggaacctgggagagggggcggggcaccggggaattcgaatgggagaggcgggcccaaggagggagtggaatggccgcgggcggctcgacgcagcagaggcgacgcgagatggcggcagcttcagcggcggcgatctcaggtacttgagcccggcctgggcaaggcgggtaccgacgtctggagtttagtgggagttatgtgtcggagtgtggtccaggctctgcgggttgtcgcggagaggcggccatggcgcaggggcggggagagggggacggtgagagtgtggggtcgcgagccggtcgccccgcctggctcctgccttctccctgtttcctgctctccccttgggtcagtagactcgggtctccggtccaggctcttggcttgaaccccgcgcacttttcctttgtgagcttcggtttcttcgtctgtgaaacgggggtcatggcctcatccctggagatcacctgaataagcaagagaagagtggcggacgctctagccacgaggacgagaagaagggagccggaggcgtgtattgggaagggttctgtgtgggacatggtgtttgggtgcagagacatccctgagagatgcaagaggacgggctgaggaacagacccggctgctgctgggtttgagttggcagcgtaagatgctctgcgattacaggaaaacgaaataaaagactaaaatttcctttcactctagcatggaagtgaatgctattttagggttggaaaggctgttaggacacccaaaatcttgtatgtgagtatttgtttacatgtgcctctctaacccggagacttaatcctcgttagtgatgatggtgagcgccatagtaattcactggagccctcgttagcctcgtggggaaacagacatttaggagaatgcctaacacatgtagagctcttgctatgtgccaggcacagttgtaggcattttatggtggtgaaccatttattgtccacacaatgctatcaggttgttactattactgtctttgttttacacaggaaactgaggttagtttgttcagagttaacacaactagtaaatattggggcttgaattcgctctcaaggagtctgagtgtagaacctctgctcttaaccattatgcccaagtacatgttatccctgctggctgagcacagtctccccttacccttcgaagatgcactgtgtccggtgcatggtagatatgaaaatgcctgaatgaataatgtcccttcctcgaggaatttacagtctgtttcaatagagtgtcacatacgtagatgtaatacgaaacacaatgagagatgtgtataaactgagggtgtggaatctgaagtaagcccttgagtattctgggaggacttcattaagggagtgaatgatacttgagatgggtttcaaaggttggataggagtttgccaggccttgactaagaagacaagaacagcaagtgttttcttatttatgatgtaaaagaggccaaagatgctctcttagctcaatttcctcatcaataaaagggagaagagtgaatgaaatttaggaattgtgaaagaagggaaaattaataattgctagcctggtccaagctcaaggttgcttttatcatgaaagggctagactcttgtgcagtaaataattgtttacatgtggccctcccctcttccctcctaccctggactgtgagccctggggcaggaatggccgtgagccattttcatgatggaaatgaacaagccagtgattagtagtttattcactaaatcttaatttttttcagcaaatacttcttgagggcctactctgcgccaggtgttggggttagaaaggtgagcaggataaaacttgttctcacagttggcagtcaggtggagaaagtgacaaacacgcaatagtggggtgtgacaaatgcttatggaggggctaacatgagctgtggttgcacctgataaagccttagtgtctaccaggaaagggtttttggttttgttttttaagaggagttaaaatgtgtttaccttagtcactccagggtggggtggggagcaatgcagatattctagggagagagattaacgtggacaaaaatccaaaggtgcaagagaacttggagttttgtaggaagtgaaggaaattcatcatgactggtaacttacactgcaaggaaggaaacagagggaatgactagagggcagggagacaccttgctaccaccagcaaggaaggctgtaaagaccatgaccttgggcagaggtagtgcagtgggagtggagagaagtggacttgttcaagagagatttaaagagatagacttgacagatgttaatgatgaactgatgtgggaggtaagagacgttggagttaaagactcccacttttggggttggtgccattcatttacatcagagatcaaaggaggaggctgcagagagatggggaaggagggttcagtttaggacaggtggagtttaagaggagccgtcggctgggctcacgcctgtaatcccagcattttgggagaccaaggtgggtggatcacgaggtcaagagatcgagaccatcttggccaacatggtgaaaccctgtctctaaaattaatcaaaaattagctgggcgtggtggcgtgcacctgtagtcccagctattcgggaggctgaggcaggagaatcgcttgaaccgggaggcggagattgcagtgagccaagagcgccactgcactccagcctggcgacagtgagattctgtctcaaaaaaaaggagccgtcagggcagccgttcagaacgtgggctgcagttgagagctcttgtgcagaacgtgcaataggacttatcagctgtaagatgttactgaagccaagagggcgggtgaccggcctatgaaatgaatctgagtggtctcagctcggggcaactttgtccctcacaggacatttggagatgtctggagagatttttagttgttacaacttgagggtgagggtggagaatgctactggcatctagtaagcatatgctaacagtctaaatgcacaggacagccccacaacggaattagccagcccgaaatgtcagtagtgctgaagttgagaaatgctggtctagagaaaggatagacggatcctaggatgaggagtgaacagaaaactaggtaagacaaccaggaaggtggggggcatggaaatgaagggaaaagtgtgtttcccaagagtgtcgcatacttctgggaggtccaacaggattgaggctgagtatgcctactggatctagcactagggaagtcatgggtgaccctgctgaatagtgagggcagaagcaagttgcagggatggaggagtgggtagcaagagaaagggtgtaataataacagctaaggactgagcagttgctgccaggcactgtgctaaacattgtatgtacattattactttgaatcctcacattcttatgagatgcaaagatgaaggggctaaggaggctgaggagggttcatataaagcactttggagttagatcttcatttgaagctgtcagtcactagctgttgaccctgggtcagtcagctaacccctctatactgaggtttcctcatctggaaaatgggagacggacattaaaaagcacttactggcctttcaccaaataccagataatgttctaagcacttttacatgaatcaccttaattactctcctaacaacctaacaaagaggtatttttattcccattttgcaggtaaggaaattgaggcactgggatggaaaataatttccctaggttacttagctagctgtaaatggcagagctgggatttcaacccaggccattttaccttgaatgatgaacctacctactatgtgctagtcactgtgctgccactttatctggcacttatttcaattatcttttttttttctgagacacagtcttgctctgtcacccaggctggagtgcagtggcgcaatctctgctcactgcaacctccacttcccgcattcaagcaattcttgtgcctcagcctcccaagtagctgggattacaggcgtccaccaccatacctgactaatttttgtatttttagtagaggcagggtttcaccaccaggctggtctcgaactcctgacctcaggtgatctgcccaccttggcctcccaaagcgctgggattacaggcatgaaccactgcgcccggccaaattctcaaaaagcccaaggcccacccccaaccttattttacagacaaggaaaccaaggtccaaggtcacaagctaataaatgtcagagctggaattgaagtccacttctgtctgaccagagtctacactctacctcattactgacttccccttccccttagattgatcactgcgcttccttaagtgcttctacatctgccatctttctgttctcccaaaacatcctgtgaaagcaggcagaggaaggtcctgcacatatttttgacaagtcagtgcacctcagttttctatctgcacacatgcatctgcaggtttttacctgcttgctcctgactttcaggattgccatgaggaacaaatgagaactagatgtccaagcgctttgctaccataacgtgagaaatggtattagtagccccatttatcagatgatggaatggaggttcagtttttgaaacagcccgtctgcttatgggcatgccttacttaggtgtaagattctttgcaggggtcatctgtctgccttttcgtcttgctgtttctgtgttggctacgtataccagccagccttttgccttctgcgaggcctatggctcctagcaaccagctgctaccaccagcaaggaagggaaagagctgccaggagctttcccagttggtacataataaggaagcaatacagcatcctattaaaagcagatttttagaggggaagagatctaggtttgaattccactatgagctacagtatgttatcctccaacgtaaaatagagtaatactctccttagatattttcagctcatttaacccccacaaaaatagagggcttttctttttttaagttttatcttcattgtgttttctgatgataaaaataattcagttgccaattctaaaacaaaacaaaacaaaaaaaacttaatcatctgaagcaaattcagggttaagtttacatgagagaagaattgcatgtcggtggtttttgcagaacccacataattccccatcaagagaagatcatcattaacagtttgcaggggtgggtgggtctgtgagtatacatacgtctcaatacatattagaaaccccagttaagaaatggaggtacaggctgggcagggtggctcacacctataatcctagcactttgggaggccaaggcaggcagatcacttgaggtcaggaatttgagaccagcctggccaacatggtgaaaccctgtttctactgaagatacaaaaactagccaggagtggtgttggggacctgtaatcccagctactcgagaggctgaggtgggaggatcgcttgaacctgggaggtggaggttgcagtgagctgagatcatgccactgcactccagcctgggtgacagagcaagactgtctcaaaaaaaaaaaaaaaaaaaacacacacacacacacacacagaaaattctggcagttcgctctctggtttaggtttcggtcagatgtcaacccttttaatccttagaacaaccctgtgaggtgctggtctacttcacccttggcaattcaaaacatgtcctgggccaggcatggtggctcctgcctataattccagcactttgggaggctgaggtaggaggatcgctggagcccaggagttgaagacaagcctgggtaacctagtgagactccatccctctctctctcttttttttttttaagtgcccagcatcacctgggagcttgttagaaatgcaaaatctcgggcatcaccccagggagacggagaccaaatccacattttcacaagatcctccaggttatttgtgtatacattacagtctgagaagcctgctatacacctgctgcacttgcttgtagagcagggaaggcactgaggccaagcttaggggtgtccacaacatgaccagggcagaatgagcttctccaacatgagctgtggcccccagcccgcccagcaaagttggtccctgcttcttctgctaccaccatacttcatgtctaaaagtgatcttctctcctccaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtaaggttcaggccactcctcttccctcatgccatcacctccctctcctaggcctgcccacgttcccctgcctccccaggatccttgctccctccttagcaccgctttgttccctgagccttcactgttcacttaggaaatgttgacaggtgcccccatgatgggccctctctgggatactgtagggagagatgagaggttgaatcaaacatacattactgtgcacagagagggaggagcaatgagggtgagcaggtgagccccaagtagaggctgggggacatatcaggagggttgggggaacacagacctgccagccagcctacccaagctgcagctgggtagtgtcagagaagaccacccagatttggggacagaactcagaagggcagctactttataatcctactggggatttaaagttcaaactccttggcctgtttttctaggcgggggctggcaaaccatggcctgcaggtcaaatctgatcaggagtaagattttcagtaaataaaattttatcgtttatttacatattgtctatagctgctttctgactacagtggcagagttgagtagttgtaaaaggaacacatggcccacaaagcctaaaatatgtacaatctgcctttttacagaagtttgctagctcccatactaggccgttaacaatttgggcttcagtttctttccagcctcattccctcaatatatattaaactccctgctgtggcctaagctgcacttctccaccagaacgcagtggataggtgattggtatgtagagtctagttcagtcataagcagcatcctctattttccccattatggtgtaaaatacaatgttctacacatgtagccatttgaaaaagactgggaagccttgcttttttgctattcttgattctcagaatttctttctttggtcaaaatcttccttccttgagcagaatcagttactcctttgagagtgtgttcttatcttcgtttcctaaatcacagcaaagtgtggatatctatcctaccagactgaaaaactccaagagcagggatatcagatctatctctgtattcctaacaccaatagagagatgaggatggagtaggtgttaggtggatgctttttaaggtctttgtacaagaaaggggatagagacgttctcttaaatccaaggtccagatgagagtagaatcccttacccacccccaccccactccaccccttacacacacacacacacacacacacacacacgctaatttctttctttcttcctgcaggtttgatgccttctatggggagaggagtactcagcaggacatctatgcaggttcagtgcagcccatcctaaggcacttgctggaagggcagaatgccagtgtgcttgcctatggacccacaggagctggtgagggagccagaaaagaaacagctatgggtcagaaagggctggggaaacggagaggaaaacctcacagttttctccactctcttcccagggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtgaggccccgtgctggttgggagaggagcaacaaagggtcaaagtaagacctggttctagaacatgaagctctgctgtagcagggaggtaaggtgagacctagaaagacagagactggggtagcagatggtacaactccgagaatagaacagagaaaggaaactgatccccaggaagaaacagcctctctatggagaattgcccttccccttcactgcttacacaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtgaggccgcagacaggggcgaggacctgggaagcccaggagcctgagctaagcacgagacctttgttcttacccccaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggtcaggcccacctgtctcagggaagaaggggctgcagaaggaggttctcaggcctgctgtggggtggggaatagcagttgaggcataggaaggctgggcttctgacccacccactgcctggtctcaccctcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatggtgagaactgggggaggcaggagtggaaacgctgggtctggaaattagggagtttgttgaaaccaccaagcatcagcacagaggctgaccacccccaatccctctctccaccccatcctccaatcatctagccttgggacctgttaagctgtctcagaaagaattgcttggtccaccagaggcaaagagagcccgaggccctgaggaagaggagattgggagccctgagcccatggcagctccagcctctgcctcccagaaactcaggtgagcagtggggccttgggtgtatccccttcctgatgtatggcttagcagcagagctgcaatgcccgtcagatccttgagcagagagctgtgatcttgttcctctcccattaaattcaccctaggccggatgcggtggctcactcctgtaaccccagcactttgggagactgaggttgggtggatcacctgaggtcaggagttcgagaccagcctggccaacatggtgaaacctcatctctactaaaaaatacaaaaagtagccggatgtggtggcatgtgcctgtaatcccagctacttgggaggctgaggcaggagaatcccttgaacccaggaagcagaggttgcagtgagctgagattgtggccattgcactccagcctgggcgacacagcaagactccgtctcaaagtaaataagtgaattcaaccctggctaggcacggtggctcacgcctgtaatcccagcactttgggaggccaagacgggtggatcacctgaggtcaggagttcaagaccagcctggccaacatggtgaaaccccatctctactaaaaatacaaaaattagccaggcatggtagtgggcacctgtaatcccagctactcaggaggctgaggcaggaagaattgcttgaatctgggaggtgaaagttgcagtgagccaagatcatgccactgcactccagcctaggtgacagagcaagactgcatctcaataaataaataagtaaataaataaattccccccaaattctactccattgaatcactaaagtctaagattaatctctcctcagtgctgctgccttggggacctaaggaggcctcctcctggggatcctttccattttccaacccctttagccttcagcaaaacttctcactttgggacagctgtttcaaggatgagcatttttgcttctggttcaaggagtgatctggatcagatctttcagatccatgagagcaaagcaaaggagacttggaagagctgtcctgctgagaccatctggtctgtgtgtcagtgcccagcttctccatgactctccggggagccagctgctgtcctaactgcgtctaccctcaatccagataaagcctctaaactaagtcctttgtgtcacctcctgccccaactccaatcaccccacctcatggcccagtatgtactaatcctcaggtcatctctgttcaggggtcttgctttctgtgtctggccacttagcccttgcgctattccctccaccccccaggagccagttgcagttttaactttgccctgtttctacccctagcccaaataaagcctgtgaactactaaacagaggtgacctgaggtggccaagggttagtgcccactctgtcccagggggctactgtagttaaggaagatgccacacacaagaagatgcttgtgcactcatgaccccatctctcagtcttgtctttcccaaaccatctgtcagcactccccactgctgtgtgcacccagaaatgtgcacaggtaagctgtcagacaggcactctgagtaaggggaagctcagagttgggcacatcaaacccagcagacccagagcttgggggcctcacaggagagcaagtcagatgggaacatcagtatacgataccaggtggagaattcagaatcaggaaggagtagctgctgctgctgtgagagtcaggaaggaagagatgacttctagtgtttgcccacgtatgttctgatcctgtttttccaaggcactagcatggaaagcacaggagtgtccctgtcctccaggagccagttcacagcataggaagggagatgcattgttaagcttggcgtcatgggaaaggtggcatcaaactgacctggaaagattattgatacagatgtgaggaggtgtggggcaagattccaggcaaaataaatgaatgttagacgttgctgactgggcgcagtggctcacacctgtaatcccagcactttgggaggccaaggtgggtggatcacttgagcccaggagttcaagaccagcctgggcaacatagtaagaccccatctctacaaaaaataaaaaaattagctgggcatggtggcatgcacctgtggacccagctactcaggaggctgagacagggggattgcttaagcctcaggaggccaaggctatagtgagctgtgatctcaacactgcactccagcctgggtgacagagcaagaccctgtctcaaaaaaaaaaaaaaaaaaaaaaaaagaatgttaagccttaccgtgctcagagtcagtcaggactgcttgaacaggccttcccagctgcccacagcagggaagcttggcagctgaggtcttcggtggatttcaaagccctgctaaagatggcatcctctgtgatgttttccgcaactgctcctccaaatggataggcactgtcctggctgtcaccttattatggtctcttgatttcctcagtagacagtgcctccagggcagggcagtgtcttaggtctctcatacctggcactcaagtgttcgcctgatttcctggcatccccgagcagtcacttcacctgatgaagacactgcacccagagaaactggatgcctagcaagttaacattaggttctggagctacaggatataccaagttaaggtgtggtgaggggagtcctgctgctgtaggtggtgatgagggaggaggtaggtggggagcaacttctttttctgctcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagtagattgaggtacgtgttttagggatgtgggagctggattcctattggccttgagaagcaatccttggatcttcagacagggaaggacactcaggctggactagagtccagttttctcccaataccggaagttctccagcttctgcttgaatgtccttaacatggctgaactttgacagacaattgagaccagatgtgagggtgagaagaaaaagttcaaagtaaaagcaacaaatgttaaacattacatttcctaaagcccagctcaattaattgaggactgtgcttgaaaagcctttcccttcaatatttgcagaggcttgttccacctctgggtagccccctaatcacagaaagcccttaattatgttaggctccacctgtctcctggtaacctcccactggtcctagccctgccctctgggggctcagagccttgcatactcaccctggtaacccactcccttcaggctgccctggagttgggtctggatcacatctccctgatcctttccaacagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaagtaagtttgactccaggggctggggggccaaggcagctgagatcctataagggaggaagtgttaggagcagctgtctccatgtcattcatattctcccaccacataccagtcccagggaggggtgaggaggctctgaggcagtgctgggggtgctctgccctcgggtgtttaggacagtgggatggacaaacgagtagaggattgaagataatgcaagactgactgaaattcctttaaatgcgggtataaaaaaggtcatgtggaaacacaacaggttaactctggatggaggggagctggggaatcagaaatggaagaatcgaagggctaccagggagggtgaaaagtaccctttgccctgactccaattctcgattcctactttcagttcaggagcaggcagcatccccaaatgccgagatccacatcctgaagaataaaggccggaagagaaaggtgaaagtagctgggggcttaggctacacctggagcccagaagtaagggggagtaggctctagggggaggagcgttggccttggggttaaacgaactggatgatggccgccagctactaacagacctcaacttgcttacccctggaatgtggtgatggatggttccttgcagggcatttagggtggaaggcagtgatgtggatgtacctcgcagagcggatgttccactgtgtagcctggcttctaccctctacaagcttaagagggaaaacttagggaactatgacctaagcagtcaagcaagaaaccacacatatgcacatacccagaatcgaacaccactagaactacccaaaaactgagatggttgggggaggtatcatttattcatattactttctcccatgtactttttgaaagacagcttattctttcccttttagagatgagggaccagatttaagagcttattttgtgctttacattcattaactcacttgatctccacagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctcccagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtagcagcccactggactgggggagggcgggggcgggggagaccgggtacccccgagaccctgtcccctatcgatcctgtcccgccaggtggaggacctggaacgcgtggagggcataacggggaaacagatggagtccttcctgaaggtgaagtcacggccctgcccctcctctgcctgtcctgcgccccgcgcccctctctaacgtcgctgtctccctccctcctgtgttgcaggcaaacatcctgggtctcgccgccggccagcgctgtggcgcctcctgaccgtcgtctcctcactccgccttttcaaatttttgtataaccccgtgttgtgtaaatacagtttttgctccggtgcttccgcctgatttttggggctgcgggggcgggaccggggtgtgaccgcctcggggtgggccgcgagcaaggcaggcgactccactgggcgccatcttcggggaacgactcagcgcaggattgtaaatacaccgctggggtggggcggggaggacggtggcctgcaggacgcaaaaagcggaagccgaagcatgaggcctgcgaccgttaggcgggcgcgcgctcagggattagccccgccccgtccgtgcccccggcgcgcgcgctcccccattctcccgctcggcaacgacggcggccttgtgcgcgtgcgcgcgaaataacggccgctggcggagggagggggagtggaatcgttggcggggggaagaggagagaagccgccctgtctcccgcgcgcccaccacctgcgccatcgtcagccaatcagcagccgtctcaggggtctcgcgctcggggcgactcgggctgctgggtggctcccccgtccctcctcccgccagagtccctctcgcgcctgcccctcccgctggccacgcgcgcgctcgcgctagcgctcgcgcccgctccagcctcttgtgtgtcctcgcgccccccgcccgccctccccgcgcgtagtgtgctccgcttcccccaccctccacctcccccctcctgcccgccccgcgcgcctcctcccgggttccccctcccccaccgccgccgcctcctcctcccgccccagggtgagcgcgagccacctccctccctccctccgccatggatcccagcaactggagcagcttcatcttccaggtaacaactccctccccccgcccccacccccctgcccacaccccctcctgcccgccctccctcccgtcccaccccccctccgcgcgcccggtgcgcgcgcagctgtccccctccctccctcgcgccctcccccgccctccccgaggcgccggctgggcgcgcgcgcggcgggggccgaggctgctccctcgctccccccaccccgccccggcaggctccaaccgccgccgccgccgccgccgccgcccgggcccccgcccccggccccggccccgcggggcctcccgcccccacccagggggcgtcgccgccgccgtcgccgcggcgctccgcggcccgcaaggcgccctcctttcctccctcccgccggccggggtgcgcgggcggcggggcggcccgcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggtgagtagggccggccgcggcggcccgggctggggggggacgcccgcccgcacccgcggcccactcggcgccttgtctccgcaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaag

SEQ ID NO: 14656 - DNA, 11024 bp, Human; identical to SEQ ID NO: 12120

SEQ ID NO: 14657 - DNA, 57859 bp, Human; identical to SEQ ID NO: 12334
  misc_feature (1)...(57859): n = A,T,C or G

SEQ ID NO: 14658 - DNA, 57859 bp, Human; identical to SEQ ID NO: 12334
  misc_feature (1)...(57859): n = A,T,C or G

SEQ ID NO: 14659 - DNA, 22888 bp, Human
taattgatttctctcatacaagatgcaattcccatagtaggaataaaacaagatatatgcagcaaaatttgacagaattgaagggagaaatagacagttctacattaacaatgggaggctctaaaacccctctttcaattatggaaaggctgagacggaaggtaagtaaggaaatgcagaatgtgaacacacaatgaaccggttagatctcacaggcatgcagaaaataacctgacaacagcgtgcacattcttccccagggcaccacttccgcctccctcatccccactgctcccgatccctgtccacagacccacttcccgccctggtgtgatcctcgtggccactgtggcccctactttggagatcctgctggtccagttcttcccgccttccgcagagccgtactcctccttctgaagaagccacctgggacctgggccccgtcttcctggctcctcagagtccttgcaacagcaggcaccgcttctctctcctacactcaacccctctcccactccactgcctctcagtgtgcaaaaacagtaagaagtgtcccgtattttcaaaatctctcccctgtagttcccacctgacttctagtcgtaggtggccaaagtacagtgtttttgaaggattgttttattcccagtgcctggaatatggtaggatctcaacaactgttgtttcaataaaggaatgaccaaatgggtgaatactaatgtaacaatatcaattctgtttctttcataattattctcataagtgttagctttcttaaaaaatcatcttcacaattggacctagacattttatctttcccagctcaagatggataaactcagaatgacaggccaggcaccgtggctcatgcctgtaatcccagcactttgggaggcggaggcgggtggatcacttgagaccaggagttcaagaccagtctggtcaacacggtgaaatcccatctctacagaaaatacaaaaaagttagcagggcgtcgtggcgctcgtctgtaatcccagctgctcgggaggctgaggcaggagaatcgcttgagcccgggaggcggaggttgcaatgaaccgagatcgccctactgcactccagcctgggcaacacagcgagtccccgttccaaaaaaaaaaaaaaaaaagactcagaatgacacattcttaatgtcttaatgtataatgagaagtataactattcagaagtccaagcacttgtgtgtgcatggtgctatcgtcttgctgtaggcaaacctacatgggaatccaccttgacacataggccacttcctgagcctggacccagtctcagagctggggaactggcccaatgcaaaagggtcgggagcatctgcaacagagactgagctctatcagcttcggtgacatagcctccattcacgctccccaactcagcagagagagcacaccatcagacttctaagacttagtagccaagaagtgttgaattaaactctctgagacctctctttagtctgaccctggcagcctcagtctcccagagcctgtgggaactcggcagccgagaggcagaaggctgggcgacgtccggagaagaagaaacgggggaagaacttttctcttacgatctggctttactctcacgcgcacagccgagtccctggggacccagcagaggtccgaagcggagcggggcggggcggggctacggaagctggcgaggccgagcccctcctagtgcttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcggggtgagtgagggtccgctgcactgtgggaccgggcgcgtgggcgggaagtgccgagcggctggggaccggctctagggacggttccctccttagggctatctctcacaggagggcctgtgcatgcctgtgtgtgtgtgtgtgtgtgtgtgtgtgtgtgcgtgcgccggggtggggggggggtgcagtgcagtgtagactaggggctcacctggtgcagagaaagtcaccaagtcagggaccctccatctctgacacgacctgcgggccatctcttccagctggcccacgccatccgcctgctcctggaatacacagactcaagctacgaggaaaagaagtatacgatgggggacggtaatgacacccttgtgtccgggctctgcccactcacgctgagttggcaccaagcaacccatggtggccacctgtggctacctctgcaggcctcccctgctggagctgcaggctgtcccttccctgagccccggtgagggagtcctgtggccttgcaaggcagaatgctggggcgggatgctgggccccctgtttaattgggttgggtgtccctcagagcttccctaaaccctggaagccttagccgtgtggggtccagagccctcagcgggattctttgtccctgaaccctgggatgtgggactgagtggtcagattctagatccacctgtctcagggatcttgccactggttccttgggagggtccccgggaaggagggctgggctctggggaggtttgttttcacttcttcttccccacggcagctcctgactatgacagaagccagtggctgaatgaaaaattcaagctgggcctggactttcccaatgtaggtgcaggggaaggggcggttttgggggaaagtgcgacgtgtctctgactgcatctcctctccccagattagaggtgttcggatcaggagtcttctgcccaattcctctcactcctggttgtctacacagcccctgcatgatgttctgtgtcccagctcatttgttcatgtgacagtatttctatgtcaggcctgccatgagcgggcacagtgagtgcctggtctcccctctgcccttgcatatgggaaggggatgctggggagcctgctggcccaactgagcttccccggtttcccatctatccagctgccctacttgattgatggggctcacaagatcacccagagcaacgccatcctgtgctacattgcccgcaagcacaacctgtgtgagtgtggttggctgcagtgtgtggggggaaggtggcatcctccttggctggattggggtgctatgctcagagtgagtctgtgttttgtgggtggcaggtggggagacagaagaggagaagattcgtgtggacattttggagaaccaggctatggacgtctccaatcagctggccagagtctgctacagccctgactttgtgagtccctccctggtctggaccagaagccaggcttgtattcccatctactctggtcctattcacaatttgaactcctcactgctattgatcctctgagggttccctgtactgtagcagagtgactgtcatatcattaaacttataaaataaaaacttgaaatcagtccccaccaatcataggaagtcctatgaaagctagcaattcagttcctagacaataaagtcatgcgttcagaattcccttcacctctgacccctgacctctgccacgggccatctaacccagctggttcatgccatctgcctgttcggggaatacgcagactcacactatggggtaaagaagtatgtagtgggatgtaatagcaccctcctctgtggaattccgtgctattcttttcctagtgcttctccttgacacgcacagggatgaatgcattttcctaacaggcagctcaggggcggccagagggcctttgttcctctgtctccttccatgcagcctctcaaaatctcatctctccagaaactactcaatgtccattgtattattctgccactgcactaggaggaactttcaacttctttctctgagctcctttagttctttgtatccttgattttgctcatgtctgggtccagagcctgccaggtactcaggtgctcctgggctgacccagaggagggtggttgggaggtcagtggggacagattcagggatagtgttgcattcctctctgccttcccatcaccacaaaagcctccagctacccatttggagtgtaataaatgctggtatgtccagctgaagccagttccagctgtggggaagatggctgcttgctcgtggccagctggggccatacacagccctggggaggccacatctgtgcagggagcttgtgtctgagggtggtgacagctgttttctgcctcaggagaaactgaagccagaatacttggaggaacttcctacaatgatgcagcacttctcacagttcctggggaagaggccatggtttgttggagacaaggtaatgggggcatgtgatgaggacactagagatttgccatacatcctatgttacagagattccagcccacacattcttggccttctgcagatcacctttgtagatttcctcgcctatgatgtccttgacctccaccgtatatttgagcccaactgcttggacgccttcccaaatctgaaggacttcatctcccgctttgaggtgatgcccccatcctcctttctctttgatgccccttgttccgttacctcctttcagatgctttcccagtcctggatctgcataaagaataacttgcatttattgagtgctggcttcatgccaggaaccttgcccagcacattatacctatcgtgtggaatttgaaatttccaacattcctacagggtgacagaattatcttgcccatttagagataagaaaactttgaatgagagggtcagtcctttgttctgggtcccagagccagtggaggctgtgctgggctccctgtgagcatctggatctatgggtggcagtcagggctctcccttttgtgacaaaagaaagaagcctcaggcctcatccagcctggatttcacagcccagggcactttggaagaggcagagaactttaggagcatggatgcagctggcaatagtaggactgacacacggtggcattgacgtcgagtacgaaacccacaggcagtattcatagctactcccagaagctttgcacgatcagacccccacgtggggaatcctgagagccagagctgtggccagagctggattagggtacatatgtgggtgcccctgttgaaggagtgtatgttgaagtgctctgtgctggggcactctccttctttatcttttttcctctcttttttccctccagtgttccaagtgttccccctgtgagatgagtagcacactgattttactgctattcaccgaccttctcctctgcatgaggcagggtgtgaggcacagtgggagttgcatagatgactgccccatcctggaaatgagtgcagtgagaggcctgcaggcagagcagcctgtgaggtgtgtggcaccacctgggtaccaggcctggggcctgcccctcactcatggggaaccatccctcacccgtgctgaatttgtttgagagcagcaaatcctacttttagtacagatgtgagaatttgaggcattagtccaacaagtttttcagcctagaatttgttttcctttcccactacccatcaagggatctggttactcagctagttcccatcagctctggctgtggtctcggctgagtggccttggggttatgtaagaggtagtgggaggggaagagagctgagggctgcagcatatggtccacctgggcttggccctttgggaataggcagccctggctctctctgaatccttagaaattacacggctatttgatcctggaaagatcgtgcagagcacacctgagtgtcatacagcctggtctgaggtagtggggttggagatgaggtgggttggggcacagtggtgtttagctcaggtaccaggtggggaggtttagactttctgctttaaaaggaatgattagagcctggtctggcgtttcttttgctggtccaacacaccttgaccactttcatccaggttttgccaggtccttgggtgagatctgggctctcttccaggctgcacagacattttcagaggtcccctctgtgtgtgcaaacctaggcaagccaggtgcctccctgtgaaacaggagaatgttgtgtagtcagagagtgacaggacctcctgagggatttgggggaggatggggatttgacagaaagaggccagaactggagagagacagaaccagtctacgttgcagctctgtcccccttagtagctatttgagtgtgaggaagttactgaacttctgtttcccacatgagaaatggtgataatagattcagccttgcagagtagtcgagtgggttttctaagcttatgttgtaatttctcttgggtacagagcacccagcaccgtgtagaatcttcataagtgttagctgttactgtggtacaacattacttaaaggaagttggaagagttaactccgcaaatctggggaccctaagaggctgtgtgatgcctcagcacttgagcccacgtggaaaggctgtggccagggccctgacctgctgtgtctgcagtggggttgtcccagccctcatgggcagctgaccttgagttctggccttattttcccccctctcagggcttggagaagatctctgcctacatgaagtccagccgcttcctcccaaaacctctgtacacaagggtggctgtctggggcaacaagtaatgccttgaaggccaggaggtgggagtgaggagcccatactcagcctgctgcccaggctgtgcagcgcagctggactctgcatcccagcacctgcctcctcgttcctttctcctgtttattcccatctttacccccaagactttattgggcctcttcacttcccctaaacccctgtcccatgcaggccctttgaagcctcagctacccactttccttcatgaacatccccctcccaacactacccttccctgcactaaagccagcctgaccttccttcctgttagtggttgtatctgctttgaagggcctacctggcccctcgcctgtggagctcagccctgagctgtccccgtgttgcatgacagcattgactggtttacaggccctgctcctgcagcatggcccctgccttaggcctacctgatcaaaataaagcctcagccacatttgctatagtcttgtcttatttgctcctggctgcccagactgtgtctgtcactgcctcttctgagggactggctggtgaccctggcagtagctgggttcatagagattatgatgggcttagtaaggtgtttccaactttgttttttttttgaaataaggtctcctgcttcccaaggtgaagggcagtggcggcatcgtagcttactgcaacatccagtcctgggctcaagaatcctcccacttcagcctcccaaatagctgagactataggtgtgccaccacacctggccacattaaaaaaatttttgtagagatgtgtctctttatgttgcccaggctggtctggaactcctgagctcaagcgatcctcttaccttggcatcccaaattgctgggattgcaggtgtgagccaccatgcctggccctgtttccaacttcttgatctcttttctgactgccttagagcaggaagccacataaagtgctctatagaaaggatgcctctttctgggcctagatcttcatttatttttatgtattcagtattattcagtgctttccatggttaggcagagctaggtctcagtgagtacgtcttagatgcccagaggtggtggaattcccatcacagagaaccaggatccttctgtcttccacactgactgactccatcacagcttagatctctaggacgcaagctctactgtgagctgcttcaccagaaggttctcccactcagcagttcccaagctgtgttatcacaaatagttgttgattttgtgggttaggaattcaggtgatgcccagcagggagaacttattacaaatcaacaaaggtcttttctccaaaaactatatatccagaaatacggcccattaaaaaatgagtcaaaacttgaacaggcatttccgaaaaatgaatatccaaattgccaacaagctcatgagaaggtgctcaacattattagaaagcagaaagttaaaaacccataagatcctactgtatccccactagaatggctgacattgaaaggactgacaattgctggtgatttatgcagtaactggaactgtcatgcattgctggtgggaaagccactttggaatactggcagtgtcaactagagctaaacatacatctacccaggacccagaaatcccaccctataggaatgagtcttaatggattccaagagccaggtataatgatgccaaaagcagctttattttaaatagccaataactgaaaacaatccaaattccatgaatagaagaatgaacaaataaactgtggtttatcaacataattccatcattcatataatggtatatttactctgctataatgaaaataaacatgctaacactatgtgcaaaaacatggatgggtctcacagaagtgttgagtaaaaggatccagacaggagaaaggacacacgatctcattccacttacacgaaattcaggagagggaaatgagtccatggtatcagaggtcagatgattggtgaccttggtgagaactggaaggttgcctattgaaggctcctggtgcagtgctgtaagttttctctctttatctgggaggtgattccagaagagtatccaagtggaaaagcccacagagtagcacacttaaggcctatgcactgtatgtattacacttcaatgaaaagcatgcttggccaggtgcggtggctcacgtctataatcccagcactttgggaggccgaggcgtgtggatcatgaggttgggggtttgagaccagcctgaccaacatggtgaaaccccgtctctactaaaaatacaaaaatcagccaggcgtggtggcagcgcctgtaatcccagctactcaggaggctgaggcaggagaattgcttgaacccaggaggcagaggttgcagtgagctgagatcacgccactgcacactccagcctgggcgacagagcaagactccgtctcaaaaagaaaaaaaaaaagcatgcattaaggcctgtgcactgtatgtgtattacacttcaatgaaaagcatgctcatatgtcttacattatttgtgtgcttgtgttggtttgctttccctcataagatgtcaacgtcctcaggacatgtgtttttgtctcttcttgttcgctgatgtaacaggtgtttgcatatcacctaggacagtccctgagcatagcaggtgctcactgaatagttattaggcaaattataggctctatcttaatggtgtcatttcaaattccctttagatttttatttatgcctacttctttggataggtgagattgatgggcacatacactcttaggttctgcagttttttctctttaacattttacctaagaatctgtacatgttggcagtctatatgcatgcctatttctagcatttaatggctatcattacttcctgtggataaattatagtttgcttagtcattcttaccctattgggcatgtggatttttctcatttatttatttttagaacagagtgatcatgtttaaactaattccttctctggtttttgggtactttatttgagttggtccccaaaggcaattactacaaggcaaaaggtgagaatggtgttatggtattatcatagataaattgctctctagagagaatagctttttttttttttttttttgatgtggagtcttactctgtcacccaggctggagtgcagtggcacgatctcagctcactgcaacctccgcctcctgagttccagcaattttcttgcctctgcctcctgagtagctggaattacgggcgtgtgccaccaccctcggctaatttttgtatttttagtagagatggggtttcaccatattggccaggctggtctcgaactcctgacctcacgtgatttgcctgcctcagcctcccaaagtgctaggattacaggcttgagccatcgcgcccagcccagagagaataacttaattcatggtgacacctgcaagtcacatggatctttctgcactaccttaggtacttgagggattgcagtttcatcttataatatttttataggtttatagaataccttcaagttttctaccttcaccttttttgtttatagtgtgtgcatgtttctgccaatgaatcacagtctatgaatctacctgtccttgaatctcctgtataaaactctctgtttacccattctctacctgtggcttagtcaactcctggagaaaggttaaagaatgatcttgtggcagtcaagaccttctctctaataggcacaatgtaattaattatgattctgttctaggtttcctgtggcataatgtgatggtcaattttctgcatcaacttgactgggctaagggatgctcagatggcaggtaaaatcattgtgcttgtgagggtgtttccagaagagatttgcctttgaatcagaagacagcaaagatttccttcagcaatgaaggaggcatccaccaaactgtcagggcccagagagaagaaaaagacaggaagggtgaatttgacctctctgactgggacatccatctctgcctatcctgggacctccacactcctggttctctggccttcagacttgatcagggactaacaccatcgcctcccacccccacctttgttctgaggcctttagcctctgaatgataccactggctttcctgcttctctatcctgcagtcggcagatcatgggacttcttcactccaaaattgtgtgagccaattcccataacagatagataaatttataaataaacacacaaatttcctacagccttatcttagtggtgtcacttcaaattttgaagaaccctgacctagtacacatagcaaaaaacaacaacgacgacaacaacaacaaacaaaaacacacacacacacaaaaactcatcatcaataagttttaaaaaatcaaacacaagataaaacgctgcagcatatctattacctgggggcttttctatatggaaagcactttctgagatgccttgcagtaaactccaaggagattttgagggaagatattctcttttctcctggtaaatctccctgttgatgatcattattttaaagactccaaagatgaaaacatctgcttgcacattttgtcgattcattttgggtgagggtctctggcaggcttggaagggtgggtgaacagtggaagggggctgcctctggtgactagcatcactcatatccatgtctgtggcagtcatcaggtgcttattatatattcgacttttggccacccctaatgggggtgttaaatgcaggaagagtccagtcaagtcattgcaaattggcattgacttttgggacctttctacacacgatagtcaggtagataccttctttttaaatttgacttgttattacttttttttgagacagggtctcattctgtcacccaggctggagtgcagtggtgtgatcacggctcattgcagcctcgacttctcaggctccaatgatcctcccacctcagcctctcaagtagctgggaccacaggtaaagggccaccatggccagctaattttcgtatatttggtagacaatgtttcaccatgcttcccaggctgggtggatacttttcaaaaataagttcagttcatcctgcctagccttgccccagcagctctagaggaattacccactctggtgctgggctcaggctgcctgtctctggaataatgtgctcagagctgcagggtaggcctgctgtctgactggcagagagagtcccatactccctaccctgtaccctgaaagatcaaggctgcccagcctgtccacctggtagaccatttccctgcccaattctccttctctcattcctgatgtgcagcttgatgcctgcagggactgtgccagctgagattgtctctaggtcctcccttctgccagctggtgtccagggaagtgggtcctttggcctgcttcctgccaccagaattttgaggaccttgtttctcccactgcaacttttgacccattcctgggtttctttttcttttttttgagacggagtcttactctgtcgctcaggctggagtgcagtggtgcaacctcagctcactacaacctccgcctccccggttcaagcgattctcctgcctcagcttcctgagtagctgggattacaggcacccgccaccaggcctggctaatttttttgcatttttagtacagtcgggatttcaccacgttggctgggttttagactagggtttcttcacctcagcagtactgtcattttggagggcaaaatcatttgttgtggggcactgtcctgagcattgcagggtgttcagcatcctacgcaaactctacccactagatgccatgggcgcttcccagtggtgacaattaacaaagtctccagacagacctacatgtcccctgaggggcaaagttacctccacttgaagaccagtggtgtgctggatggatactaatattaaaataataataataataataatagaaatcataatataactcatgtagttaaggtaagtcctttttgatggaacatttatttcagttaataatatttgtatatgtctgtcctggtagttttttttttttaactttttattttgatttaacatgagagtttgagaaatttacaaaacgaatgaatacaaagacctctgattaccccagattctaacgtttccacatgggctttctcctccctccccaagtccaccagcccctgctccccacctttctgtctctcttcccacccagcaagctccctaggagcacagcaccacttatgacaaaaacatcattttcttttctctgaggcggtattcctgacgtttggatttaggctgataagtgacagtgagttataatcatccttgcctgtgttgtccttcccacgttaggtctgtcatgccacgtatgtccgcagtttataacaatctctatcatacattgaaaagttttgaaaacttatccagtgaatccctgagcaccaaatgttcttttgtgttatttttctttattaggctattattactttattcagaatctctctgttttagagagagcctttctttcttgcctaacctagagtgcagcggcgcgatcatagctcagttcagtcttgaacccctggactcaaccagttctcccccgccctgggcttctgggcgtcctgatctctctcctgaaacccacggggctgggaggtgggaggagatcctactcctagccccatgagcgcgctccaggcctccagattggcccgtttcgggggcagggcgggccgtggggcggggtcgcagcaaggcttcccctctaccctctctgtgcctctcacaaacgctgagccccgccccgctgaggcctgtctgcagaatccacagcaaccagcaccatgcccatgacactggggtactggaacatccgcggggtgagcgagggtccgctgggcggtgggacgggggtgcgtgggggcggggaagtgtggagcagctgcaggacgggctctagggacggttcctcttcagggctgtccctgacagcggggtctgtgcttgccgctgtctgtgcgtgtggctgggcgtgcggggtgggggcgggtgaggcaggaacgagaggaggagatggggctccccttgtgcagagtcgtcacaaagtcagggaccctccatctctgacccgagctgtgggccatctctcccagctggcccattccatccgcctgctcctggaatacacagactcaagctacgaggaaaagaagtacacgatgggggacggtaatggcaccctcgagtctgggccctgccccctcacactaagttggcaccaagcaaccgatagtggccacctgtggctgactctgcaggcctcccttgctggaactgcaggctgtcccttccctgagccctggtgagggagctccttgcaaggcagaatgctggggcgggatgctgggcccccgtctgggtaattatgatgggtgtccctcagggcttgcctaaaccctggaagccttagctgtgtggggtccagagccctcactggaattctttttctctgaatcctgggatgtgggactgagtggtcagattctagatccacctgtctcaggggtcttgccactggctccttgggagggtccccaggaaggagggctgggctttggggaggtttgttttcacttcatcttccccaccacagctcctgattatgacagaagccagtggctgaatgaaaaattcaagctgggcctggactttcccaatgtaggtgcaggggaaggggcggttttgggggaaagtgcgacgtgtctctgactgcatctcctctccccaccttagaggtgttaagatcaggagtcttctgcccaattcctctcactcttggctgtctacacagcccttgcatgatgttctgtgtcccagctcatttattagtgtgacagtatttctatctcaggcctgccatgagcaggccctggtctcctctctgcccttgcatatgggaaggggatgctggggagcctggtggcccaactgagcttccccggtttcccatctatccagctgccctacttgattgatgggactcacaagatcacccagagcaatgccatcctgcggtacattgcccgcaagcacaacctgtgtgagtagatttggttgcaagatgcggggagggaccgtggcctcctcctcggcttggctgggctgtgaggctgagagtgaatctgctttacgagggtaggcggggaatcagaaaaggagcagattcgcgaagacattttggagaaccagtttatggacagccgtatgcagctggccaaactctgctatgacccagattttgtaagtccccccaccccactcccagtctccccttccctactcccagtctcccctttccctgcagagtttgtgtccaaaattgattccttctggtgagttcttggtcttgctgactctaagaatgaagccgcggtcctacacggtgagtgttacagttcttaaagatggtgtgtccggagtttgttccttcagatgttcagatgtgtccgcagtttcttccttccggtgggtttgtggtcttgctgacttcaggggtgaagccgcagaccttcgcagtgagtgctacagctcttaaaggtggcgcgtctggagttgtttattcctcttggtgggttcatggtctggctggcttcaggagtgaagctgcagaccttcatagtgaatgttatagctcataaaggtagttcaaacccaaagagtgagcaacagcaggatttatggtgacgagtgaaagaaaatacacttccacagcctggaagacaacctgagcaggttgctactgctgcttgggaagggcggaggtggggggggaaatcccttatttggccccacccacatgcagattggtccattttacagagagctgattggtccattttacagagtgctgattggtccgttttacagagtgctgattggtctgtttttacagagtgctgattggtgcgtttacaaacctttagctagacacagagcgctgatttgtgcatttacaatcctttagctaggcagaaaagttctccaagtcctcacctgacccagaagcccagccagcttcacctctcattttgatcaggagccaagacagtggtcctgccaaatacacgggtcctgttttctgtttgaactctttagtgctactcatccttcaagctatttcctatactgccaccagagtgaccctcaaaccccaaagtcgtgtcaaataaaacctctaaatcaattccccaccaatctacttatagaatcctgactccccagggtatgaattcactctctagacagtaatggttacttccagaatcccttccatctctgacccatgacctgtgctttgggccatctctcccagtggtttatatcatctgcctgctttaggaatacacaaactatgaggaaaacaagtgcaaaacaaaggagtaatggcacctgaaattttggtgtcttccgagtgctctcttgacatacactgagatcagcgaattttcctaacagacagcttaggggcagccagaggctctttttccccctcctttcttccactcatcctctgaatatctcctcatctttccagaaaccactcaatgtccattgtattcttctgctgcccaactaggaggaaatttctacttctttctctgagctcctttagttctttgcatccttgattctgctcatatctggtccagagcctaccaggtgctcaggtgctcctggggctgacccagaggttgttgggaggtcagtggggacagatttagggacagtgtcacattccgctctgccatcccatcacctcagaaagactccagctacccagttggagtctaataaatgctgatgtatccagctgaagcctggacagtgacccagttccagctgtggggaagatgactgcttgcccgcggccagctggggccatgcacaaaactgggaggccgcatctgtgcagggagcttgtgtctgagggtgttgacagctgttttctgcctcaggagaaactgaaaccagaatacctgcaggcactccctgaaatgctgaagctctactcacagtttctggggaagcagccatggtttcttggggacaaggtaatgggggcgtgtgatggggacaccacagatttgtcatacttcctatattatggaggtttcagcccacatatccttggccttatccagatcacctttgtggatttcatcgcttatgatgtccttgagagaaaccaagtatttgagcccagctgcctggatgccttcccaaacctgaaggacttcatctcccgatttgaggtgatgcccccagcctcctttctctttatgtctcttattcctttccctcctttgtgatgctttcccagtcctggagctacacaaagaataactcacatttttggccatgtgcggtggctcacgcctgtaatctcagcgctttggaggctgagggaggcagatcacctgtggttaggagtttgatacctgcctgcccaacatggcaaaaccccatctttactaaaaaaaaatacaaaaattagctgggcgtggtggcgagcacctgtaatcccagctacttgggaggctgaggcaggagaatcacttgaacctgggaggtggaagttgcagtgagccaagatcgtgccactgcattccagcctgtatgacagagtgtgactccatctcaagaaaaaaaaaaaaaaaaaaaaaggagccgggcatggtggctcacacttgtaatcccagcattttgggaggccgagttgggtggatcacctgaggtcgggagttcgagaccagcctgaccaacatggtgagacccctgtctctactaaaaatacaaaattagctgggcgtggtggcacatgcctataatcccagctactagggaggctgaggcaggagaatctcttgaacctgggaggcggaggttgcggtgagccaagatcgtgccattgcaccccagcctgggcaacaagagtgaaactccatctcaaaaaaaaaaaagaagaaaagaataacttgcatttattgagtgctggcttcatgccacgaactgtacccagcacattatacctattgtgttgaatttgaaatttacaacattcctacagggtggtagaattatctcccccattttagagacaaagaaactgagaatgagagggtcagtcctttgctcagggtcccagagccagtggaggctgtgctgggctccctgcgagcctctggatctatggttggcagtcagggctctcccatttgtgacagaagaaaagcctcaggccttgtccagcctgggtttcatagcccaggacactttggaagaggcagagcacttcaggaccacggatgcagctggcaatagtaggactgacacacagtagcattgatgttcaatactgaacccacaggcagtattcacagctacacccagaaactttgtatgattgaacccccatgtggggaatcctgagagccagggctgtggctggagctggattaaggtacatatgtgggtgcccctgttgaaggagcttatgctgaaatgccctgtgctggagcactttccttctctacctcttttttttttttttttttgagacggagtcttgctctgtcacccaggccggagtgcagtggagcaatctcggctcactgcaacctctgtctcctgggttcaagtgattctcctgcctcagcctcttgagtagctgggattacaggtgtgtaccaccacgtccagctaatttttgtatttttagtagagatggggttttgctatgttggccaggctggtctcaaactcctgacctcaggtgatccacccacctcagcctccctaagtgctgggattacaagcgtgagccaccgcgcctggcctcttcctctctttttttccctccaatgttccaggtgttccccctgtgagatgagtagcacgctgattttactcctgttcactgaccttctcctctgcatgaggcagggtgtgaggcacagtgggagatgcatagatgacagccccatcctggaaatgagtgcagtgagaggcctgcaggcagagcagcctgtgaagtgtgtgctgaacttgtttgagagcagcaaatcctacattactacagatttggggatttgaggcatttgtccaacaggcttctgagccttgaatctgtttcccttttccactccccatcaagagatctgcttgctcagctagttcccatcagctctggttctgcggttctggtccaggctgagtggccttggagttaggtaagaggtggtgggaagggagggatggaggagagctgagagctatggcccgttatgtgccagggtcaagcctgtcacccaggctggagtgcattggtgcgatcttggctcactgcaacctccgcttcctgggttcaagcaattctctgcctcagcctaccaagtagctgggattacaggtgcccgccaccatgaccagctaatttttgtatttttagtagagatgggttttcaccatgttggccaggctggtctccaactcttgacctcaggtgatccactcgtctcggccttccaaagtgctgggattacaggtgtgagccggatgtttttgaataccttatctgggcattcaatcctggtaagattgtgcacagcacatctgagtgtcatgtagcctgatctgcagcagggctggagatgccatgggttagggcacagtgagattttgctaagataccagatggagaaccttggactttctgctttaaggggaatgattagagcctagtctcgcctttgattttcttgtgcactgccactccccattccactttcatccaggttttactgagacattgggtgagtgtgttcagagcccctttgttctgctggaggtcccttctgtgtctctatacccagacaagccaagagcctccctgtggaaaaggagactgtttgtgcagtcaaggagtgacagggcctggtgtgaggggtggtggggcagaagaagaagagaatttggcagaaagaggccagaactggagagagacagaaccaggctacattgaagttctattccccttactaggtatttaaatgtaaggaagttgctgaacttctgtttcccacatgagaaatggtgataatagattcagccttgcagagtagtcgagtgggttttctaagcttacgttgtaatttctcttgggtacagagcacccagcaccgtgtagaatcttcataagtgttagctgttactgtggtacaacattacttaaaggaagttggaagagttaactccgcagatctggggaccctaagaagctgtgtgatgcctcagcacttgagcccacatggaaaggctgtggccagggccctgacctgctgtgtctgcagtggggttgtgccagccctcatgggcagctgaccttgagttctggccttattttcccccctctcagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccacatttgctgtgtgtcttatcttatttgctcctggccatctacccagactgtctgtctgtctgtcactgcctcttccaagggactggctggtgatcctggcagtggctgggttctaaaggattctgctgggcatagtaaggcgcttgagaattcttgctcccattcctgagagactcagagcaggaagccccatgaggcactgtggaaaggatgtctctttcttggcctggatctcccattcattcatccagccgtattgagtactttccataattgcacagagcttgtgtctcattgaataggaccccaagggggtggaatctccatcagagagaaccagggtcccttttaccttctccactatatgactgcatcacttctgttaggtctccaggacccaatctctattgtttttctcagatggcttccaggtaccctctccaggcttgctgcacagctgtcatcaggacgttctctctgggtttacttcctctctttcctgggtacctgtgagagaaatgtctttagtccttgcataactgaaagtgcctttacatgcttactgaatactctggctgaggatttagtctgttctcacgctgctaatagagacatacccgagactgggtaattgataaaggaaagaggtttaaaggactcacagttccacagggcctgggaggcctcataaccatggcagaaggcgaatgaggaccaaagtaatgtcttacatggcagcaggcaagagggcgtgtgcaggggaactcccacttataaaaccatcagatcttgtgagacttattcactaccgtgagaacagtatgggggaaactgcccccatgatggagttttctgcacccggcccccacccttgacacctggggattattacaattcaaggtaagatgtgggtggggacacagccaaaccatatcagctggggatagaattctatgatgaaaaccttcagacttctaatagatttattcacttttttctagaattgagcatttctggtgagtaggtcgatgccagtctgactgcatcctttgctttttaaaaattattattattgttgttattttgagaggaagtattactctgtcgcctaggctggagtgtggtggtgtgatctcgtctcactgcaacctccccttcctgggttcaaacaattctccttcctcagcctcccgagtagctgggactacaggcgtgtacactgtgcccagccgatttttgtatttttgttttagagacgggttttcaccatgttggccatgctggtctcgaactcctgacctcgtgatccacccacctcggcttcccaaagttctggaattacatgcgtgagccactctgcctggctatatcttttgcttttttacgctttttctgtttgtcattctgaggtctataattccaaaggctgtgtggggatctacaggttgatctcttcttgattcacatccttgcaggaacatgctaagcataggcttcctccaccctgacagcaatctgcattgcctcttgttgaagtaacttaaaatctcactggagagtgaactgcttcagaggaagattctcatagcttagcagttcctaagctgtgataccagaaatagctgttgagtctgtgggtcatgtattcacgcaaggctcagcagggagatcttgttacaaatcaacaaaggtctcttctccaaaaactatatatccgaaaatacaactcattaaaaaatgagtcagaatttcaacaagcatttcccaaaagtgaatatccacatggccactaagctcatgagaaggtgctcaacatcattagacagcagaaagttaaaaacccctaagatcctactgtatccccactagaatggctgacattgaaaggaccgacaattgttggtgatttatggagtaactggaactgtcatgcattgctggtgggaaagccactttggaatactggcactgtcaactagagctaaacctacatctacccag

SEQ ID NO: 14660 - DNA, 9281 bp, Human
aaagaaaagaaaagaaagaaagaaagaaagaaagaaagaaagaaagaaagaaagaaagaaagaaaggaaagaaagaaaagaaagaaagaaaggaaagaaagaaagaaagaaggaaggaaggaaggaaggaaggaaggaaggaagggaaggaaggaaggaaggaaggaaggaaggaaggaaggaaggatacccagaagcttctaaaatgaggaaagcacagataatctggtggaccatccaggaaggataattgatttctctcatacaagatgcaattcccatagtaggaataaaacaagatatatgcagcaaaatttgacagaattgaagggagaaatagacagttctacattaacaatgggaggctctaaaacccctctttcaattatggaaaggctgagacggaaggtaagtaaggaaatgcagaatgtgaacacacaatgaaccggttagatctcacaggcatgcagaaaataacctgacaacagcgtgcacattcttccccagggcaccacttccgcctccctcatccccactgctcccgatccctgtccacagacccacttcccgccctggtgtgatcctcgtggccactgtggcccctactttggagatcctgctggtccagttcttcccgccttccgcagagccgtactcctccttctgaagaagccacctgggacctgggccccgtcttcctggctcctcagagtccttgcaacagcaggcaccgcttctctctcctacactcaacccctctcccactccactgcctctcagtgtgcaaaaacagtaagaagtgtcccgtattttcaaaatctctcccctgtagttcccacctgacttctagtcgtaggtggccaaagtacagtgtttttgaaggattgttttattcccagtgcctggaatatggtaggatctcaacaactgttgtttcaataaaggaatgaccaaatgggtgaatactaatgtaacaatatcaattctgtttctttcataattattctcataagtgttagctttcttaaaaaatcatcttcacaattggacctagacattttatctttcccagctcaagatggataaactcagaatgacaggccaggcaccgtggctcatgcctgtaatcccagcactttgggaggcggaggcgggtggatcacttgagaccaggagttcaagaccagtctggtcaacacggtgaaatcccatctctacagaaaatacaaaaaagttagcagggcgtcgtggcgctcgtctgtaatcccagctgctcgggaggctgaggcaggagaatcgcttgagcccgggaggcggaggttgcaatgaaccgagatcgccctactgcactccagcctgggcaacacagcgagtccccgttccaaaaaaaaaaaaaaaaaagactcagaatgacacattcttaatgtcttaatgtataatgagaagtataactattcagaagtccaagcacttgtgtgtgcatggtgctatcgtcttgctgtaggcaaacctacatgggaatccaccttgacacataggccacttcctgagcctggacccagtctcagagctggggaactggcccaatgcaaaagggtcgggagcatctgcaacagagactgagctctatcagcttcggtgacatagcctccattcacgctccccaactcagcagagagagcacaccatcagacttctaagacttagtagccaagaagtgttgaattaaactctctgagacctctctttagtctgaccctggcagcctcagtctcccagagcctgtgggaactcggcagccgagaggcagaaggctgggcgacgtccggagaagaagaaacgggggaagaacttttctcttacgatctggctttactctcacgcgcacagccgagtccctggggacccagcagaggtccgaagcggagcggggcggggcggggctacggaagctggcgaggccgagcccctcctagtgcttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcggggtgagtgagggtccgctgcactgtgggaccgggcgcgtgggcgggaagtgccgagcggctggggaccggctctagggacggttccctccttagggctatctctcacaggagggcctgtgcatgcctgtgtgtgtgtgtgtgtgtgtgtgtgtgtgtgcgtgcgccggggtggggggggggtgcagtgcagtgtagactaggggctcacctggtgcagagaaagtcaccaagtcagggaccctccatctctgacacgacctgcgggccatctcttccagctggcccacgccatccgcctgctcctggaatacacagactcaagctacgaggaaaagaagtatacgatgggggacggtaatgacacccttgtgtccgggctctgcccactcacgctgagttggcaccaagcaacccatggtggccacctgtggctacctctgcaggcctcccctgctggagctgcaggctgtcccttccctgagccccggtgagggagtcctgtggccttgcaaggcagaatgctggggcgggatgctgggccccctgtttaattgggttgggtgtccctcagagcttccctaaaccctggaagccttagccgtgtggggtccagagccctcagcgggattctttgtccctgaaccctgggatgtgggactgagtggtcagattctagatccacctgtctcagggatcttgccactggttccttgggagggtccccgggaaggagggctgggctctggggaggtttgttttcacttcttcttccccacggcagctcctgactatgacagaagccagtggctgaatgaaaaattcaagctgggcctggactttcccaatgtaggtgcaggggaaggggcggttttgggggaaagtgcgacgtgtctctgactgcatctcctctccccagattagaggtgttcggatcaggagtcttctgcccaattcctctcactcctggttgtctacacagcccctgcatgatgttctgtgtcccagctcatttgttcatgtgacagtatttctatgtcaggcctgccatgagcgggcacagtgagtgcctggtctcccctctgcccttgcatatgggaaggggatgctggggagcctgctggcccaactgagcttccccggtttcccatctatccagctgccctacttgattgatggggctcacaagatcacccagagcaacgccatcctgtgctacattgcccgcaagcacaacctgtgtgagtgtggttggctgcagtgtgtggggggaaggtggcatcctccttggctggattggggtgctatgctcagagtgagtctgtgttttgtgggtggcaggtggggagacagaagaggagaagattcgtgtggacattttggagaaccaggctatggacgtctccaatcagctggccagagtctgctacagccctgactttgtgagtccctccctggtctggaccagaagccaggcttgtattcccatctactctggtcctattcacaatttgaactcctcactgctattgatcctctgagggttccctgtactgtagcagagtgactgtcatatcattaaacttataaaataaaaacttgaaatcagtccccaccaatcataggaagtcctatgaaagctagcaattcagttcctagacaataaagtcatgcgttcagaattcccttcacctctgacccctgacctctgccacgggccatctaacccagctggttcatgccatctgcctgttcggggaatacgcagactcacactatggggtaaagaagtatgtagtgggatgtaatagcaccctcctctgtggaattccgtgctattcttttcctagtgcttctccttgacacgcacagggatgaatgcattttcctaacaggcagctcaggggcggccagagggcctttgttcctctgtctccttccatgcagcctctcaaaatctcatctctccagaaactactcaatgtccattgtattattctgccactgcactaggaggaactttcaacttctttctctgagctcctttagttctttgtatccttgattttgctcatgtctgggtccagagcctgccaggtactcaggtgctcctgggctgacccagaggagggtggttgggaggtcagtggggacagattcagggatagtgttgcattcctctctgccttcccatcaccacaaaagcctccagctacccatttggagtgtaataaatgctggtatgtccagctgaagccagttccagctgtggggaagatggctgcttgctcgtggccagctggggccatacacagccctggggaggccacatctgtgcagggagcttgtgtctgagggtggtgacagctgttttctgcctcaggagaaactgaagccagaatacttggaggaacttcctacaatgatgcagcacttctcacagttcctggggaagaggccatggtttgttggagacaaggtaatgggggcatgtgatgaggacactagagatttgccatacatcctatgttacagagattccagcccacacattcttggccttctgcagatcacctttgtagatttcctcgcctatgatgtccttgacctccaccgtatatttgagcccaactgcttggacgccttcccaaatctgaaggacttcatctcccgctttgaggtgatgcccccatcctcctttctctttgatgccccttgttccgttacctcctttcagatgctttcccagtcctggatctgcataaagaataacttgcatttattgagtgctggcttcatgccaggaaccttgcccagcacattatacctatcgtgtggaatttgaaatttccaacattcctacagggtgacagaattatcttgcccatttagagataagaaaactttgaatgagagggtcagtcctttgttctgggtcccagagccagtggaggctgtgctgggctccctgtgagcatctggatctatgggtggcagtcagggctctcccttttgtgacaaaagaaagaagcctcaggcctcatccagcctggatttcacagcccagggcactttggaagaggcagagaactttaggagcatggatgcagctggcaatagtaggactgacacacggtggcattgacgtcgagtacgaaacccacaggcagtattcatagctactcccagaagctttgcacgatcagacccccacgtggggaatcctgagagccagagctgtggccagagctggattagggtacatatgtgggtgcccctgttgaaggagtgtatgttgaagtgctctgtgctggggcactctccttctttatcttttttcctctcttttttccctccagtgttccaagtgttccccctgtgagatgagtagcacactgattttactgctattcaccgaccttctcctctgcatgaggcagggtgtgaggcacagtgggagttgcatagatgactgccccatcctggaaatgagtgcagtgagaggcctgcaggcagagcagcctgtgaggtgtgtggcaccacctgggtaccaggcctggggcctgcccctcactcatggggaaccatccctcacccgtgctgaatttgtttgagagcagcaaatcctacttttagtacagatgtgagaatttgaggcattagtccaacaagtttttcagcctagaatttgttttcctttcccactacccatcaagggatctggttactcagctagttcccatcagctctggctgtggtctcggctgagtggccttggggttatgtaagaggtagtgggaggggaagagagctgagggctgcagcatatggtccacctgggcttggccctttgggaataggcagccctggctctctctgaatccttagaaattacacggctatttgatcctggaaagatcgtgcagagcacacctgagtgtcatacagcctggtctgaggtagtggggttggagatgaggtgggttggggcacagtggtgtttagctcaggtaccaggtggggaggtttagactttctgctttaaaaggaatgattagagcctggtctggcgtttcttttgctggtccaacacaccttgaccactttcatccaggttttgccaggtccttgggtgagatctgggctctcttccaggctgcacagacattttcagaggtcccctctgtgtgtgcaaacctaggcaagccaggtgcctccctgtgaaacaggagaatgttgtgtagtcagagagtgacaggacctcctgagggatttgggggaggatggggatttgacagaaagaggccagaactggagagagacagaaccagtctacgttgcagctctgtcccccttagtagctatttgagtgtgaggaagttactgaacttctgtttcccacatgagaaatggtgataatagattcagccttgcagagtagtcgagtgggttttctaagcttatgttgtaatttctcttgggtacagagcacccagcaccgtgtagaatcttcataagtgttagctgttactgtggtacaacattacttaaaggaagttggaagagttaactccgcaaatctggggaccctaagaggctgtgtgatgcctcagcacttgagcccacgtggaaaggctgtggccagggccctgacctgctgtgtctgcagtggggttgtcccagccctcatgggcagctgaccttgagttctggccttattttcccccctctcagggcttggagaagatctctgcctacatgaagtccagccgcttcctcccaaaacctctgtacacaagggtggctgtctggggcaacaagtaatgccttgaaggccaggaggtgggagtgaggagcccatactcagcctgctgcccaggctgtgcagcgcagctggactctgcatcccagcacctgcctcctcgttcctttctcctgtttattcccatctttacccccaagactttattgggcctcttcacttcccctaaacccctgtcccatgcaggccctttgaagcctcagctacccactttccttcatgaacatccccctcccaacactacccttccctgcactaaagccagcctgaccttccttcctgttagtggttgtatctgctttgaagggcctacctggcccctcgcctgtggagctcagccctgagctgtccccgtgttgcatgacagcattgactggtttacaggccctgctcctgcagcatggcccctgccttaggcctacctgatcaaaataaagcctcagccacatttgctatagtcttgtcttatttgctcctggctgcccagactgtgtctgtcactgcctcttctgagggactggctggtgaccctggcagtagctgggttcatagagattatgatgggcttagtaaggtgtttccaactttgttttttttttgaaataaggtctcctgcttcccaaggtgaagggcagtggcggcatcgtagcttactgcaacatccagtcctgggctcaagaatcctcccacttcagcctcccaaatagctgagactataggtgtgccaccacacctggccacattaaaaaaatttttgtagagatgtgtctctttatgttgcccaggctggtctggaactcctgagctcaagcgatcctcttaccttggcatcccaaattgctgggattgcaggtgtgagccaccatgcctggccctgtttccaacttcttgatctcttttctgactgccttagagcaggaagccacataaagtgctctatagaaaggatgcctctttctgggcctagatcttcatttatttttatgtattcagtattattcagtgctttccatggttaggcagagctaggtctcagtgagtacgtcttagatgcccagaggtggtggaattcccatcacagagaaccaggatccttctgtcttccacactgactgactccatcacagcttagatctctaggacgcaagctctactgtgagctgcttcaccagaaggttctcccactcagcagttcccaagctgtgttatcacaaatagttgttgattttgtgggttaggaattcaggtgatgcccagcagggagaacttattacaaatcaacaaaggtcttttctccaaaaactatatatccagaaatacggcccattaaaaaatgagtcaaaacttgaacaggcatttccgaaaaatgaatatccaaattgccaacaagctcatgagaaggtgctcaacattattagaaagcagaaagttaaaaacccataagatcctactgtatccccactagaatggctgacattgaaaggactgacaattgctggtgatttatgcagtaactggaactgtcatgcattgctggtgggaaagccactttggaatactggcagtgtcaactagagctaaacatacatctacccaggacccagaaatcccaccctataggaatgagtcttaatggattccaagagccaggtataatgatgccaaaagcagctttattttaaatagccaataactgaaaacaatccaaattccatgaatagaagaatgaacaaataaactgtggtttatcaacataattccatcattcatataatggtatatttactctgctataatgaaaataaacatgctaacactatgtgcaaaaacatggatgggtctcacagaagtgttgagtaaaaggatccagacaggagaaaggacacacgatctcattccacttacacgaaattcaggagagggaaatgagtccatggtatcagaggtcagatgattggtgaccttggtgagaactggaaggttgcctattgaaggctcctggtgcagtgctgtaagttttctctctttatctgggaggtgattccagaagagtatccaagtggaaaagcccacagagtagcacacttaaggcctatgcactgtatgtattacacttcaatgaaaagcatgcttggccaggtgcggtggctcacgtctataatc

SEQ ID NO: 14661 - DNA, 9044 bp, Human
aactgtggtacatatatatgatgaaatactactcagccataaaaaggatgaattaatggcacttgtagtgacctggatgagattggagactattattctaagtgaagtaactcaggaatggaaaaccaaacatcatatattgtcactgatatgtgggagctaagctatgaggatgcaaaggcataagaatgatacaatggactttgaggacttcgggggaagggagcgggtgagggataaaagactacaaataggatgcagtgtatactgcttggctgatgggtgcaccaaaatctcacaaatcaccaccaaagaacttactcacgtaacccacctgtgccccaatacttatggaaaaaaaccccaccacttatggaaaaaataccacctgtaccccaataacttacggaaaaaaacctaaactttttttttataagtaacatcacagatgctcacatcttcacatgcttttaagtattatttgtactcagtgtaaggctattatcatttttcatacataaagttttttttagctgtgtaacaatgcaatttgtaatccattcaagtaaattcagccccaaagttgttgcttcccagcattaagtcctgcgcccacccctcttctaagattttctaaaacttgtatttcagaggaaaaaagtgtagctgaagggaatgcatatttgatgcatatttggctacacgatttctgtttactgtattttgcttcctattttatgtctaaatcctattattttcatttaaaatcttaataatggctcatttccagtatgtcaatttcaaagacttaaggttttgctactagtatcagccatttactttcccactaattgggatttttttttttttaaagagtttatttatactcttttagagcttgtcccatggtccttctggtttccctctaccacttgggagggatgactcctggccacacccccattggttgacttgttttccagctctactggaaatctctgggatttgggatatacagtcagaatgtttctgtcaacgacagaccacatatacgggcggtggtcccacaagattataatgatgctgaaaattcctattctctagtgatgtggaagtggttataatgtcgtagtgcaatgcattaccttttctatgtttagatacacaaatattatcgtgttaataatagttgcctatgatactcagtacagcaacatgctgtacaggtttgtagccaggtgctataggctgtgctatacagtctaggtgtgtagtaggctctaccatctaggtttgtgtgagttccccctataatgtttccacagtgaagaaatctcttaacgacgcatttctcaggacgcaccctgtcttaaatgatgcatatgttacaaactagcgtaactttttttttcttttttgagacaaagtgtcaatcttgttgctcaggctggagtgcaatggcgcaatcttggctcacggaaacctccgcctcccgggttcaagcaattctcctcctcagcctcctgagtagctgggattacaggcatgtaccaccatgcccggctaattttatatttttagtagagaccggttttctccatgttgttcatgctggtctcgaactcctgacctcaggtgatccgcctgccttggcctcccaaagtacagggattacaggcgtgagccaccgcgcccggcctagtttaactttttaaagtgcattttcttgttgtcactgccatagtatttaaatcttttcctttgctggaacacaaagaccttcagtaattttcttttcaccacaatttctcatccagtaactaagccccttcttgccctctccttaggcccagcactgacggggcaatgacaccgttgttctcaccgggggccatgatgaagtgaaaagagaatgggcctagcagacatgagactgaatcgagcctttgccagttcactaactgtcaatcagaaaatgtgcaaatgtacttcactctagttttctcatctgtacattgaggcaatgagtaaccacctcataggtggtaagggttagataggaaagaacacagtagaatgcctagcacacctaagtactcaatcaatgttagttctggacctttcatttgaatactgcttgagctctgtgcccaatctccctttcctggatcaaataagatttttctttgttagtgatttctttctagatacttccttggccagaactatagatcctctgtctttcactaactcttgttgatctatggttctcattcaagtttgtgtagaacatccagagatttcagaggcattgtttactcctgatgaacagggaacattgcgtgtccaggaaccagcacactgcctgagttatgggggatattcaggaagcatgctgaaccaatgaatgaatgaacaaatgaatgaatagctgattctgactagtcaaccaaaacttaattagcgccattgcttccagatgttattgcttctcaagggagtatgcaatgtgaaagaagaaagaaaaaaaggcgcctctcaatcgtcaaatatcagtagatgcattggttttattaactgatattttctcttcaaaggaaaggctgattcagtcttgcacaggcgaaagatccagtgggtcccattggttctctgtgtctcctgctacacaaattactgacggaaagatttgagccttcattgtgaccacatccacagagaccatagtccagagagagcaattggggcctgaatcaactgctggtgtttgttgagcagaaacagtgagtctctgacttcccaccaacagctaacctgatatggaagagccaagaggcatctcagatttgtcaacattgctttaatgagctgaggaacttctcatggtaaactcagcagctgagtaacaggatgatggcaccacaacaggtagataatcaaggcaggaggtcaaagcactggagccaacacccgcccaggatggggtataaaagggttgggaggagaggaggcttcagtctcagtggctcagccttcccagctgatctgaagctcctgtgcagcctcagccctacaccatgacctccttctacagcacctcctcatgccctctgggttgcaccatggctcctggagcaagaaatgtctttgtctctcctatcgatgttgggtgccagcctgtggcagaggccaatgctgcctccatgtgcctcttggccaacgtggcacacgccaacagagtccgtgtggggtcgactcccctgggccgccccagcctctgtctgcccccaaccagtcacactgcttgtcccttgccagggacctgtcacattcccggcaacatcggaatctgtggggcctacggcaaaaacaccctgaatggccatgagaaggagaccatgaagttcctgaatgaccgcctggccaactacctggagaaggtgcgccagctggagcaggagaatgcagagctggagaccacactcctcgagaggagcaagtgccacgagtccaccgtgtgccccgactaccagtcctacttccgtacaatcgaggagctccagcagaaggtgaggtgtgggatcgcctgggcatgctgggtctgagaaggcagaagccttcgcaggaggaatctgcataaggtccagagagctttgggttcttggtttctcttggacatgagcgtaaataccacacatggagtgggagcttagagtatggtgctttgtgtgtgaaccgtctttccgttttcctcagatcctgtgcagcaaggctgagaatgccaggctgattgtacaaattgacaacgcgaagctggctgctgatgactttaggatcaagtaagtcaggatgaggagggtcagtgtgacttctctcctgctgtatttccaagggcccgccccattactcagtctatattgtaggtgttcaaaaacagtttttgactagaagaatatttctctccacaccttaaattagcctgttgctagaaatggtcattatataggaggaaagagaatataagcattgaaagaaaaagaagggctgtagtctagattggttagaacctatgtcactttctcccatatctagaagataagaggattttgcttttcaatcagaagtaaaattgagtcatcacaaaaataaactgtcaatgcataggttgttgctagactctctgactcttggccaaatccatcagctggaggaattgtcattgaagctccttggtagctagagttgtgcttgaatgaaggggaaaagcaagaaaacaacgagaaataatgaatccaagaggaaaagcagcaaactgaaggtccagaggcttatttttagccattctttttcctggccaaatgactcctattatggcagaataaatgctgcatttgaagtcagaacacttaggatgagtccatgcatttactattaactgggcatggaattctgaacaactcgtgttttgtttctgagcctcagtcttccatctggtcaatgggcataatgtcctgactacaaaccgtgtcgctgcagggttgagaatagtgtatactgcccacgtgaacaaataaggatccaaggtggtgtgggaggtaggaagccagggcagctgagaggggctattggggcattctttttgaccctgtgcctcctgtgacggaaggctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggtgtggccctggctgctcagactcctggggagggcgctgggcagacaggggagctccccggccctggggctctcagagcattgcctgggctcagctggcctaaggatgcagggctgaggtgggtctgagggtccagagggcctctgtggaaagtgcagacttgccttgggcatgaggaaggtgtccaggtgggctctcccaaatgcactctggacaagactttcccatttgcttatgtgtgggactcccctcctactgcttgccagggacggagtcctggtgctgtctgctccatcaaaggccgtttccttacgcaggctgtctatcgcttccatttctgcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccaggtgagtgggggttacagagccagggagtacctggcctccatctgagcagggaggtgactgtgtttctctgtgctccagtctgaaggcatcagcctgcaggccatgtcctgctccgaggagctgcagtgctgccagtcggagatcctggagctgagatgcacggtgaatgccctggaggtggagcgccaagcccagcacaccttggtacgtgtccttcaccctcactgcactgcaaatgccccatgccatgtcctggtagtagcatctcttaaagtctcacaaatcagttccttcaacattaagtcaagatctggggtcctctatacccgatggagacgtcttgctgtcaagttcagtgtgacccagggaaatggtttcttcagaaaatcaagtccacttcctttacaacacagtgcggaagttcaggcactcactccacaagattttacgaggtgcctgctttttgtcaagcactggggatacagggatgaacatgacagttccttaagttagatttgtgtgcatgagagagaagtcatggtcatgttgacagtgatttctccagagctctgagaatgtcctatgacattttggaatttgccctatgtgtgatgagtttggtcatgattttcactgctgagttttggggcacctggatctcttaccccattatttcccattacagaaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttctggagagcgaggactgcaagtacgtgtgatctgggcaattcctaagccacacacatgactgtcaggcaattcctcagaggtaatggaagtgcttgcagaagatatcatcttaacaaacaagccttcctgtgctctcttgctcagtgactcattaacctctcctggtctgtgcagactggattattgagaaaatgttctctaaatgatagccaggtccctaagccaaatcttccccaaggattcctggatgtagaaagacacagatgagagaactgttggtatagattctctggtctgtgtgccttgttggtggcaggcccagccttcaccctgatcttacccttgtccatcaatcactgagacatctttttaatgtaactcttctttctctccctgcagactcccctgcaatccctgttccacgcctgcctcctgtacttcttgtccaagctgtggccctgtcaccggtgggtctccctctggccatggagccagcatggggagatgattctgaaggcccgagttaggagattgaggctggttgcactggggtcaggagtgccctcaccttgcccagtcttccttcaagactagactcactgaggcattttccctaaatcaaccggtagcagatacttccaaggagtggctccctgcctatgcctctaagctgtattttttgttgttgctaaaatgttgtaattatcttccatgaaagcaattatttttcctggtgtctcttcttggtacttttagttctattccagtgtttcagaatctccaaaaatgtaactgggttccctgcattaaatggtcaataaacctccttcctgcaccaagtgctgtctccccggtgttggttgtatgtgagatgtcggagagtcctggtcgtcaggtcctgtgtcctcactggctctgacatcttgcttccaggagctccctggggtgctctggggcctctggatgaaggtcccttcctgatgttggatgtgtattcacctttcccagggatccctatagactggtggaaggaagtgatgccagttgccaagtttgaattctttcagaacagctcagagctaacatgtccctaccatgcttttggcatcttcagcctcttgttattttgtccaagagcaaaatcacatcacttagcattctaatatcgtcaaaggaaggtcgtgttgagaattgtctgagccaagttgccaagtttttcctctcactccagttggcccctttcatggagccatggaattctcgcccactctcccaaatgcagaggcccagattgggcactggagactggggtcttggtcctggggcacttctaggctttagttttctctagagagatgctgccactgatgtttctgttgtctattctgctgctgtcttggaggtgctggcggtgagggctgccgctgccatcagagcactccaagtccctgcctgcctctcagatgtggctttggcactggccaaggtggttcacagccagatgcagttataagcaggtggaggagcagcccagagaggctgctgcctcccacgccatgctagtcagtttacggcaagcaccaagtgtgtccagaagaatgaaactcttgggtctcagcttgtccatgtgccctggtgcaaagagcaatgaaaaactggtccttcttcatggtggcatagtgtggtggaggtggatcttctctagggtcagggaaacttgggttcaaatcccaccttggtgactctgaagtgggatttgaacccaccttgctgagtgaagttggccaggtcactgcattctcttgagacctattccttgtttgtggaagtaggatagttgtatttccctctcactgtggttgaggggtaatgcatctaatgttcctggcatctagaaggtgttcagtggatattggtttattggggctccctaggaaccagcaggtacaatctcttcctcccagagagaaaaaggagctgaagagatagtagcagaacccactctcagcatcggggccctagattctacgttggtggctggaaagtttggccatattccttgttcatgtacatgcaataataaaagccatcttctgttgtcattaggcctgtttctcactccaagtagcctaactgaatccaaaaaagcattcattgggctgtcagaggacaagactgtttggtgggctcttctaatgaggaacccacaagagtcatgttttaagaagtggccatgaccctccctgaccctcagtgtgatggggttgtggagatccgacctgtccccacctttcttggccaggtcacacccttaacaagctctacctatgaggtcccatggctaggtgtgacaggaggtgccactcaggtacatagaaaatgaaggctagaggctggcaggtgggtaaccagtgcagtcaggacacctggaccctggggttttactcacattcgttatcctagcctgagagcttagggctccctctggtaccaaatcccagacatcttttcttgcaagtgattctcccgcctggacattctgtgcctgtccctggcctctctgcctcacatactctcaccgactggatggatatagccctgaatgtggcacaataggctttgctttggccacaataactgcaaccaggtgtctcttattttccttctcctgaggcttctgctcccttggctgggggccacatctggttctgagccacctagtgcttagcccgtccctcttcagttcaccaatcctgcactgcctgtgggctgatgtgtgatatttcttcccagccttcacgtggtaacatcagttgcggctcatgaggc

SEQ ID NO: 14662 - DNA, 11577 bp, Human
ccaattctataggttgcctgctgactctgataacagtttcttttgctgtgcagaagctctttagttgaattagatcccatttgtcaactttggcttttgttgcaattgcttttggtgttttagtcatgaagtctttgcccatgcctatgtcctgaatggtattgcctagactttcttctagggtgaaaactcacatttctaacatgttcctgagtcaggttgatgctgagagtgactgataacaccttattataataattatagtttttgggtgagaggattaaatgggcaaattaatgccaagcactcagcaccatgcctggtatttgtatacattccacaagtgctggctatgattctgaagggtggcctgatgagtctcatcccttgtagttggtattgccatcacacctccttccatctgatgctataatcttctctaaataggtaatccagacaaggtactggaatttgtagttgttgcagagaatcaaattgtgagagtatttgatctgaccccctcgattggcatgaagaaactgaggtctggagagacaaaattactttcccaaggccaaatggcaagtcagaggcagtatatctacgctctccttttcttatgcaatgaatgagctgggtggcattttccctttcctgttcttgtactgacatttctgggaatatgtgaaacataaggcaagtacttataccccaaaattatatcaagaagattactgaataaaaaagtggctatatagcacacacatactaaatgtgaagctcacagcttttgcagccaggactgaaaaccactgctctagcatgttgccttcttaagtgaatgcccagggcttctatagttgggcaaatatgctccctgtctcctggcttagctcattccagggctatagaacatcctttcccaagggagtggattcacactgcttccatagtctgagatcctgaagtgagccttccccatctgccacaacagaaagtaaaagtagaacctgttccaactattctcagtctgttcaacaaacaattattgagcacttgacaattgtgtatatggtgcagtgataattgaatggatggtccagagggggtcaagacagagcagctgccacctggagatgttcatgatatggacttttccaagaggaagagaccaactggaaagatgtacctgattcttaggcttctgtttgggtctttttttttttttttttgccttttgaaggggtgcagcattcctggaggtactgcaataccaggtcaacatgtagagtgaacagagcaagctcttattccatctccctgctcccaaaatccatttaatatgttgtcctcagatggaggacgtatcagatattaagacgataagaacagataccacacttgatcttagccaaaaggctgagaagtgatgctgcctatgtcttgagttcattctctccccactgatattattttcttccccttggcaggaagatgatgtctgttaggaagcctctgaggttcctgttcctttctgctggatttatgccgctgccagcatcggagcagtttctaccacccacacatttccttgttaaatagccaggcctcttcccatggggaatgctttcattaaaagaggcagccactgctgcacagacctgcaggcttctcagggctagagcaggcgggggtgcagtgggcaaagccagtggaggcacaggctgggttgtggcagtctcctggagggcctgccctagtaatgagggcccaggcatgcggctgaccctttgaagatgtgtcctgaagctctctcatggtgatcaatgacaggaacccagactcctgctttagccaaatgataagtttggcctcttttattggaaaccaaattacaaattaattagcagcttcctctggggctgggtgtgaacatcaacaccacccaatgatgaatttctatcatgagccccctcactgcaagggcataaaatggcccgggcggcatggggtctgtagacatccaggtagctgtggctgaggagaaagggcctctccaacatgacatcctcctgctgtgtcaccaacaacttgcaagcctctctcaagagctgcccccggcctgcctcggtctgttccagcggcgtgaactgccggcctgagctgtgcctgggctatgtctgccagcccatggcatgcctgccttcggtctgcctgcccaccaccttccggccagccagctgcctctccaaaacctatctatccagttcctgccaggcagccagtggcatctccggctccatgggccccggcagctggtacagcgaaggggccttcaatggcaatgagaaggaaaccatgcagttccttaacgaccgcctggccagctacctgacgagggtgcggcagctggagcaggagaatgcggagctggagagcaggatccaagaggcctctcactcccaggtgctcaccatgactcctgactaccagtctcatttcaggaccattgaggagctccagcagaaggtgagggcagcggtgaggtgaataggctctctgggaagggaactggactagctggcattccagattggaatctcgttagcttattaagctatgttcaggacaaagagacttccctagggcatagggttattttataatttgagcactcagcctgaggctttcatgtggagagatctgggatctagtctcagttctaccattgcctcattgcatgactttgggggtcccatcccttccccaggcctcagttttctcatctgtaaaacagggataataatggtcgttatctaatggggttgtcaaaaggatttgatgagatgatgcaggtcaagtgcttggaacagcccctggtccacggtaagttttcagtaaatgtcaaagacccttctaactgtcacatgagtgacttcagacatgagattcttcccttccacattgcttggcacatccaaaatggggaatttgaatttacgaagcttcaggttcttaaaaaatacatctcaagttctccaaggactagcaattcgctaaatatctcccagagttccagggaagaggaccttctgcagggatggctgcagggctgctggatcctacctttgctgctgtcttctcttcatttgggttcttcttgcttcgtctcatcctgaactaaccctctccatgtgccttggcctacagattctgtgtaccaaggcagagaatgccaggatggttgtgaacattgataatgccaaactggctgccgatgacttcagggccaagtgagttcagtcggggggctggagctggggaggacctgtcctcataggctctggggcaactttccattagtttcacggagggttggaaagtgccggcagtttaaggccttccctgagttctgcattctgtttcacccttggttgctgaccctgtccttgtgcaggtacgaggcagagctggccatgcggcagctggtggaggccgacatcaatggcctgcgcaggatcctggatgatctcactctgtgcaaggctgacctggaggcccaggttgagtccctgaaggaggagctgatgtgcctcaaaaagaaccatgaggaggtgaggctggaagtcccgctgaagtggccccgggaagcagagggggaggaacgtggggtatggggttggataggcgtgggttgaaattcccaagcctgccacatgttgttttagtgactttgcccaatttatggaatcttcctgagcctcctcttctgtaaaatggggacaacatgatcacgcagggttattgtgaggatttaatggacaggatatggatcatggaaatccccaaggcatgggtatgaaacacctgccacttggtcaactctcagaagtgtagcccccttcccttctgcatttcctgggctagtgtgactgccaagcactcactagtggcaactgcatttttttctctcgagagccacacagcagaggtagagtggtgcagtggtgccggggtgagttatgttccagatctcacgttgaatggcctgtccatctctgcctggctcaactctcagaagcagtcccatctcttctgagagggagtacagctgcagtggtctcctctttttgcccctatccttattttgtcctcccttctgtttgcatataaaatgctcaagctgaagccctttactttctgatttttccttatctcctgaagtttcttggaggggaagccctctgctttgggcacctgtgtgctgccaagcccacctgagccatggtgtttttcccccctccctggttgactctcaacctcttgacttgggatttgaatgaacaagtgcctctgaatcttggctgggtttcctcaggcttaagtgtaaagtaacaatcagtcaccacgtactcaccgagcaccctcgggctcctgactcatcttgctcaaatcagagaactgggaacggcaccaagaagccactaatgagaagttatcacacatcctggcagactcagtgacaactttccctctttggcagccaagcctgggaggcagctgccctaactcgggcgtttaactagtcaagccaggcttctgctaccctcctcccaggatgaacacaggtggggagggagactgggaatactaggggtaccggtttcccattttagcccaaatgcatcaaacaaaccagggtgctgctcttggcttctgccaaagtgataggaagtgttgtgttgcagtgaggttcccatcgcaggggtattcagctggagtttgaagagcactgggatgctgctgagtggactgcagtccttaggggccatctaatgtttcaatctttagcaacttttgttgcatcttttcatgtctccctggggaggtgagccaggatcctatcattgtcacatttttctggaggtcttgtgccttttcaggaagtcggttcccttcgatgccagcttggggaccgccttaacatcgaggtggacgctgcacccccggtggacctgaccagggtgctggaggagatgcggtgtcagtacgaggccatggtggaggccaaccgcagggacgtggaggaatggttcaatatgcaggtgggcctctcacggtggggatggcctcctccatatccctaggaagggactctagccttctccttcccccaactgcagatggaggagcttaaccaacaggtggccacaagctctgagcagcttcagaactaccaatcagacatcattgacctgagacgcacggtcaacacgctggagatcgagctgcaggcccagcacagcctggtgagagctgctgggtgggcacccatccctccggatcctaggcggtactgagcataggtgcaggtccccaggaaagaggaagaggaggctcagatttcagccaccatggatgctcatcctgttgacttttcccggagggaggtttctcccgagatccagctcagagataaaaaagggatgtttcaaatcagacatgggttaggtggacactgtcaaactcaactccacaagaaggcttgttctgtgcttagcctgcccttccaaacctatggatctcaatatcacccatcctgatgcccaggttcttttctggaccaactgaaccagagtctctggaggtgggacctgatcacagctattttttttttttttgagatggagtctcactctgttgcccaggctggagagcagtggcatgatctcagctccctgcaacctctgcccccgctgggttcaagtgattttcctgcctcagcctcccaagtagctgggattacaggcgtgcaccactatgccctgctaatgtttgtatttttagtagagagggggtttcaccatgttggccaggctggtctcgaactcctgacctcaggtgatccacctgccttggcctcccagagtgctgggattacaggcatgagctactgtgaccggccagccatgggtattttttgagggctcccatgtggcgctaatgtgcagctaggtttgaaaacccctgttctaaatgatgccggcagggaggtacttgggaaatctcagatccaatcctgaaggcagacaaaggttgcggaagaaaggagggatttaggatcagatttacgaatagaaactgtggttccataatgtaccagctgtttacccttgaacaagtcatttgacctttctggcttctgtttccaaagtgactggtgtagggagggctcatttccagcatcaaatggagatttggctcttcttggttctttctgaagcaggccatggtaaacagctcccttcctcatggttatgtcttcctttgccttagagggactccctggaaaacacgctgacggagagtgaggcccgctacagctcccagctggcccagatgcagtgcatgatcaccaatgttgaggcccagctggctgagatccgggctgacctggagcggcagaaccaggagtaccaggtgctgctggacgtccgggcccggctggagggcgagatcaacatgtaccggagcctgctggagagtgaggactgcaagtacgcaggcccagctgaggcttagagagacgtgggcagggattctgggaggttataggaagcaactggatctacccttgagggaccatcagcttagaaccctgtcctgactatggagccattaagaagctggtatgctctgaaggaagtcaggcagtggtgttcatgctgccatcctgaaccaagcccctcggagaccattctatctcattccaagctggcaagctccttctaagtgcccaccatggggcaggtgctatggaggacaccaagatagaggaagacagggcatttgccctcctgtcatttccatatgtttagggagataggcagacaggtgactggaggtcatggcctgtccggagcttaggatgaaaagcagctttattaatagtacctacacaatcctgctcccacctcttaccccagcctcacctcatagctccattcctctcagaacggagattttggcatgtcagcaggacaataggtagccttgtgtaattgagccctggtggggagcaggacaggaaagatcagccggggcccatttatggagaacaacacgggtcatactgggaagggagggctttaatttataggtgagtggaaattgttttgaggaggaaatgagagaatttactgtgtgtcttctccactagatggtaaacatctagaatgcagagacattataatacaattttattccctgtacgtggcacatagtagatgctcagtaaatgtctctcaagctcaaagctgttcttcaggaagatggccctgatagcagcaggaagaactgagtagagggaggggaaccaggcagggaaactgtccaggaggccctggccacagcctaggtaagcaatagggagggcctgagttagggcagcagaggcatcagctctagacactgtgcaggtagaatcagcaggacttggtggctgtctgaatgcagggtacctctgggccatggacacccggtgggctgacgactgttgtagctgtttcttattccgcatttggcgttgcttctccatcattcagaatctataacttcagggcaagtgttgtgtcaaacatttgcaaggaccaggccattaacatgcatgaatgacgtgggtcatactgagatggtagaaaagcagaaagctcttgccttgtccaatccaggcaatggcatgccctcagggccacttctactgtgtgagaagcaggtccaatattgctgatcttccaatagttccagggaagctgagaatctgggtttttaaaaatgttaaattctcctgattcttaagtattttcaaaaaattaaagaaaatatatagtgccaggcaaatggaacacatttcaggttgcacatgatcctcaggcctcccattggttctctgagctactgggtttccatccagcatccagtgtgttgttcctggttttgagtgcatgcctgtcagtctctgagatcatcctttttcctttcaccatgtattaattcttcattcatttattgttttgtctgatccaaatattcttattaggtgcctattctatgtgaggtatgcagggtgggcatgggtctgtggctgctggcctcactgcttggccggggagacagaccataatagaatgattactactcacgatgaaaggagatacatgtaccatgggggctttgtctcagagaggtgggggaggcttcaaggaggacgtgacagttgagttgagctcttaaacaagagaagaaatgtaggtgagtggagagggaagagggttccagagatgtacggcacagggcacaagccctgtggcctgagcagtacagtccctgcaggagctggaagaaggtcagagtacctgcagctcccagagtaatggagctatcaggtgaggctggggcaagaggtgggagcaggatcatgcaggtcctattaaggaagcttcttttctttattttattttattttactttaacttctgggatacatgtgcagaacgtgcaggtttgttacataggtgtacatgtgccatggtggtggtttgttgcctatcaacccgtcatctaggttttaagccctgcatgcattagatatttgttttaattttctccctccctgctcccctcacctctcgacaggccccagtatatgatgttcccctccctgtgtccatgtgttctcattgttcaactctcacttatgagtgagaacatgtagtgtttggttttctgttcctgtgttagtttgctgagaatgatggcttccagaggaagctgcttttcatcctgagctcaaatggaagccactgaaggttttagggaggggagggacataattggatttgtgactgtagaagattgctctggctactaagtggacagtggttaggaggggcccaagtggggttggggagatcagttaggaggccatgaggtgactcaggcaaagatggcggaggttgggaccagggaggctgggcagagaaagcacggaagatggggttgagaggcatccgaggggagaattggcaggacctgtggccgagtgggccttctctactaatcctgtttctctttgactttctcctgcaggctgccctgtaacccatgctccactccttcctgcaccacctgtgtgccctccccatgcgtgacccgcaccgtctgtgtgccacgcactgttggcatgccttgctcaccctgcccccagggccgctactgaagtccctttgtgccagtggatcctggagggcctggggctgggcagcctggtattcagtggccaccagaagagcagggccagccccggtcagcaaggaagaccctgagcaggaccgtggatcacctgcaacaagctctgatactccaggggatacttaagccctcatcacttcaaaactgcctcttttttccatgggtgaactgttctctttggtgatgtttctggttgtctgtgctgcctcaaagagcgtgtgttcttagttaactggcaaatagagctgtactcagtggccttgcaaacatgtctgtctctgtttgtcacttacgctgctgcatccacaagccaatcctactcaattgggcttaagaggaacgtgggcaaattctgtatttatttttatgctccttctgcttccatagaggcttgagaggtgttcactaaaagggcccgcatgccataaaccagttaaaactaatcaattactctagagccaagtaataaaagaataaagagaggagggagataattatgccagaaacctaggccaaattactgtaattgagaatcatatcataataaacccacccctaaatctcattacagctggtacaatgtgatcattcattctttcaaaatatcttcactgagcagctactgggtgcaggttctgcattagaggctggctaatccaaggaagagttcccagacacattgttagtaatgcttcatttaatccttgcaacaatccgtgaaaaatatgccattattgcatccattttgtaaatgaggaaactgaggcccagagaagttaagaaacttgcccaaagtcacacagcttgttagtggcagacccaggactgaaatcgaagcctttgggctctagagatgctcaaccgattcacattcacagtcctcactatttgcaaactacagctgggtgcagggggtattaaaaatgcaagtgatcaccaccattcaaacacttgtaattacaggaggagctaagacccatgtgcataagatgccactcctttcttcataagggccatataatagtaacagtaataatagtaataatggcaacggttactaattcttgagcacttataatgcactgagtactgtgtggagcatattacataaattaacttatgcagttttcatgaccaccttgtaaggtacacatagtatccattttagacatggaaatggaggcatagggtggtcaagttagttgttgaaggttacatgcaaggacaaagacttaaacccaagtctagcttcacagcagtgttattttaaccattctaactgccaaattcctacccagaaagagtaaacactagtcaagatttggagaaagtcttaagctgagaggatcctgaaaggcttcttgtagctggtggcatttgaaataggtcttggaggttgaatagaaggtctacagggcaccagataggcaagtaagtgtgtggggatcttcaggagagcagggggtcatgcttggaaggcctcaaggggtcttgctggctggagcagtgagttcctgtgagaggctgatggggatgaagctcaaatggtagaaaggcatcagagagtaggggggccttgggtaccccacaaaaagcctggattctggactctatcctgaaggcaatgggagggctgctgcaggatttgagcccaaagatgacatgacttgagtggcatcttagaaagtatcaccaagtaacacagacaggatagctaagaggaggggttaggctgtggaagaagctaacagggtctcaggcaagacaatgtcagggaccatggaaaaataaggaatcaatctaagagacactgtgatggacctgacttggcaatggattggccatggcaggtaaagaggagagagctggggacaggaatcttgaacacctttctgaacctcaccctccaaacacacagttcttccttaatgagctgagatgatgtttctattaagtatcctccctctggccttgccaagaaatgatgaaaaatggattggatcctgaagctgcctgcaggctgctctccagacatgatcctgcaggcatccctggcagacaaggtcattagcctgacagcagggacatgaacatactgcttagcaagctgtggttcctggttgatggatgggtaaaatttcaaggagctgaaatgccaagagagaggggttctggctaattgaattttctcataactgcgtgcaaaccagcaatctttaatttcaaccccggtgcaaaacttttctggaatgtgctcagcttgataaa

SEQ ID NO: 14663 - DNA, 8617 bp, Human
  misc_feature (1)...(8617): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatacattttactgtatgaaaaatgtacctaaaaaatgcaccttagcgtcagacagaaccagacttggatttcagtcctgattctgcccttaaggttcattttcctcatgtgtaaatgggggcaatagtaggaccctcctcctgtggctgctgtgaaggttaaatgagatgatgagtgtaaagtaacttcacccagttcctgcctatggtgagggctcggagaatattcgctatgataatggacagggccacttcctctttccatgcctgagtttccacagctgtgtctgatggtccctaagatcccttaaggtctctgtcactgtgactttttctgatggcctcggagctatttctttctcagtctaaatactttcaaggcaggtgattctatcgaaccaagcaaagtttgtcatcagagttgctggggcccctggagtagatgaagtgctaagaaggatccaggacatcccagtcagaagttttaggtatagaaaaaaggaaggtcgagggctacggtgaccttgcaaagcacagagccactctgcacccaccactttcctcgcagaagctcctggcaggcctccgcatctcaggtcccgttctaatactgggtggggctcagagcctgcacagtgaactccttaagtggaggtgaaacagaattcacttgtcaaaagggcagtctcaggcagaatgctgtcccctctgaatcattctttttgttaaggattaaaaaaaaagccacccctaaaaggcacaacccaccctggagagatcagagataactaagcttgtgggaaacagaagtgtagttggcaccaagtcagagggtggggaagggaggagagaagataaccagcccctatggaggtgtataaaaggtgtccactctggggaagagccacagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaaggtgagcccttggaagctgaggaggggtcctccatgaagggcagagcctccaaggccaagaaacacagtgttgtgggggactaggtgtggacggaattcacaaacttcttgcaggggaaaagcctactgtttgactaccaagagtctctacctctgatgggctttctcatgccacaactccccaaatgcattttctctcattattcatttttatgattgttattactcaggtcagtttttttactgctttccagacagttatgttattcatgactcgatctctataatcctaacctactgagttatctggaaacatgacaggtttaaaagccattaagaatgcatgaaatcaacagagaaagagagacgtgttcattcattgccctgggaataattgtttactttgtaggggacccattcaaactggtattctcaactggcgatggccaagttgggggagagagaggcagaggcttaggcagtgccgagcctgggtgccctttgttgagccctgtctgttgtgctgtgataccagcctgttggagcagaaatctaccagcctgggctgagtctcagccatgtggagcaggctttcactgctttggaatataaacgtttagacaagaaattcaaagggatgggaatatttgttggatttcccctccactcagctgggaagtcagctctagcaaagtgattgtgagatatgtggcaccaagccgagtccctcctgactttcaggggatggatctcaagacagtggcctagggagggtgctagtctgaggctgccaagacatgacgaaccaaagatgttctcagcaggtcgttcctcagaaatgcactccctgcatctcccccagggtgctcagacatggaatattaaagtgttagaaacgattggaggggatgcagccccactcctcactttacagaagagcaatggaggcccagagggaaatgccttgtcccagctcacaggacagtttagaggtagagccccatgggaaccaggtcctgcccatgttttcccaggccacctcctcaagcacgtggaccccccagagcaagcttgtctaacctgtggccggtgggctgcatgtggcccaggacagctttgattgaggcctaacacaaatttgtaagctttcttaaaacattgagtttttttttattttttatttttgccaatttctttttagcccatcagctatcgttagtgttagcgtatttgatgtgttgcccaagacaattcttcttccaatgtggcccagggaagccaacagactggacacccatgccctagaggttaccttcttctgcattttgtagatcctgaccgccaccattgaaaacaaccgggtcatcctggagattgacaatgccaggctggctgtggacgacttcaggctcaagtgagttttttttttccccctccctctcctttcccaggagtctcttagtttagacaaaagctcatctgaccaatgacactggagcatcccaggagtgaaggtctggaagtactggagtctcgtgcaggggtagggagaatgtctcatatcatttatgtcttgctttttcaaaaaacatttcatttttttactattttaggtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggtgagcggggattgcaggctgccctgggctcaacaacctccagtgagaaggaggagccctcccctgcaactggacacagtcctccactgtgggacctggaaacactctccagaacactctgccagcactcagagccaaggagagggaggatgagtagcctcacacatcttcctttcccatccccacaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaaggtacctggccctcccaccccacatagcccatcccatatagccaggggggccgggcggacacagcctcttggtcaggctgctcgagctgagcttccccaccaccttcttcctgcttgcatttcagagtgcagagctgaacaaggaggtgtctaccaacactgccatgattcagaccagcaagacagagatcacggagctcaggcgcacgctccaaggcctggagattgagctgcagtcccagctgagcatggtatgcctgcagcctcctgcccggtggcgaccacctctaggtttccctctggcctggctccctctgtaacttcttgtctgtcgctccaccagaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagtaggtcctctccagcctctttcttaggatagtgactgcaggacccgtgggtgtcagagcaggcagggccttagagatccaccccctcatgtcagagaggagacccctcactgtctgactttacggggacatttccttggtaggctgcagggttaacacctttaaactttctaatttgggcctccaagttagactggagggaacagagaccatggagggaacatctgatattggaaaaacatgagcttggatacagctcagctgaacaaagctattactatggtgctttaactgcctttagaccctttgcagaaatcaagccacccctgtgggctcagggctcaggtggagggttgcgggtttgggcgatccagagggaagacaaacaccctgaatcttgtggctaataatatctccccttgagacctctcagacagacagacaggaaagacagacagtcccagtgggcacctgatgctgctgtcccttgagctgggggcacagctaggaggcactagagtccagcccaggggcttgaaatgataagccgaggcacttccccagaggaacaggtaagcacctgccctcagttaccctctgctcatggccacctctgtcctctctcccaggatgattggtttcccttcctcagcaggtaagggaacagccccgtggtgtagggggaggcagagttagcctcccattcactgccccaatgggggtgggagctggcggggagggagggagccagtgctgggctctccagtgtagggagggggagagctggggtggaagtggtcattcgctcactgattttccttttgaaactgatggctctgccccacagagctatttggctgtcttgggaagagccatctttggggacaataaagagtctccatccacgcaccacctgactaatgaggagtttgtgagccctccaggggggccctgccctgtcctgaggtgggtcttctccagcctgagcatgtcttgtctcttgtttcccaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacatatttttgattctggcctggtttcttaggtggcccctgctagggccctggtttagcgggtgagggggacacagctgggcggagtagctaatccagacaacgacaagcctggggagcttcctatctaggaaggacagacataggcccatgggccatctgagcacacagacacaacaacggcaaacacaggggacacaggcagctcacagacgatggtgtccagcagacatggacagacggaacacaccagagacagcgcaggggcacgtgagccagttcaacagccttgcagattaggatgttcagtgagaatggcagctgatagtagagtcaagggagcgtgaaacatgggcaaaaagtacagatgcctctggggcaggctgcaaggggccagtgaaggggtgatctggggagaaggaggcccagcccccacctgctacctccctgcttcctgcagagaggtttattctcaggcaaatggctccttgttggcctgaggcatccactcctaatgtcctccccagcccacccctaggtcttgccactcccaaccactcctgggaccagctccctggctggccgctgcactaacctggccccttctctctgtgctccccactctctccctgccgctttggctgcccctgctctgattcgcaacctcttcctgctctgctcactccttgcacgttgactcacctcctggattccggtgtgggtgttcttctctttttcctcttcactgtccctgtgggtcatccaggacataaccatggttacagttgcctgtatgttctgataacgcccaaactcgaatctccactgaggcccctcccagcctcagactcccattgccaacagtgagccagacatcacctccttcaatccacccaggcaaaagagctcccatcatcctcccagatctgctccttccttgccctttatcccggagaacctggaaagctgagccaggagcccaggagtcatcctggcctcctctgtccctcacccccttcacaatgcttcccgtggacactgcattagccataatgtccttcctggtcctaactatgggcacgtggccacagcctcctcactggcctccctgcctccatgctccacactccagcaggggtgattactggaaactgagtcttcttctcagcttagagacaccccaatcgctccctgctggtcactgaggaaagcctagacacctcgcctgcctccaggtcctggtggtgcagcttcttctggcctctccccagctctggctcctacactagcctccctcactcaccccaaattcctgccatcccaaactgcccttgaggaagcaggcaggtggctgggcaccctggggattttgttcggtgacagacctctgtctgacccaaccttcttctctcctctctctccacactcctgtcatcattttattggagactaccagttttttattcaaaattcagactgagatggatgccccctcctctgcagcacctggctggggtggggcacacttgggtgttcacatgtgtgtgcccacctgtcctagaactgacagtatcactgaagtgtcactgaagtgacagtgagaaaggcagggctgtgccttcctcaaagcgggcggggggggggtctctcatccaatagagtgcaggtgggctctgtcagtgctgatgaaaggcagaggtgaatgaacaaactggggaaatgcccctccagtgccatttgattttcgttaaggggcttaaggcagagggtagatggagttccggcaccctggccatctgcccccttcctctggcaccatcttcatattccctcccctcccctctgctgctcccctgtgtggtctcccccttccttgtcttccttctcttcccccacctcaagcctgagtatgggctgcacacagttgtcttattcacacagtggttgctcagacatgcctggcccagcttgctaaactagcagaaaggtgtctaccctccaccatt

SEQ ID NO: 14664 - DNA, 36093 bp, Human
  misc_feature (1)...(36093): n = A,T,C or G
gttgacaatgaatactcaagtgttgaatgaaggaatgtttgtagggcccttggcacaccatacagccacgagcagcattcatgtcatcaaccacagaaaggaagtgcccttgtcttcttaagctgcctgtgagaagtcctttttatttttttgagacagagtctcactctgtcacccaggctggagtgcaatggcatgatctcagctcactgcaacctctgcctcccgggttcacgccattctcctgcctcagcctcccgagtagctggcattacaggtgcccgctgccatgcccggctaatttctgtattttcagtagagatggggtttcaccatgtcggccaggctggtctcgaactcctgacctcaagtgatctgcccaccttggcctcccaaattgctgggattacaggcatgagccaccacgcctggccgagaagttctttctgatctctaccccaggctctcctatcgcagaggggtgtgctgcccggtttatttttttcttttcttttttttttttttgtttgagatggagtctcgctctgtcatgcccaggctggagtgcagtgacatggtctcggctcactgcaacctccgcctcccaggttcaagcaattctcctgcctcagtctcccaggcagctgggattatagttgcccgccaccacgctcggctaactttttgtattttttgtagagatggggcttcaccatattggccaggctggtgttgaactcccgacctcaggtgatccacccgcctttgcctcccaaaatgctgagattacaggagtgagccactgcgcctggcctgccccgtttctttcatgccagggctggatttccttcagatctgctgcttgatgtttccaagcccaccaaagcctcctgacaccaatactgtatttttgtgccaattaattgttctgtctctcctccaagtgtttgtgccttttctctgccccttccccattgccttgacattttatgtctatgctcctcttccatgaggggaacagctggtttggtggtccttcaaatgagaggaaggaggttctagcttggggtgtgccactttgtagttttgtgacttctctgaacttcggtttcttcatctttacaatgagggtcgttttctcatcctaactatttttcagagctgtcacaataattaaaaaaaaacataccgttaatttaaatttctaacctttagcagtttctgagtgctttcacaaacctgacctcatttaatccccacatactccagtgaggtagatatggctaatgtatccagtttacagaagaggagaaacagggtgaagtaacttgcctaaaatcataccaagtgggagaagaccaaacctggccttctaattctaaatcccaggagtactccatctttcgggaaaaaaatcccaccccagcacaaagcctatgaaatgctatacaaatatgtgattactactttggggcaaggatgaataagcccaaagaagcatcatgcctgacgctgagttggctggccggtgaaggcgtctgtcccttcccttggtatccctatgacttacctgttggacaggtagggggaaggggagagtaatgagtctcacctgctcagagcaagggtggggcaagacacaccccatcccttccattggttttttccttagtcttactgacagagccttgtccaatcaggaggaagtaactttctatctgccaatagatgcaatgttaggatgagacctcaagttagagtccatccctagagccgactggcagtccccggggccaatggcaagcggataaacagaggcggccgtggaagaggactggaggcgaggctccgcccctccacgggacagtcaggcgagatagccagtgagctcgcaccagagggtgggcgtctcccccaggggcggagcttcgaggtggcgaggggcgtggcttggctgtcaggtctcttcgccttttgttcggttactgagttgctgccttggccagagtccggagcagccgccgcccgaccacgccgagctcagttcgctgtccgcgccggctcccaccccggcccgaccccgacccggcccggtcaggccccatactcaggtgcgggctatcgggggcgcaggtatcgttggggacagaggggtggcgagcggccgcggggccggtcccagccgtccctgggcaggtgagggccggtgccatcgagcgccaccctgcaccggcggcagggggcgcgctggggtcctgggcgcggcgacttgggggtcgcgcggttcgggccgagcgcgcctcggagctccgcgaaccagagatctgagcaaggcggggagggatccggacaggtgcctccggggtcgcgcctcccccggggcccgcgcagctcgcccgacgccgcgtccctgactctcgccctgggctggcgggggagactttgctctgcttcgactgcgtcccagggctcacgctgcagtcaggaatttaccgtttgggaaacttgctgccgctggtctctttggggccaccctcaccccaccccacgcgtcatcctcgctttccctccctccctactcccccaggcctgggtggggccctattgtttgcgcccagcttgcccaactgtgggggccgagcgcacattttcccagcgactctggccccacctgccgagcaggtgagcgcacggagtccagaggccctgccctccagctcccagagcctcgtcgatactacctgcggcgcctccctccacgccggtgggagcccggctctggcttcttcagcggaggtgggatggagtgactggggggtgcagggctcggctcagtgtccagctggtgtctggcacccgtggctcgccctggggtctggggggtggggtctgtgcacggatgaagaattcagggtcacctggcccagtttccagtagctgtggctgccagagtgttggtaggggaacaggacccgtcttctctaacctcttattgttggaaaaaatcacccaaaacaaactttgcaggaggaagtattcacagcagctttatctgggggttttcccgtctccttgcccaaaacttcctttaggcttagggggtccttcctggtgcaaaaccccttcccccagccggcccctggctgaacctgggccggtgcctgggctccgaccctgtcttccctgcccccacattcatcctgttcgctgggccccaggggcctgaggtaggggccggggtggggggtggaaagtgctgagaggggaagcagcttcttccttctcttcctgcctcctgggaccaccacaccccctcagacaaggcctgcgtaagtggttgtctctcaagctctgccccctccccaggaatgggggtggggcagggctgggccaaactgaggaaggtggggggagtggttgttcttgtctttttttttttgcctctaccccatcccccacattacttagctggctggttattgaggcagaagcgcatgaggctgtgggacttgccttccatttgatttctgaattgtgaaggtgcatgctttctggaggcctgcacagacctttcccacccgctttcctgaaagaatttgacagggaaagtgagaccgcaggaaggctttttgggggaaggtttcttcaatgctagactctctcaggcagagctgcatcgggccccctgccttccctgctcccaatttcctgagaccgcccccccccacccagaattggggatcttgatcagggtttgtaccccggtttaaaaaaaaaatctgaaatgtggtctttttgcaggatttggagcccagcctcgttggggaacagagagagaatacaacagttgggttctctctcagtcctgggggtgggagaaagattgtggggggcggggatcgagagtgcttggaggggaagagtctaccacctctttctttgttgtagatgggggagtgaggctgggggcccagactcagcccctttatcctgggtggggatcacgctcagccctgtgctagggggaagtcagtgtgggaactcagatccttttctgccgggggatgggattctgcacctctggggagcaacaggagcagggagtttgggcaaaaataacctgctttccctcttctctgtgccaaggtggaggaggggagggcattgtaattatgttggctacatgattagtttagctaatctggtttgtggctgtgatgaaaagataatactgaggaagtactgctaggaggtgcttggtgaaaactggccactgactggactgggggatgcgggggaggaggagaaggtaggacccagttagtcatttcttgctagatcaagccccagcttgggtgacttgagccctcccacccccactccacccctcccttgcaccctggctccaccccattccctctggagcctctgtttgggctgccagggccgaggctttgagaatgcagtgcataggaacgaaaaaggtcgggctagggctgccaacctttttcccatcctggagccaccttagagtgagatgggtcaattgactagtctacagaaggactgtttatttggagagatgggacagtggggcagttctgagcacagggctttgggcttgaactgagctgggtttgagacccagctctgtctctcattacctgagcctcagtgacctctttggcaaaatgggaatactaatacctatctacccagtaagtacttgacaaacggtaactcaagatcaaggtaagactttacagaaaccaagcactttcttttttttttttttttttttttgagatggagtctcgctctgtcacccaggctcactgcaacctccgccttctgggtnnnnnnnnnnnnnnnnnnnnnnnnnnnnnnnnnnnnnnnnnnnnnnnnnnnnnnnnnnnnnnnnnnnnnncccatctgtgctcccatttccttttttataggaaacgatcatagctactgagattgaatgagtaaaactcttagaaaagtgcctgaacatagtgttatgtaaacaggttagatagtactatgattactctctgcaccccatcctaagacaaggctttgcatcagatgtcttgtgggttaatttcctccatcgcttgattaaagactcagtcacgctgggcgcgctggctcatgcctgtaatcccagcagcttgggaggctgaggtgggtgggttgcttgagtccaggagttggagaccagcctggaccacatggagaaaccctgtctctacaaaaaaatagaaaaattagccgggcgtggtggtgcatgcctgtggtcccagctactgggaatgttgaggtgggaggattacctgagcccagggaagtcaaggctgcagtgagctgtgtcactgtattccagcctgggcaacagagtgagtccctgactcaaaaaaaaaaaaaaacaaaaaaaacgcgtatcattattcgcattctacagaggaggaaattgaaactcaaggaacttaagtaatttccccaatgttgtacagcgagacccaagcagcaccaagactgacgtttgggtcctctgattccaagcccagaacccatcctgctgtattgccccatgcagctctggaaaggattttttttttttttttgagatggagtcacgctctgccacccaggctggagtgcagtggcgcgatctcggctcactgtaacgtctacctcctgggttcaagcgattctcctgtctcagcctcctgagtagctgggattacaggcatgcaccaccacactaggctaatttttgtatttttagtagagatggggtttcaccatgttggtcaggatggtctcgaactcctgaccttcaggagatccgcccgcctcagcctcccaaagtgctgggattacaggtgtgagcggaaaggatttttctgcacccccttttgagagcctctgcctgactggggagaagagaattcagaagggcccatgaaggcatgtgtgagtggtgaatgtagggcaggttttgtaggtgggggtgatacctgtcctggccaccagcccacttaaatctccccagtggcttgatttttagtttccggtggaagcggcttctccccaaggccagggctgtggtgagtgttggggggaggttgagagggaaagaggaggcaggggtcaaagctgtgctgcctcctagcttgggttaggtagaaccatggctgttctgggcttgttcatgtgtaggaagtgggagttgcctgctttgctgggggctggggctatgccaagataaaggggtgctgccctgtggggattggcgagaaacgagagtccgatttaggcctgggctaatgtcctgctggagttgacgaggcagtgctgccaggctgctcttgatggggaactggctgtcctctgctctgaagcccaagagacctgagataggcagctgctgggagggcttttctggtgatggaggtgggggtcatgtgtgctgcctgtcagccagagccttggccctctagagaggagctggtgtcagattgttctccagacctgcctggttctggtgtctctgccaactggacatctgacaccagaatgggcctggatttggggtctgggaaatgggttctctttatgtgatggtgcagccggagtactgaacctgtcactaccgcgcttctggattccctgagggcaggcggggaccccaggcaacgggattattgatcgtggagaaggctaatgggacttgagacagagaagaaaacagaatgaaccccatcccactgactactacaaagagggcatgaggttgcagtttttccatctcccccgaggacttgagagctgcaggcccgatgcacttactgaagggacgcagtctagacaggaggaggggctttctgcctgctaaagatgaaatcttgagttgagaaataagagggagaggtggagactcagcattgactcttctctgatgagggccatcctgtgcggcagggaggccagacaggaattgctgccctttggggagactcctcatttgtatcttttgggagaagagcgacctggcagtgagagggaaaggcatctgtgagctggtcctgtgacccctgtgaagaggaaaagcaagcagtgtggctgggcaggtcaccagggcttgtgttcctgcaagtgacactgagcggcctctcctgggacatggttgagtctggggacatggaatatcttattgtgaagcgacttcctctgccaggcctgaagggcaagctcatggaccactctcctttgctcagcctcctggcatcttggcctttggggccagcagagcaggaagctcagctttctttttctctttctttctttctttttttttttttgagatggagtctctcactctgtcacccagactggagtgtagtggcacaatcttggctcactgcaacctccatctcccgggttcaggtgattctcctgtctcagcctcccgcgtagctgggactacaagcgcctgccagtacgcccagctaatttttttttttttttttttttgagacggagtctcactcactctgtcgcccaggctggagtgcagtggcacgatctccgctcactgcaagctccgccccctgggttcacaccattctcctgccttagcctcccgagtagctgggactacaggcgcccgccaccacgcctggctaatttttttgtgtttttagtagagacggggtttcactgtgtttgccaggatggtctcgatctcctgacctcatgatccacccgcctcggcctcccaaagtgctgggattacaggcgtgagccactgtgcccggcctaatttttgtatttttagtagagacggggtttcaccatattggtcaggctggtcttgaactcctgacctcaggtgatccactcaccttggcctcccgacatgctgggattataagcgtgagccaccgcttttggcactcagctttctttcctcctcccttctcctcttctcttttctttctttttttttttggtttgttttttgagatggagtcctgctctgtcgcccaggctggagtgcagtagtgcagtcttggctcactgcaacctctgcctcctaggttcaagcaattctcctgcctcatcctcctaagtagctgggactacaggcatgcgccaccatgcccagctaatttttgtatttttagtagagatgggggtgtcactatgttggccaggctggtcttgaattcctgacctcaagtgatccacccacctcagcctcccaaagtgctgggattacaggcgtgagccactgcgcccggccttctttcctttttttgaggtagggactcgctctgtcccttaggctagagtgcagtggcgtgatcacagctcactgcatccttgaattcctgggctcaagcaatcctcccgcccagcctcccaagtagctgggtccacaggtgtgcaccaccatgcccagctaatttttaaagttttgtgtagagacagggtcttgctatgttgcccaggctggtcttggactcctgagctcaagcatttgtcccatctcagcctcccaaagtgctgggattatgggcatgagccaccatgcccagctgaagctcagctttctgtgtctttccctaccatggagacagtagcagggaccagagcagagttgggacaggggcttggcaatcaataagctgcttatttaggggagactcctcctcttccttgattgagaaggtaatatctggctggggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactgggggccagccgcggtggctcacgcctgtaatcccagcactttgggaggccgaggcgggcgcatcacgaggtcaggagatcgagaccatcctggctaacatggtgaaaccccgtctctactaaaaaatacaaagaattagctgggcgttgtggcaggcccctgtagttccagctactgtggaggctgaggcaggagaatggcgtgaacccgggaggcggagcttgcagtgagccaagattgtgccactgcactccagcctgggtgacatctgtctcaaaaaaaaaaaaaaaaaaaattgggaagtttagaaaagtttaagagaaaagaaaaaaaatcgcccataatcctaaaaagcaactttcattaaggtctcttcctctttttttttttttgagacggagttttgctcttgttgcccaggctggagtacagtggcacaatctcagctcactgcaacctctgccttctggtttcaagcgattctcctgcctcagcctcctgagtagctgggattacaggcacctgccaccatgcctggctagttttttgtatttttagtagagacggggtttcaccatgttggccaggctggtttcaaactccagaccttgtgatccacccgcctcggcctcccaaagtcctgggattacaggcatgagccaccacgcccagccaagtctcttcctcttttcttagcatcctttttttctttttttttgagacggagtctcgctctgtcacccaggctggagtgcagtggcaggatctcggctcactgcaagctccgcctcctgggttcatgccattctcctgcctcagcctcccgagtagctgggactacaggcacccgctaacacgcccggctaattttttatatttttagtagagatggggtttcaccgtattagccagtatggtctcgatctcctgacctcgtgatccgcccgcctcggcctcccaaagtgctgggattacaggcatgagccaccgcgctcggcaacatccttttgttctttagccttgatcttgatgagctcatcccctgtatatagtaacattttttttttttttgagatggggtctcactgtgttgcccaggctggagtgcagatctcagctcactgcaacctcctcttcctgggctcaagcgatcctcctacctcagcctcccaagtagctgggactacaggcacatgccaccacgcccggctaatttttgcatttttttgtagagacagggtttcgccatgttgcccagactggtctggagctcctgagctcaaggggattcacctgccttggcctcctaaagtgctgggattacaggggtgagccactgcaccctgcctacagtaacagattttagccaaaactttattccaatcctggttttccagcatgtgttgtacaataaacagatggatcttcccaggagagggttatatgtagggatccttgcagaatcacaccccagggagtgggcctcagtcagctgggatcggagctgctgttattgagaagtgggccgcccctggaccccaggctgcccaagccccactggtggtggttggaggcagtggaatgagagtacttgtgtattttgcgtcaccaacacacgtcaaccttttgttgttgtttcctggtgtggggtgaagtgtttttccattcccaggagtcccggtttggggtcatctgccagtttgggaatctgcccacgggggtcaccagcagggaacggagctccagctggagccctctccaggggagcatagaggtccctgggtcgagccacttggccgtggcaaattccctctcctacaaatccccttcattttcctacccgggtttgtttgctttgggaaggagcccagaaggaggaaaataaacagcagctgggtcggcaggcctgagcctcccccaggccccagctcatcctcaggccacagcctgggctgctctccagactggaagtgagggttttcctccggaagcctaagaccagcttgtctgacagctcctgcttcagttctgccctcttggaatggaccagcttgctgatggagaccacagtgtctgccagagaacctgtagtctgcaggaggttccgtcctggagctgccagccagaggggagaggcctccttgggcagccccagcctgagagggaaacaggccctcaagggaagccatcatgtccatctctctggactttctagagtctgtgtctgtgcttggaactgctggccagacctcagcaggagccagggacagagtggggaaggtgggggctggagatcctgctgagcccagcttccccctgggactgctatgtggggaatgttcacgcctggctgtgcagctgcccctggctgcaggaagcagcatggactgggcatagggcagccagtgtctccacctggcgtgagcgaagttccactccccttctcctcagccatgttcccttgacctccccagggcctgggaggcagctccctacctagtccccatctcaggggtcagagaaagcagccagggctcccccagacagactgccatccaccttgcccgacaggtctctgtgccagccctcgcctttttaaatttttattatttttctttttttttgagacagagtctcgcactgtatccctggctggaatgcaattggtgcgatctcggctcactgcaacctccgcctcccaggttcaagtgattcgcctgcctcagcctcccgagtagctgggattacaggtgcccaccaccacgcctggctaattttttgtatttttagtagagatggggtttcactatgttggccaggctggtctcaaactcctgaccttgtgatccacccaccttggcctcccaatatgctgggattacaggcgtgagccaccgcgcctggccccctcacctttttgttttgagacacggtctcgctctgttgcctaggctggagtggcatgatcctggctcactgcagcctcaatcacctgggctcaagtgatgcttcagcttccagagtagctgggactgcaggtgcatgccaccatgcccggctaatttctttttattttttgtagagacagggtcttactatgttgcccaggctggtttcgaactcctgggctcaaacgaccctcccacctccgccttccaaaatgctgggattataggcacgagccactgcgccagctggcttccgcctcctctgccatctctttgttcttctagcatgagaatgcatgcctttcctgtggacagagggcttccagagtcacagtgacaaaagaagtcacttgatcatctccattttacagatgagaaaatgaggcttaaggaaattgagcccctctcctcactcagaatcctgtgctcaccctgtcgctgtctgagcctggggacctgtgtctgcacagggtgctggcctctagcctaaggaacctctgggggacccagccctgccctgctccgccctgctcctctgttcccaaatgcaatgcttctgagtctgcttccagcacggcctctggggtaacccactcctgtccttatttccaggtgtcttggcacttggtgccctgcaacccagcctagatgtgcccattgctgactgtccttggcaggtgccggctggggaaggagcctggtgtagctctggtggggctatttttaatgtcagggctgggccacactctgccaggtcagtcttggatttagggtgcccggtgccagccctctgggttggctgcgcagaggaggaggcaggaaagaagggtaggggtgcacccagtctagccttattacttgctcacacttacctggtgtgggtcccatggggaagggtcctctgcaccccctctccagggcccgtcttccttcttcctgtccttgggctgtccctacagtctctgatctggcttcttcctcccgtgctgctaacaatagagcacgctctaaacaaaggccccccattcaactcagaaacccgccctgtctctgtccctgcccgtctctggctgggatgagtgggcagggcctgcgtctgtctctctcgcttccaccctggctctgtccaggggcattgcaggaggtctgactccaggtccagggtggagagggacaagactgaactgggtgtggccccctccaccctgggaactgtaaaaccagcacttttgtttcttgtgagagaagttcctttgttctcctgggcagtaggtaaggagaagggtggggctggttgacagtcctgcctgaggtctgacttccagccttcctgttgcaggaatagctcccgtgaccccttcctcaggaggagttctggagtgtgtcctctctctgaactggttcccaactctgacgttgcccacccccagccttcttctgtctgttgtgggaatcctgtttttttatttctagaatcttagacatcaacattcctttgagatccagggacacaaggacacccagcaagtttgtggcagagctgggactagaacctgggactctttttttttttttttgagacagggtcttgctctgttgtcagccaggctgaagtgcagtggcgcagtctcggctcactgcaacatgcacctccctggtttaagcaattctcccgccccagcctccccgagtagctgggattacaggtgcacaccaccatgcctggctaatttttgtacttttttagtagagacaggatttcaccatgttgaccaggatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttctcagtgtgcaggcacagcttcttcacctagaaattgggaataaagccaggcacagtggcccaagcctataatcccagcactttgggaggctgaggtgggcggatcacctgaggtcaggagttcaagaccagcctggccaacatggggaaacccggtctttactaaaaatacaaaaattagccaggcgtggtggtgcacacctgtagtcccagctacttcagaggttgaggcaggagaatcactggaacccaggaggtggaggttgcagtgagccaagatcatgccactgcactccaacttgggcgacagagagagattctgtctcaaaaaaaagaaagaaagaaagaaattggaaattataaaacatctgccagggttgctttgagggaagaatgagattcacataataataaaggccactgggcgtccacccccccacccccccatggcatcctgtggcttctgtctctccctgggtagctgtctagccctcagcagtctcctggcggttgacctgggctggtgggggtggtgaggggcctgctgaggaagttcctcagcttgactgtggtggtccctttagatgtgaggccggcaaggggtgacccttgtttggagtgaggcccgcttccctctcccttagctgagaagccccagggttaggcactgtctatgcaggagggccctctggctgggatgcagtgtgtttgttgaccagagctgcagatgtccagcagtgtccagatgtcgttcagccttgagcccagcagagcggcattcagtgggttattgctaccgtgtttacttgtacacttgcaccttccttctctcctgggggcagcttctcttccaaactctcctctgctctctcttgggacttgcccttggggcagggaaatggttggggaaggcggcacagcacgaggagctcaggattttagtagggttttcccatgtctgccttctccgagcaccccgccccccgccccccaccattgcccctgtttcctgccagtggccattcccctctgttgctggggaaggggtgtggggaaggggtgcgtgtggaaagggggctggttgggggggctccttctgaaatagctacactttcgaatgcctgggaagcagctgtgcacatctggcggcccgagcctgtcgtctggggtctgccgtctgaggtggcgggactgcttctgtttaatcagcctgaaactctgagtcactagggattgcgggaggagaggaaggaggcagctgggagctggcctggcccctgcctctgcctgttccgggtgtgctcacggctgcctgccataaaaggctgggagacctgcaggaccattcgtcatcctcctggagggccagggcggcactggggcagtcacagggaagacttatccttggtgatctttgttcctggggtggggccaggttgccccagccaccccaccctcacctggtccccatcacagtgagacaacccgggtgctgcctggcttcatgggtggaccagcctgagttctgcttactcactgaggctgcgccgggatgtgcaaagactacagaccttggtgccctcacacctggtcccagtcccagctctgccatttctaacctcagtttctgcatctgtacgcgggggaccagtgcatgggctttgaaacccgcccatgagcatgacggtgtctgtgaaaggtctggctcgtagtaggccctcatgggatcacggcgtccattctccccgcagcctctgacctctgcaggtcagttcccaggacagtggagccaaacacagaccaagcgggaagttcacctccctggtacaaagttcggccctgctactcattaaccttcaggtgcgcctaaacctttgcagagagagagaggggttcctgacggcagtgaccacccacaggcctgccccaccccagatccctagcctgggctcgaggagaccaggaggtgaggaagcacttctggaggagaggcagtgctgatgataatggccgtggcctctgagcacctgctatgcaccaggtcctcgcaaccacctctgagggaggtggcgtgaccccgctttacagatgaggacactgaggttctgtggggagaggaactgccccagtagtgagtagctgagatttgaattgctctgtgggactcaaagaggcgtctagggactgggagggctgggagagagggggccttagggtctggacctcagggccatgtgtgatcctgcccaacctgtaggaaagccagatcctggagtctctgagggagcctggggcgctccagagaaacctgtcagaccgcttccctgccccgcccagtttcctgcccaatggcttgggtgcctcctccctgcagcctttcccagggagccccagtagttgagggtgggcccaggggacctcagaagctgctagaagccctgagtgccttctcttgcccctgggagagttgggtcagggcagcaaggtgcgtgagcaggggcttctggcggcagctggcccttgactgtcctgccccctggggctcatccccctgggaggtcagagatgcaagcccaggacatacacacagccgcacccctggggctcactgctcccagggtatctcgtcgtgggcagcccctccctgggcctggtgcccttctgggcagtccccccatccccagcctgcatcctcattgaaatccctgggccatggtgatgatgtgggaagacaggcggggcttggtgacgggctgaagctgggggctgggccaggtgacttcctgcttcctgacttcctcctttgtgcccccagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtcaggacccctggggactattgcatggggcagaaaacctgcctgggtcctggagagaggtcagagtgaaaggaggcagattgtagggggtctctggtctgagggaggaggcacagctcatgctaactaggggcccacccagtctgaaggaggaggtgcagctacttcagggtgctgcatctgggagggtcacagaatcctcttctgtgaaccatcagtagggagggaaggcatagtccctgcccttagggtgcctccagtctgaaggaaaagccatagtccttgccttctgtgaacataagaatctgatgaagacattgggtacggtggctcatgcctgtaatcccagcactttgggaggctgaggtgggcagatcacctgaggtcaggagtttgagaccagcctggccaacatgatgaaaccccgtctctactaaaaatacaaaaattagccgggtgtggtggcgcatgcacctgtagtcccagctacttgggaggctgaggcaggagaattgcttgaacccaggaggcagaggttggagtgagctgagattgcgccactgcactccagcctgggcgacagagtgagactccgtctcaaaaaatagtaaaaaaaagagtctgatgaggatgtatcactatggctctcagggagcccatggatggcagggaggacgcagccctttggctgcaggagcctcacgtttgtgggagagccagggccgtagcccccaggaacccccagggattcccctttgggtagaggggtgtaggtgtcaagcctgagggcccctcgttggggttggagggagaccaggcctctgcggctgacctgcagataggccaaggctgtgggatgagtgactgactcagctctggggcttagtccgggatggggatgccccgccagcccaagcctcccctgcccctctgggagagaggaatagccaggccctagaactgttggccacaggtgcctccagggccctgaacatgccagggggtgggctgtgggtgctgggagtagtgtgagtagactgtggctggtggggctctatggagctcagccctcgcatgccagtctcctccctgacagctggtaggggtagcagggggccttttggctggcagggccaggcactgtgttggtagcaaaaagtacagcatccaggtgggaaagccatgcagctgtctcctccttctcgactaattagagggtggaacctctgcgtccctctccctgggggcatcaggacagttgccagggtgtggctgcttgggcacctacctgtgggactcccagacccacccaggggatggaagctagagaggaacctgacgtctcagctgaggacccagctcctgctctctgaacccacagccctgactttccctctgatctgctgtgagatgtgatgttggtggttctctgggcctctgtttgcctgcctgtatagtgggaggattgctaccgttggggatgatgagggtgtaattagactcctgagatttcagggttgaaaacagacctgatgggtaagggaggagaatagagtaggggtttgggcccctgagtcaggctgccttataacccctctgtgcccagttttcccatctgtaaagtggagccagtgatagtacttaccttgcagggtcgttgtcaggttatgtgagaaaatataagcagggcattgaattcactgccaggcacataataagtgtgcaaaaaaaaaaaaaaaattcccgtgatggacagaacatgtggggcctattttacagagattactgaggtgatggtgacttccccaaggttcctggtgagaggtagaatggccagtcatgtgctgggggtttgggcagggcaagaggtagcccagaggacccaggtggggctgtctgtggcctgccctgctccccagtgtctgcccagcccactgcctgcactcagtccctgtccccatggcccccaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtctgtgagggtccctgctagggtgggggctgggcagggaggggagagagcagatgtcctcaggggagggacattgtaggggtggagggaggttatgacccagactctcccgtgtgtgatgagtctgactggggccctcctcagctctgtggaagggtatcccggcctctccttagtgctcacgtccccgcccctgcctttgccctccaggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcaggtacccaaccctgctcactgcatgagcccaggaccccctctcacttgggcctctcccctcccttccctgagcttccataaatatccagtgagcacctactatgtgccaggcagaagcacaccccatccgggtgctcggtggctcacagcccagcagggaacacaggcatgtaaacagcaggttaatgatcaggatacgacacaggctatggcagaagagcattgagattgctcaaaggtggaatcgcttaatggcaggggattgacagatgagtggagtttggctagtgtagaggaagggaagagtgtcccaggcagagggaacagcaaatgcaaagtcccttgcaaactttctgtttcctggccccctacaaaatgtggattggcctcatttctttttttttttttgagatgaggccttgctctgtcacccaagctggagtgcagtggcgtgatctcagctcactgcagcctccacctcctgggttcgaatgattctcctgcctcagtctcctgagtagctgggattacaagcatctgccaccatacctagctatttttttttttgttttgagatggagttttcctcctgttgcccaggctggagtgcaatggcacagtctcggcttactgcaacctctgcctcccgggttcaagagattctcctgcctcagcctcccaagtagcagggattacaggcacccacgaccatgcctggctaatttttgtatttttagtaaaaatggggtttcaccatgttggccaggctagtcttgaactcctgacctcaggtgatctgccccccttggcctcccaaagtgctgggattataggcgtctgccaccatgcccagctcaattttgtatttttagtagagacggggtttcaccacgttggccaggctggtttcgaactcctaacctcagggtgatccacctgcctcagcctccccaagcgctgagtttacagacgtgagccactgctcctggccttatttctcatccccataccaggctggaagctccctgaaggggagacactgatttcactcccctctgaacgccttgcaaggcctctctaatatgtggccttccacatggtggttacttagtagggatcagtgtctaggggacctactgtgcgctcagcacagggctggggactcagaagcaggaggagtcattgtcccagttgggagaagagaggtgctgtttgcttcatgcttaagagcagggcaggctcaaggagtgatgagattttagcgaagggatatttccagaggggcgtcagtagcggggaggcttcctgggggaggtgggaacccatgccaggctcacatgtatgccaggcctctgggacctcagcgtactaacccctgcccacccccccagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaaggtgggccctccccaaccctcccgaggcctgaagcccacccttgcgccatcttctatcctgcacagccttgggccgctgcccccttactccttttagatgagatataggtgcagatatacatgcttcatcatgcgactgaattgcccagaattattattttgaggataagggaaaaaaaaaatcactcatcctcatatagccactattgtcatttcgatgtgcttccttaagagctgttctgtgggcagattacagatgtgtacacatccttgtcatcataacaatctgcaatattgcatctgttttctgcctgattttttttttttttttttgagacagggtctcactctgtcacacaggctagagtgcagtggtgtaatcagggctcactgcagccttgacttcctgggctcagatgatcctcctacctcagcctccagagtagctgggacttcaggcgtgtgctaccacgcccgactaattttttttttccttttcttttctttctttttttttttttgtttgagatggagtctcactttgtcacccaggcaggagtgcaatggcacgatctcggctcactgcaaccttcgcctcccgggttcaagcgattctcctgcttcagcctcccaagtagctaggattacaggtgcccgccaccacacccagctaatttttgtatttttagtagagacaaggtttcaccacattggccaggctggtctcgaactcctgaccttaggttgtccatctgcctcggcctcataaaatgctgggattacaggcatgagacaccgtgccccacccccaactaattttttatagagatgggatttctccatgttgcccaggctggtctcaaactcctgggctcaagtgatctgcctgccttggcctcccaaagtatcaggattacaggtgtgagccactgtgcctggcctgtatgatgtttaaaaaaaatttttttttgctatattgtcctcaaaaccaccctctaataatgacagattgcctttcctttcccttttccccctcccctttcctttttccttttccttttccttttcctttccctctcttcctctctttcttctttccttcccattctttccttttctttcttttttgagacagggtctcactgtgttacccaggctagagtgcagtggcatgatcctagctcactgcatcctcaaactcctgagctcaagcattcgtcccatcttagtcttcctgatagctaggactatgagaacatactactgagctaattagcacccgggctaagttttaaattttttgtggggatggtgtcttgctctgttgcccaggctaccctcaaggaatcctcctgcttcagcctccgaaatgctgggattaaagtcatgggccaccatacccagcctacagatagcatttcattaagtggagacctcaggctttattctgagggagggtatttagattgctcctattccacctttataaacaatgctgtaatgaatgtctagcctttgtcaaagagcggaaaaaattctcatcaatttttaacacttctaggcttttccccaaatggccagattgatttccagaaggattggactaatttccagtgccataactggtaatgggtgtgcatatagttttgtcatgtccttgtcagcactgggtattatccttttttcaaaattttggcttacataacagtcatgaaactattggggtgggctgggtgtggtggttcacgcctgtaatcccagcactttgggaggcagaggcgggtgaattgcctgaggtcaggagtttgaaaccagcctggccaacatagtgaaaccctgtctctaccaaaaactacagaaattagccgggcgtgatggcacacgcctgtaatcccagctacttgggaggctgaggcatgagaattgcttgaacccgggaggcggaggttgtagtgacctgagatcgtgccactgcactccagcctgggtgacagagcgagactctatctcaaaaaaaaaaacaaaaaaacttattggggtgcttggctgggtgtggtggctcacatctgtaatcccagcactttgggaggctgaggtgtgaggatcacttgaggccaggagttctagaccagcctgggcagcatagtgagacccccatctttataaaaagaaaaaaatacattaaaagaaaaaaacgaactattcgtgctttagctgaagctcagtaatgacagttctgtctcctgtcccgcgcttccttgttcctgtcatattccccgtccatctcacactcattccctctttacccatagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgagtatgatggccttgagggcggctggggtgggagctctgcccagctgccaggctcagtcagccatgctccccgtggctgatggcacccctatccctgccccaggtgggatgcaggccctgggcaagcacctgaccagcaacagcccccgcctggtgcagaactgcctgtggaccctgcgcaacctctcagatgtggccaccaagcaggtgagggaggtatctgggcctggggttgacctcttcagctgccccatccagcctcctgtctgggcatctgacctgaggtactgtgggaggactgggggctctaaatctctcttccttgtgactgaggctggaaatgccttgaaaaccctcatctctttttttttttttttttttttttttcctgacggagtctcactctgtcacctaggctggagtgcagtggtgcaatctcggctcactgcaagctccgcctcctgggctcaagtgattctcctgcctcagcctcccgagtagttgggactacaggcacctgccatcatgtctggctaatttttgtatttttattggagacagggtttcaccatgttgggcaggctggtcttgaactcctgacctcaggtgatccacccgccttggcctcccaaagtgctgggattacaggcgtgagccaccacatccagcaaaagaacagttttgacctgggccctgggctggagcaatagtgtaccaagagacaggcccccatgactaaaaatacaatttaaggaaaaatgcagctccagggcaagtgccctgtgcctccttccaacaaccattccccaggcctcccctagcaatatgctgtttatcaagtgctcaccctgtgctggccctctgcgtggcatttgtggacagtagctcattcaacctggggttagagtgtgggaccccgtgggttagatgaagacactgaggctcggggagctaatggccatggtcacaggtagtaaatggcagaactgggatttgaacccaggactgtccgtccccaaagctggggtttttctgttccaccacaaggcccacgtgtctccctgggagaagtgagatagacgtctgaggtagtgattttactggaaatggatttggctcagggccccagggtggtggggcagcagtgaaggcccagaaaggtgacaagcgagtagacatggctcagctgggccactgaatcatgcggccccctcaacaattgcctcctggtctcgaggcctcccttggccaccgtactttggcctgaggagggttctgcctgggtctgagggccccagggaaaggctgatgagttggagggaagagatgtggggcttagagccaagcctgggttcagatccagccactagctgtgtgtctgtgggcaagttccccaacctctctgagcctcattgcctcacttgcaccacaggatagtaacgccctctcacagggtgtggcgggtcatagggatgaaagttcccgggcacacacaggcagggctgacccctttaggtcatcccactccccttggacatattcgagaaggctccctggagttggctgctccctgactcccccgtcccttccttgccctccaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggtactgctgttaggcgaggggaaggagctccctgcagcaggcttaggtgctgtattggtataggcaaagccgctgtagcaaagaagccctaaatacagtggctcgaataagacagaagtttatttctctctcgtgtaatagtttagacctcaacaatggctctgctctaaaattccagaattgggatttctatcttgtagctctaccagcccctagggcagagctcagagttcaaaatgcacatgagtaccctgggtggtttcattaaattgcaggttccagggccaggcacggtggctcatgcctgtaatcccaacactttgggaggcaaaggtaggaggattgcttgaggccaggaatttgagaccagtctggacaacatagcaagacctgtctcgacaacaataacaacaacagaaattagccaggtgtggtggtgcacgcctgtagtcccagctactggggaggggaggctcaggttggaggatcgcttgagcacaggagttggaggttacagtgagctatgattgcatcagtgcactccagcctgggtgacagagcaagaacccgtgtcttaaaagaaaagaaaaacaggaggctgggtgcagtggctcacatctgtagttccagcactttgggaggtgcaggcagaggcggaagcggaaggatcacttgaggccaggagtttgagaccatcatgggtaacatagtgagacacccatctcttacaaaaaatttggaaaaaaaaaaaagcccaaacaaataaacaatctaaaacacacacacacacacacacacacactcactctctctctctctctctctctctctctctctctctctctctgtctctctgcaggcctgctgcagagggcttgccattctgtatgtcttttttttgttgttttgagacaatgtctattgcccaggctggagtgcagtggtacattcttggctcactgcaacctctgcttcccgggttcaagtgattctcctgccttggcctcctgagtagttgggattacaggtgcacgccaccatgtctggataatttttgtatttttagtagagatgggattttgccatgttgctcagactgatcttgaactcctgaactcaagtgatccaccagcctcagcctcccaaagtacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagcaattctcctgcattttttagtagagacgggatttctctatgttggttaggctggtcttgaactcctgacttctggtgatccacccactttggccttccaaagtgctaggattacaggcgtgagccactgcacctggcccaattctgtatttttaacaagctcacaggtgctgctccatggagcacatttcttatgccactgggtgtagacgagagggttgtcctcacacgaatgagtggactgtatcatccccacggatgtgttctagccctgagaactggggatggctagcggccaccagaaagtggcacacatcactcctgctcacaccccagaacttggtcattcagccacatcaaggtgcaaggaggttaggaagtgtgatcaccagccagatggccgtgtgtcctgctgaaaatcaggagagccactacagagacacagggcacagaggattctggggacgcttagcatctcccgtagggagttgggtgtgtgaaggagtggggtcttcttcttgaggctacctgggtggaagagagctagctgtgtgtcacttccctgtcaggtgggggaagtgagagtgggtcagggggtgggcagacccaagggacagagttatgggggaaagcgtttgtgtgtgtgtatatctatatgtagagacaaggaaggcagccaaaggcaaggtggcatctggtgccagagagtgaggaagctaccatcgatgagggtcttgtcaacgggcacaggagccagctggcaggggcatccgccagctacatttaagacaatttaatagtacagacaggccaggcgcagtggctcacgcctgtaatcccagcactttgggaggacggggcgggaggattacctgaagttaggagttcgagaccagcctggccaacatagtaagtccccgcctccacaaaaaatacaaaaattagctggccatggtggcatgtgcctgtaatctcagctactcggaaggctgaggcagaagaattacttgaacccggaaggcagaggttgcagtgagctgagatcgctcattgcactccagcctgggtgacagagagagactccgtcttggaaaacaaaaacaaaaaacatggccaggcgtggtggctcacgcctgtaatcctagcactttgggaggccgaggcgtgtggatcacgaggtcaggagatcgagaccatcctggctaacacggtgaaaccccatctctactaaaaaaatacaaagaaattagccaggcgtggtggcgggcgcctgtggtcccagctactcaggaggctgaggcaggagaatggtgtgaacccgggaggcggagcttgcagtgagctgagatcgcgccactgcactccagcctgggcgacagagcgagactccgtctcaaaaaaaacaaacaaaaaaacaaacaaacaaaaaaaacccagtgcagataagaatgactctaagtgattctacacattgaattattattttttattattattattatttttgagacagattcttgctctgttgccccaggctggagtgcagtggcatgatctcagctcactgcaacctccgcctcccaggttcaagcaattcccggctaatttctgtatttttagtagagacgtggtttcaccatgttggccaggctggtctcgaactcctgacctaaagtgatctgcctgccttggcctcccaaagtgctaggattacaggcgtgagccactgcgcccggcctatacattgaattaaaaaaagaaaattcatgtttagaaaaaaaaatgtcattgtgacccctccttgatgcttggtccctgctgcaaacctgaggtgggactttgcatcctaacccagcagctaagtggcaagtgactttggcaagtcatttgccctgtgctcacgtccccatctcacatgattttcatcccctgtcctcctggcgtcttgttttgaggatgaaatagatgacaccttgagaggctctgggaggccagagtggctcctctgagtcaaagaccctggggaggagatctcaggacacctctttccagagctgccctgctggggattaatgacaatgtgagcaccacccaagcaggaggcttcgggggcacctagagcacagaattcctgagaatcaggcttggaggactatcacaaaagcaagcaaggtcatggtgtctgtggggggtggttaagaaagaggggacagggtgaggggccaggcatggggctggcaggatgttctggaatggggtgtcattttagcaagggctattagaattagccatgagcagccggacgtggtagcccacacctgtaatcccagcactttagaaggcagaagcaggcggatcacctgaggtcaggagttcgaggccagcctgcccaacatggcgaaaccctgtctctactaaaaatacaaaaaattagctgggcatggtggcaggcacctgtaatcgcagctactcaggaggctgaggcaggagaatcgcttgaacccaggaggtggaggttgcagtgaggtgagattgcaccactgcactccagcctgggtgacaagagcgaaactctgtctcaaaaaaaaaaaaaaaaaaagaattagccatgagcactcccagatcctgtggattaagtgacatggctgggatggtctccttctctggatattttccagtatgtctgtgtctggcctcggggacagaagaggtgaaggagggaagggatacttgaagctgggaagctgggatccttcagatgtccaagaagtgcccctgatcactgcccctttttttgccaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggtatgtgagctggtggtgcctctgacagccttcctggggggtcagggtgtcctctgtgggtgtgtgtgtgaatggggaggtcagttgcaactgatgccaattccaagaacctgtgaagttcattcggctgtcatggggaggagttgtggccatgtccaaggcacctgtcccatgccccctgcctcctctcacacaggatggtgtgaggatggaggagattgtggagggctgcaccggagcactgcacatcctcgcccgggaccccatgaaccgcatggagatcttccggctcaacaccattcccctgtttgtgcaggtgagtctggggcaggtgggcaggagaggtccccccaccactgcttaaagggcaaggttaggagtcccagatttgggaggcctggaccaggtatcaagaggtctttggaggagtttggaggaaagttgccactccagattgactacttagcaaccccctgcatgggcatggctttctaagcttcaaagcaaggaaagagatcacaaatggaaaaaaaaaacaaaaaacaaaaaaacttgagattcaaccatataaacatgaaaaccatctgtatttcagaaagaacctaaaaaagcatttttaaaaaatcagcaaactgggagaatatgtgcaagtaccataacagacaagaagagtctaacatctttcacatcagtgagctcattaacactagattccaatggttagatgaggcagagtcacaggtaatttcaaggtagctcatgaacaatgctcagcccagtttaaagcagtaacacttactccccagtgacggcccattttccactatggaattgctacagggtggaggtgggcagtgctgtggggtgtgttgtccggcctgcctcacccctttccaactctcccctgcttcccacgtcccctctccccagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactggtgagctgggggagggcaggaggctgggtcccactcccccagccacgatggaggctggccgacgtttaacctggcttttcctttcctctctgctcagccacctacgctgctgccgtcctgttccgcatctccgaggacaagaacccagactaccggaagcgcgtgtccgtggagctcaccaactccctcttcaagcatgacccggctgcctgggaggctgtgagtatcctaggttggaccgcagtagttggttgtgcaagttgggcactgcccatgggcaacacttttgggggtctcctactactgtcaacttcatagatttttattttgtaattggatcatttataacaattcctagcagatggaagtagtgggttgaatcatatatccacaaaatgccaatttttattttgcccaaatgagtatacagtgtttgaggtgggggtgcctttttgtaatttgcgtggaggtgctggataggctatgggcggtcttttccagggtggggcagtgccctgtacccattcttgagtcctctgcctcctcccctgagctgctctagtccggcaggagtccctgcttcatgagtggggaaccctcctccctggggagtaccgaggacatgagtacatcagggcactgggtgaccccatttcatcatcctctattcctccaaggcctctttgcttttctccagccccctcttttatttatttatttatttttatattttttgagatggagtcttgctctgtcgccaggctggagtgcagtggtgtgatcttggctcactgcaacctccgcctcccggtttcaagcaattctcctgcctcagccttctgagtaactgggactacaggtgcacgctaccacacccggctaatttttctatttttagtagagacgcggtttcgccatgttggccaggatgatctcgattgtctcctgaccttgtgatccgcccgccttggcctcccaaagtgctgggattacaggcgtgagccagtgcgcccagcctattttttatttttttcgagacagagtctcactcctgtcgcccaggctggagtgcaatggtgtaatctcggctcactgcatcctctgcctccccattcaagcaattctcctgcctcagcctcccgagtagctgggattacaggcctgcaccaccacgcccagctaattttttttgtatttttagtagagacagggtttcaccatgttggccaggctggtctggaactcctgacctcaagtgatccgcctgctgtctcccagagtgctgggattacaggcgtgagccacggcacccagcctggccccctcttttagaagcatctctccctgcccaccagctgagatccagctcggagcctgcattttcaaacctcccctccatgtttctctctcctttttcaggcccagagcatgattcccatcaatgagccctatggagatggtaagtgtgtgccgggctcttcaggaccctggagatcctgggcggctgtgtgggtgtgtgtgaggggacaatattatgtctccggggccagaggaccagtggcaactgctgtgtggcatccacatgtaccccagtctagatgccctggtgtggggtctggggagggggtcaggcccaccaggggtgggcatgggtagaggaggcagctgaaggctgtgcagactgctccctgcagggtagcttgcagaccctaggaccgagccccactttttgtccccagacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtacggccccctctttgcaggcttttcctcctctctagaacctccttctgttggaggccctcccatctccccgctgaaacctgcgctccttttttggggggatcctttgctgctgagcttccccaagcacggtgtgccctggcctgccttcttcttgtgtctttggtggggatggggaggcctattcctgctggccccttctgggggtggtgggcaggtgacacggagtggcttgagcttctggggatgcaggtccaccgagcccctgacccctgtctgtccccgctcccctaacaggtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacagatgcgttggaggctgtttaggggagtggggtgggaaagttgaggggcttccctagcggcctggcgccctctttgctgggtcctgctggtcctcagggctgccttgcatgtgggaaggactagaagaggcaagctggggagccaggagtgttgggggagccggagtggatttaacccaacatgcgcttgtagggcgaggacgggggaggaggtgaatggggatgagtccctcacttcgggaggccaggccttgtttctctctcaaacaggcaagctcctggctggctctcctcccgtccagccttaaagtgaatatggcagatgtccccgtgcttaatgctccccgaggcttatggctttgggtccaggccccttgttggtcagctgtgggcccaccccagctcctgcccacctcccctcttccttccccccaccacctactctgcccttagccgtgcctgtgacagccagcagcctcctcctgttctttgtccatgctgttcccactgtctgggtgcctccactgttcacctgccgggatcggctcagacctgactccagaaacacctgctccacgacctccgcccccagcagggatgagcgggtgcccctcctgctgtgctccacaatgccccgtgcacaactgtcatttcacccatcacgttggtctgtcctttagctcatgtgacagttcccccacccacaaccccaaattctcctttctgaggaggtgctggttacaatgcacccggcaaacctgagaacctgtggtgcctatgtgcctgcccagggcccagtgccttctttctactccacctggagctcagggcagtggagggaggccatggcttcattcacagaggattggtgggatgtggggctggggctggagacagggaggtgcttccaattaagggctggctgtaaggtccagacactaggtgatgagacacagagctgagctctgccgactagagccggggcagcagggaggggacagagttttcagagctctggaagatctaaaaatcttttaacaacgcccaccccgcagcgttttttttttttttttttttttttttttggagaggagtttcactcttatctcccaggctggagtacaatggcacgatcgcggcccactacaacctccaccttttgggttcaagtgattctcctgcctcaggctccccaatagttgggactacaggcgtgcatcaccacacctgactaattatttatttatttatttatttattatttattttttagacagagtcttgctctgtcgcccactctggagtgcagtggcacgatctcggctcactgcaacctccgcctcccaggttcacgccattctcctgcctcagcctcccgagtagctgggactacagggtttcaccgtgttagccaggatggtctcgatctcctgacctcgtgacccacccacctcggcctcccgaagtgctattataggtgtgagccattgtgcctggccggctaatttttgtgtttttagtagagatggggtttacccatgttggccaggctggtctcgaactcctgacctcaggttctctgcccacctcagcctctcaaagtactgggattacaggcgtgcgccaccgtccccagccaacaatgccctttatatgtgctctgtgttcaggaccctggcaggaaacactcgaattgggtgatttgaggagattgtggtaaggggacagtttacaaagctgtgggcatgtataggaaagcgcaagggataggacagggtgccgggctatttatagtgatattcacctctggcctgatactgggaggagggggggtgctccctgggacaagaccctatggatgaggcttcctgacaaggggagactgtgaccgtgctccctcctaccagagctccctactggcccagcccaagcagaaacaagagcccattcacgtccattcgtgtcatctcccaccgcccagtgcagagtggagaaaaggtct

SEQ ID NO: 14665 - DNA, 36093 bp, Human; identical to SEQ ID NO: 14664
  misc_feature (1)...(36093): n = A,T,C or G

SEQ ID NO: 14666 - DNA, 22124 bp, Human
  misc_feature (1)...(22124): n = A,T,C or G
tttactctgagtgagataattggggatccagagcaacactttgtcttatggaagaggttataccaggataacaagatctgtcatattcatattaccatactgcattttagatagtcactgcctaaggctcattagtaattataatagcgatgatcacaattagcctttattaagtctttattacactccatatcactaatgtccaaaatagtggctggtatactgcaagtacttaataaatgctggttaaacaaggaacaggacttgagctagaagaaaagatggagagagactgagaattgtttcagacatgggacacagcatgaacaaaatctgggatgtggggtgaacaagcagtctggatggaagcgaagaggcttcatgcaggaaatgagtgaagtcacctcgcagaagccccgaatgcctggtaaatactatcctggttcccttgaaaccagattctgtccctgttcttctagctctgttctattttttttgttgttgtttttttttttaaagagacagagcttgactatgttgcccagtctggtctcaaactcctgggctcaagtgatcctcctgctccgcctcccgagtagctgtgactgtaaatacacaccactgtgcctagcccaactcctttctttcttcctgcctacagggcctgtgaactcggagctgttcctgcgccatgttcctggatggctgcgcccacttttgcgcccattggcttggctggtgctccgggcaccaagagggggtgcccagacacccctgtattgtgctctacaagagggcatcgagcccctcagtgggagatattttgccaactgccatgtggaagaggtgcctccagctgcccgagacgaccgggcagcccatcggctatgggaggccagcaagaggctggcagggcttgggcctggggaggatgctgaacccgatgaagacccccagtctgaggactcagaggccccatcttctctaagcaccccccaccctgaggagcccacagtttctcaaccttaccccagccctcagagctcaccagatttgtctaagatgacgcaccgaattcaggctaaagttgagcctgagatccagctctcctaaccctcaggccaggatgcttgccatggcacttcatggtccttgaaaacctcggatgtgtgcgaggccatgccctggacactgacgggtttgtgatcttgacctccgtggttactttctggggccccaagctgtgccctggacatctcttttcctggttgaaggaataatgggtgattatttcttcctgagagtgacagtaaccccagatggagagataggggtatgctagacactgtgcttctcggaaatttggatgtagtattttcaggccccacccttattgattctgatcagctctggagcagaggcagggagtttgcaatgtgatgcactgccaacattgagaattagtgaactgatccctttgcaaccgtctagctaggtagttaaattacccccatgttaatgaagcggaattaggctcccgagctaagggactcgcctagggtctcacagtgagtaggaggagggcctgggatctgaacccaagggtctgaggccagggccgactgccgtaagatgggtgctgagaagtgagtcagggcagggcagctggtatcgaggtgccccatgggagtaaggggacgccttccgggcggatgcagggctggggtcatctgtatctgaagcccctcggaataaagcgcgttgaccgccgaagctgcgctcactcctgcctcaacgcgccggccccgccctccgccgccacacttccggcggggctgcgaccgcagaggggcgcgggcgagcgagcgggcggccggccgctgggggtggcgggataggctgggcgcggccggcgctgcagacccgctgctgttgtccgggtctgtgcggtcccgagggccctccgtgccgccggcgccatgggcaattgccacacggtggggcccaacgaggcgctggtggtttcaggtgagggggcggcgaggaaggtgggagctgtggagggtgctcggggtgggtgcagggctggggagtgcacggggaagagctgggcctgagtccaccgcgcggcgcagggcgctggcccccgggccgcacctgaggccccttccaagagagatctcgtgctcacgctttccttgctgcgcaccctcgggcacccaccaggggctccccctcccgctgtgggttttcctgtgtttatttgcttctcctccccctccctaggcgggcctccccgccgctctactgtgaggttgggggtcccgaactgaagccgcggggttccaggagggagggaactggtggttccgggaacgcagaggtttggctggattccagcgcccgggatggggggcgggtcgcgcagccctggagggcaggtgcctgtatggggaggggccctgaaacagaggtcgtttctcggcacagtcagacccgttaattccaagcaggctggggcttgttggggattaccggcactgcccgcccaggagacgcggatgcggcctctacaggttgggaaacccggttctgggcagtgcagtttgggattgcaaaatgctgcaagttccagaatttctatctaggtggggcatggggactgcggtactggggaaaaggaactgctattgagattttatatttggggcgctttgagaagcggctgacaccttgcaagccaccgggttgtgcagctccttgctctcaggagctgggggacgggggtcctggtgcctgacagcttggaggcctggagctggaggaatttctcttctctatcttcccactatcagtgctgattttttcagcctgcgtgcagatttggtagaactggttactgaagagatagaaggggatagaagccctgagccaggcctcacagctgccaacccttggagaggggtgataaatccactgggaattttcattccaaaacatggcttcaggctcactttggatctcaaaatcaatctctccactgggacatccccagtgtgtgggagataagtaccctacccccctgaagaccagaaatagccttgaggacagaagggagactcccagagaacactaaatgcagacttgctcctccataagacctaaacctgtctcccagtccccacccttagagaaggcttttagagaccagaatctgcactgcactttgtttttcttgtggaatttccttcaggaagcccagactctgagctgagaagacaaaagctccagttccatccttgtggaaagtcttgggactgaggggcaagaagagccccagagatgggttgctctgtgccttccagttactgagaacctggtcttcagaacagaagtcaatgcactgttagcttcaacgctattttaggggtgggaagaggagatcttgctgagaactgaggatgctggagtcagggaagcagagaaggttggcgggggtgacagataatgcctggcacaatgataccttgggatttgagatgatcaagctgagatccagctccctcttgtgtgtggactcctgagagagcagagcaactgcccccacccctgcccccacctgtctgccttgctccttggacctgtgtctaagaccagaggcatctcacccagcccagtttcagaaggaggatgctaatacatctcatggtcatcttttccatcctttcttattatctaacttccctccttcagtttgtaacataaaaccttttttctctctacttttgaaaattttaaaggggaatccttttcatttggatggggttgggggatggggataaggggggagaaaagcataattttattttcactcaccctaactgaaatttagtgttttctgtgattatgaatgttggcaacaattcatgatagtattagcaaaaagtttcctactacactacagttatttctggtaccttgaaaatctattggccgggcacggtggctcatgcctgtaattccagcactttgggaggccgagatgggaggatcaactgaggtcaggagttggagaccgttctggctaacatggtgaaatcccgtttctgttaaaaatacaaaaaattagccgggcatagtgatgcacgcttgtaagcatctcaaaaaaaaaggaaataattcatctgtattttggcattaagctaataattagatttaccactagatcttactatttaatgtattaataaagaatgacatattactaatattgcacacttggttttaaattttgataactttcaatataatttcttatgtatttattttatgaatttataagtattcttggccagactaatgcctgtaattccagcaatttgagaggctgaggcagatggatcactcgaggccaggagtttgagaccagcttgggcaatatggcaaaactctgtctctaccaaaaaaaaaaaaaattagccaggagtggtggcacatacctgtggtcccagctactaccggaggctgaggtgggaggatcgcttgagcccaggaggcagaggatgcattgagccaagatcacaccactgcactgccagcctgggcaacagagtgagaccctgtttcaataaataaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcctcccacctcagcctcccagtagctgacactataagtggacgccaccacactcagtatttaaaaaaaaaaaaaaaaaaaaaaaaaaaggtcttgctctgttgcccaggctggagtgcagtggtatgacttcagctcactgcagcctccacctaccaggttcaagccattctcatgtctcagcctcccaagtagctgggattacaggtgcacgccacagtgcccagctaatttttatatttttagtagagacagggtttcaccatgttggccaggctgttctcaaactcctggcctcaagtgatccgcccacctcggcctcccaaagtgctgggattacaggtgttagccaccatgcctggctgctaatttttaattttttgtagagacagggtctccctgtgttgcccagactgttctcaaactcctgggctcaagcaatcctcccacctcagcctcccaaagtgctggaattacagtcatgagccatcatgcccagccaggatatggacttcttgactagtaggaagaaagtgggctggacacactggctcacacttgtaatcccagcactttaggagaccgaggtgggaggagaacttgaggcccagagtttgagaccggcttgtgcaacatagtgatgtaacaggacgagctgcagacaaaacttctcagatactgagttgtagaaggaagggctttattcagctgggagcatcggcaagctactgccttaaaatccgagctcctcgagtgcccaatttctgtcccttttaagggctcacaacactaaagatttcacatgaaagggtcgtgattgatagagcaatctaggggatacgtaacaggggtttcatgcactggtagtcagagtgaaacagaataggacagggagtttcacaatgttcttctataaaatgtctgcaatctatgaataacatcggtttctaagttatgagttgatttttaactactaggtttaggccaggcaggcccaggcctggtttcgggcctggcgctgggctgcctgtctttgatttcacttccttgtttttttcttaaaacaggtactgagtataaaacaatatgagagggtctctctcttccctcagcgagaccctgtctctacaaaaacaattctttttaattagacaggcattgcgatgtatggaaggctgaggctggaggatcgcttgagcccgtgagttcaaagctgcagtgagctgtgattacaccactgcattcagcctgggtgacagagcacaatactgtctcaaaaaaaaaaaaaaaaaaagaaggtggaggaaggccaggaagggcaggggatgctcctgagagggcagagtggtgggctgtgtcctggggaagggctaagggagtggaacagaggttatcgtggggtattttgtggttcttcagctcaattgtggaaagggaaagcaagttgggttagaaagaatagagtgaggtacagttaggagaaacttccaggtcttgagacgagtaagagttagggaaatcaaggaagaggcacctaactggcctcttgggaggggtgctcaggctgagtgaccaggaagctggcaggaagttgccttccaggggaggatgctggtaggggcgggtaatctggcagtttcagcttcctgttgttgctacccttgggaacctggcaatgttgcccttggccaaggcccagcttgagctgtggcagcctgctccccaagccaaagaataagttaaaggtaaagggtgggctgggtgcggtggctcatgcctgtaatcccagcactttgggcacctaaggcaggcagatcacctgaggtcaggagttcgagaccagcccggccaacatggcgaaaccccatctctactaacaatttaaaaattagccagacgtggtggtggttgcctgtaatcccagccacttgggaggctgaggcaggagaatcacttgaatctgggaggcggaagttgcattgagctgatattgtggcactgcactccaacctgggcaacagagcaagagtctgtctcaaaaaaaaaagataaagagtggccatctagggccgggcacggtggctcccacctgtaatcccagcactttgggaagccgagccgggcagatcacgaggtcaggagatcgagatcatcctggctgacaaggtgaaacccggctctattaaaatacaaaaaaaagctgggcatggtggcaggcgcctgtagtcccagctgcttgggaggctgaggcaggagaatggcgtgaacccaggaggcggagcttgcgccagtgcactccagcctgggcgacagagcgagactctatctcaaaaaaaaaaaaaaaaaaaagagtggccatctaccctgtccatcccccaccccactcccacatcctacccccaccactaccaccttcccactgcacattgagaagtcccatggggctagcccaaggcagccatgccccagcccccaccaggccagaagatgtagaataagctgtgatttttggtccccttccagtttcacttgatcctgagatggtttgggtttcagattgagtgcttgtcctcagaggcctccccaccccacttcccaggtcagagaagcccggaatggcttaccttgaacagcagccctgttaacaggtagttctaccccagagaaacagacagagacccaggaccccgtcttactgttccctgcccacactgctctttgatccctggacctctggttctgctgctggaacttcacgcatggcagcagacccagaaaactgggttacctacctggtaagcagtattagatgccagctctccaacctttcaagccctccccactgggggtgaggtggagcggttctttatttctttgcctccacccaccgaaaatttgtccccagtttcccattctctccattgtgtctgtttctattattgtcctcaacacccacccaaacccagactctacagctgcactgtccaatgtggacaggagccacaggtggccatttaaattaattaaaaaattcagttccccagtcataccagcctcatttgaagtgcacaacagtcatatgttgctagaggctgctgtactgcacagcataaacacagaagaagatatagaacattcctaccctcacagaaagttgtcatggataagactgctctagaagttgtctgccagtatcagccaccatgccttgcctggattactgcaagagaccagtctccctgatcccagtgtcttcctcctcatgcaaagtggtgtgtgtttctcaagggtaaccttgctccctgtcactcacatacacagcttcttggcctgacacacaagacactgtgtgatctgccctctgcccctccacttgccttattccctgccgtgagtcctcagagacactaacccagctgcatgaaactcccccagacccttgaccttgggagtcagtcaaccttttgaggttctttgaagctttcatgaaaacctaactttgtgaacatggaaatgataatgctcggccaggcgcggcggctcatgcctgtaatcccagcactttgagaggccaacgcatgtggatcgcttgagcccaggaattcgagaacagcctgggcaacatggtgaaaccttgtctccacaaaaaatacaaaaattagctgggcatgggggcacacacctgcggttccagctactcgagaagctaaggtgggaggatggattgagcccaagaggtggaggctgcagtgagccgtgtactccagcagtgctgtactcgtgtacagtgtactccagcctgggcaacagaatgagaccctgtctcaaaaaaaaaaaaaaaaagaaatgataacactctctggtttttcccagatcacatatttcctttgaatactgtttcctgtacatttttttgcactgcaagttaactgcctgtccagttttatgaaggtttccttgaacttgatgaggaattttggcattaacaagagagttcactacaagaatctcaggaattgccgggcgcagtggctcacgcctgtaatcccagcactttgggaagctgaggcgggcagatcatgaggttaggagatcgtgaccatcctggctaacacggtgaaaccccgtctctactaaaaatacaaaaaattagctgggcgtggtggcgggcacctgtagtcccagctattcgggaggctgaggcaggagaatcgcgtgaacccgggaggtggagcttgcagtgagctgagatcgcaccactgcactccagcctgggcgacagagcgagactccgtctcaaaaaaaaaaaaaaagaaatctcaggaattgatttttctcgtttctgtatagggaacatatagaacatgtctacagcatggatctgggttgtggctgaattagatgttctgtgtagctgacacactgtttccaagaaccacttcctttttaggcctttttgctttctccacttctcccattggtaccacaagttagcctttgttttgaggccttgccttccccacccgttcccatgagaggaacaaagtcattctgaatgttttggaagtagagaaccagcctcactgagatgtgtctgccaggcagaagagcaaaccctctcgccttggttgggagactctttcttccctcccagccccccagtgttgtccctgtctgcgttccctctctgtctacaccccccgtgataacaggtgaactccagggcatacttgtttattgaattaattaattaaaaatggaagctggaccaggcgcggtggctcatgcctgtaatcccagcattttgggaggctgaggcaggtggatcacaaggtcaagagttcgagaccagcctggccaacatggtgaaaccccgtctctactaagaatacaaaaattagacgggcatgatgatgcatgcctgtaatcccagctactcgggaggctgaggcaggagaattgcttgaacctgggaggcagaggttgcagtgagccaagatcacgccactgcactccagcctgggcaacagagcaaaactccatctccagaaaaaccaaaaaaaaaggaagctggcctggcgaggtggctcacacctgtaatgccagcactttgggaggccaaggcaggcagattgcctaaggccaagagtttgagaccagcctggccaacatgatgaaactctgtctgtactaaaaatacaaaaattagccaggtatgctgtggcgggcacctgtgatcccagcaactcaggaggctgaggcaggagaaccacttgaacccaggaggcagaggttgcagtgagccgagactgcgccactgtagtctagcctgggcaacagagtgacattctgtctgaaaaaaaaaaaaagctttttcagatcacctctgcccattgtcctgttctgttcttcttttctctggaagcacttacattctaaactattcattggctatccttctctttatgtaaattgcctgtctaccaatctagactttaactcccataagggtagggagaacttctctctcattgatgtgtaacctcagcactaggcacccaacagtaggcgttgtcaagtatcagagcaggtaaaggacaaaagttgctatcagtgggctggagggtagacagacccaagaaccgactgacttgcggtggtttgctttgctccccagggggctgttgtggttccgactataaacagtacgtgtttggcggctgggcctgggcctggtggtgtatctccgacactcagaggtaagcacctgggggctctaggacctgtcatggagtgggccagggagagaggggcttccagcattgttctgcttcactctgagggtcagctagagcatctaccatttccacattccattctggcggtggaggggtggggttgggggggacttcctaagaagcatgtaagatgggttgcacaggggtgcaggagacatgcatcaggaaggtctgtcatgggcaccccctccttagtgggtgttcttttttccactggaggtggcattacttctgtcccagagaattcagggtcataacccaggcagaatcttgatttcctgattataactcaaagttatttaagaagtctttattatacgcccagtttggagtgggcatatgaagggaggaaaggctggagggaccccatgcacacccttacccatgcaggccctggggtaatccaggcagggactatgtggcagagaatggacatatagtcaaaagtggttctgtgacagtggtaagttagacagggagggggacctaacgaattagtgctggggctgagcaagacaggtctggacctcctaaatcagtctggaaagacttactagaggaagtgagatttcagctccccagagggcccaccatccagctctacctgccgctgcctgcagagcctagggcagggccagacctggcctctcctgccaccctcactgcccacccgggagatgaggcacgccagctacctttccacgatcgcccccttcctcattatgggagatggggcggtggggaggggaggagcagatccttcccaaccaggacccaggcaacaagggcagcagagctgtgggcatgttgcaaggtggtcggtcaccccacaggggaaatcatggagattccagtggaaaccccctctgccccatcccccacccgtcagcagctcacgtctgcaccaagctgctagtgcttgaggctcctgggagtctgagggcatctgctagggtcggggggaatgggaagcatggcacaatggattaacttcactggttctcagtaaccgctgcactctcccacctctcccctcactttacccgaccagaggtgagcgatgctggggactcttctggtccaaggctcaaagtgtcagagtaatcagtagtggccacagcctccactcgagaggatcctggccacacctgagtgggccagtggcctgtcagaagccgtggggagccctctccagacatactgccaccccacacactgtgcattcccagcacaacagagtatcttgtccagacacctgccctgcgtgggcagccactgctaggccaattcccctgcagtcctttctccagattcttggtcccctgctctcccttcctgctccagggagcagagccaggacagaagggccaagcctttctgacagcaagtttggaagttaaaggtgaagggccttgtatctcttcccaggacaccgacctcacacccaggctctacatcctccctctggtctcacttgctgggtagtctgagccagtaatccttctccttcttacaccttttctggggggcagcctcttccctagtccctagcctgcttgggggacgcctccacaggctggggctttatttccctaggctggcaggagcctctcgggtcagagtagaggcttctaactcagcctggatactcagcctccctctcaaggtcctttctgcagctgtctatatgtcacgtgcccttggggtcagccattcttcttccaggctcagtgacccctcctgctgcattttgctgccacatcctatactatcccgaggccctgatatgggcggctctctccctcttacctgagcaattcttccacctttggcatctgagctgcagcctcccttcttccctccccactacccttcctccctccctccctctcccctatttccctctctccttccccagaagagagcttggtgggttcctgtctgagctgggtcaagaatcctctcaggcccaaggatgctagtgttaggggctcgaatgaaggcaacttttgcacatctgcatggccagtgccccagggctggcactgtgggggtggcccctcctgggattgagatgggggctgcacatcgactgctgctccttatcaccccctccacctgcttctgccccttcaccctcggcctctgtcctctcttccttcctctgatttagggaaaccttccacactgtccacagcctggcctctgcctagacaatcaccctgcacacagactgcctagggaggcccagccaggatgggccagggagcttcgaggcaccttgttttctttgccaataatcttctctctgcccctggccaactttggaaattcccaattaaatgcctcccttatctcccggttatccctgagtattctggcaggagcacactctcccccagccttccttggccccacatcagaacatttgggcttttctggcctcaccttgccttagtgatagatagtgcagacctggcggattcggcatttgctaaagctcaggagtccccagaatagcctcccactcccgatttctggaaacacaggtttacctgtgtgaagacggggggctaagcctcagtctcccagattgcgacaggatccctgggaaagtgaggtggcgggcaacccaggtgccctgtgcacaagcctcctgacctcaggccgcaggcccagggtggcagcaggcatcttccccagcctagcaggtcctcactaaaagggtttgggggctagagaagagacccagaggcctcggatcagcacaggaggtcgctgctgtcctgcagccctcggctgagctggcagttggggggttggattactgacagcatgcccccccccgcccccaggcgtcaggcatcggtgcttgtctggtaactactgtgtgtgtttgctgtgtcccctccttcccttcctgtccctacctctccccaccccctggctgctcctcagactgtctctggaggttatgaccatcctgtgtcgctgtgagaatattgagacgtcggagggggttccactattcgtaacaggggttgcacaggtaataacccacctgcttcctcctccgtgtctaaccttctctcttcctgccctgcggggcctggcagacaggagccgatggactcccctcctgagaccgtgccttcctccctctcctcttttctctcctccactgctctgggtgccaggatggatccctgtacatccccaggtcccttgcccttgcctattggactgcaagtggggaaacagcaagggattctggaagctctgccaagtctgccagtgagtgtccctggatgccaggccttcgttaccatgcagccatagctggtgaaatctattcttgggcttgggtgttaattagctccaaatgcttactctgtcatgtgtgggttcccctcttcattgcttcattcaccagctctctactgagcaccttctcagtttgaggcatgtggactgcaggagcgaacaataaaaagcccctgccccctcagagcctgtgtgccagcgggttcccagcctggaagaggcctgaaccacatctttctcaccccctccctctgcattcagttgcccttcagcctctgcttaggcaaaaacactacaccaccactcccttcttcacccatcctgccatctctaatggggaaggggaccatccccatccccttagcccttgtagccatgggaggtgcagaggcctgggaggcttggagcaccttgtgtggaaggggtagggtccaggcctccttcaatactctatttgatgcagtcctctctccttccatacccacacctacacttgaaacacctgcaaagcccagatcccttttaaagtgggtgactgtggaccctggaggagtcagattgcatggccagaacaactctttccagggttaacactccttggccaagaagctctagtgtgacttcagtctaaattccccatgtgacccacctgggcctaataccagacatgggtttcaagtcaaaggctgcagccaccaggtagggcttctctggcaaggggcaggtacagaatcacttccatcttagcccagcagtaggcatactccaggatgccaggcaatcaggcagagctttccaagcaacttcctggggcaccctggggtgctgggtagaccaaggaatgggcaagggcccctgtgggaggctcagttgacatccacggatggcctgcacagcagggccgggaggaccagcactgacttgctatcctagaacatacacacagctacacctggattctcccctgaccaacagcccccgaccacccacaaccacttctttctacttccttttcctcagctgacttgagcagagggtgtgtgcacatatgcagcccacttccactccttcccctggggccacctgcacccaccctgccctcgtgcccacctccttctcagacactcccatctcagccccgtggagagtcctccctccaccttcctcaccaggacccagccggagcagtgaggtactggcctctttcccaacaccaccaggccctgcgcccccagacccatgcccctgttttgcgtttcttggcaggatttccctagagattatgacgttgcagccccgctgcgaggacgtagagacggccgagggggtagctttaactgtgacgggtgtcgcccaggtatagtaactcagcagccctgcgcatgtccgttgagctgcctggtcccgtactcgggttcggggggaggaggagaggacagcagccaggggcagtctctctccagcaccccagcccccgcaagtcccacaagagagggctagtcaggtcgtcgccactggaacatgctcaccgggccattttggccacccagcaggactaacagacaccccttctctcctcagcgggcccacgagggacagaaccagtgctgagggctcctggctcactaaccccacccccattctttgcaggtgttggaaatgtcaagccccagaatccaggccttccttgttccctgggtactgcgtgggaggggtggggcccagagggagaggccatgtgaggcagaggagctctggactctgggagtcggaggctgcatcatatcccctgctgagggcctaggtgagggcttcctgccccgatccacctcttggcttcacagggcagtgaggttcagccatgctgtaggcctcggcgaggggttggctgagtaactcaagaaggagaggcaccctcggttgcatcccccaaccctctcctgccctgtccaggctctttccttctctgtctgtgtccctattgctcattctgcttctcatactctctgcccctcagcctgagggtctcccacgtgtaggaagcctgcaagggaggaattagctggtgaggggacagtaggctggaggggtggggagacaagccccgaatgcccaggagaggccgtggcagggcctggggctgtcagtgcaggagaagtttcatagtgagagaagcccttgtgctgctgtctccccactagaggcttcagacagattccagccccccagggcctccaggtctgaaaaaaggaagggaggaggcacagccaccatcctgcctacctctgggtctggggcctttgtctgcctcgctccagcctagctgaagcgcctttgtcgtcactgacaggtgaagatcatgacggagaaggaactcctggccgtggcttgtgagcagtttctgggtaagaatgtgcaggacatcaaaaacgtcgtcctgcagaccctggagggacatctgcgctccatcctcggtgaggccctgttcagcctttgaggagcctcacggggcccctaagccaaggcagggaggtgtgcagggctgggcagggggcctgtttcacaggagtttcaagctaaaacacttttcctcaaatatttaatttcaaaacttcaggtgacttgagttaaggagagggtatgagtgaaggggtgggatgggggctgtcggtctgctcaggaacctagtgctgcttgggacacttttcctcattcagcctggactgtgcagcaggaagctcggtgttaagtgctgttgagaagataccccaggaagacccagctcagagtgcagcaccccgcatgcacccctacctctacatgcatgcctcctcccttccccagctggctgggtccctggggagccagcccttgatccctctgcccccagggaccctgacagtggagcagatttatcaggaccgggaccagtttgccaagctggtgcgggaggtggcagcccctgatgttggccgcatgggcattgagatcctcagcttcaccatcaaggtacgacgtgatgggaagctgtatctcctggcgtccatctgggagatggtggctttgttagaggggcacctttgtgcctctggctgctcctttgagcctctgatacccccttccctccccaggacgtgtatgacaaagtggactatctgagctccctgggcaagacgcagactgccgtggtgcagagagatgctgacattggcgtggccgaggctgaacgggacgcaggcatccgggtatgtgggttcaaggatgggaagctcaggggtgatgggaccatgatgactcaggacctctactcactcaccttccccttctgccccttttgtccccaggaagctgagtgcaagaaggagatgctggatgtgaagttcatggcagacaccaagattgctgactctaagcgagccttcgagctgcaaaagtcagccttcagtgaggaggttaacatcaaggtgagcagcctgaggacatcctgggatggggctcagggatcaggacttggtgaccagcctctaatgtgccacacaccctcttgccacagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaagtgagagccgcccaggtgccggggtcagggcttagtcaggctcctctgccttcagtgcactccctctactctcctgaccacagcttggaagccacttctccccctccactgtgtcttcttactcactgtgaagtgaggataaccccatgtcccctgtgggactgctgttgggaagactaaatagataaaggaggctccagtgcctggtgtagtgcttgggcatagacggcatcctggtttgttccctcccacttacagatgggagccggtggcctttccctggccagagccggaaggtcaggccaccccactccgttccaatgtctcccaccccgacagcccccagagcagagggtttgaaggtttgctggcccccaggcaaggcttgagaggaccctggtacgtcccactgatcctaactggcctgggctcccccagggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccaggtgaggcttccacccaagcgggtcctagggttcaagtgtccttgcttgacaagctgggcaagtgccagaacttctctgggccttgcgagtaacacagggacagatggctagaagggttaaatgaggagcatcctcagcagggggcaggaaccctacaaaggcctaagccatccctggcccacagggcgtctcttaccatggctcgagactaagggccacccaggctgctttggggttggagtgagttaaggaagggagggagagatgctggaccgggctgagaacagagtcagcgccaaccaggctgtcctcccactcttacctcctagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaaggtatgtgcctgcctagctgcggtggggttgcccaggtagcccgtcggactggcccaggcaaagtggtcctgggctctggagccaaggtctcatggcatctcccatccttgcagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgtgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgcccacccctgcattgtgtcttctgtgaggagagagactgcgaaccgagaaccaaccaggtcccctacctctcttcagcttcaaggcagcttttagcctgttcttccgcattctagccactggggagcaacagcacactggccttgcccccagttgcgccttggacatgactgattggctaagatgcttaggccaaaccccagccctggaacacctggctccatcacaggcagaaggtggaggggactagcagggtgcagttgcacatgcctgtagtcccagctactcaggaggctgaggtgagagaattgcttgagcccaggagtttgagtccagcctgggcaacataggaagactccatctcttaaaaaaaaaaaagaagaaaaggtggaggaaactgccaggttcactgcacctctgtaccggtatactgagccctactcagtaatggagcccatctctcaggcttaagagcttagactctgaagtaaggcaatgtaggtttagattttagctttattgttcattacctgtgtaatcttaggtgagtaacttcatctttctgggcctcaatattcttattcatttaatgaatttatcaaatgcttgcaatgtactaagcattgtcttagatgccagagcaatgagtcaacaaaataaatgcacagccattcaagcttacattcagatagaaacaagaaaaattaaacgtacagtatgttagataatggtaagtcataaggaaaagaagtcaaagaaattataggaagtgtgggagtccgctgaaattttagggtatccaaaaaaggcctcattaagaaggtagccctgaagaaagtaaaggattgagccattcagatatctgaaggaagagttttccatccaaaggccctgaggcaggagagtgtctggcatgatgaaagaatagcaaggtcaggatgtttggagcaagggagtaagtcagggtatcaggagatgagtcaggatctcatctttccagatcatgtagaaccttaatgaggcatattgtggtctttactctgaggtgggaaaccactgaaaggctttgaaaaaggagtgatatcatttgatacaccttaaaaggtatttctaggcaccaagacaattcaaggcagaaaggaacagatggtgctagaacaactgggtctgtattggggaaaaaaattgaattgcagctgagcgtggtggttcatgcctgtaatccaagcactttgggaggcctagttgggtggaccacaaggtcaggagttcaagaccagcctggccaagatggtgaaaccctgtctctattaaaaactacaaaaatgggctgggcacagtggctcacgcctgtaatcctggcgctttgggaggccgaggcgtgcagatcacgaggtcaggagatcgagaccatcctggctaatgcagtgaaaccctgtctctactaaaaatacaaaaaattagccaggcatggtggcaggcgcctgtagtcccagctacttgggaggctgaggcaggagaatggcatgaacccaggaggcagagcttgcagtgagccgagatccgcaccactgcactccagcctaggtgacagagcaagactccgtctcaaaaaaataaaactacaaaaattagccaggtgcagtgtcaggcacctgtaatcccagctactcgggaggctgaggcagaagaatcacttgaacccaggcagcagaggttgcagtgagccgagatcatgccactgcacacagagtgagactctgtctcaaaaaaaaaagaaaaaaacaattgaattgcaaccccctacctcacaccatatacccaaatctagtttggggtggatcacagacctaatgtaaaaactcaaaacataaagttcatagagcaagcagggaatgtttctatgaccttgacataggcaagatttcttaagaccaaaaaaaaaaaaactactaaccataaaagaaaaatttgatatattgcatcatcacaataggtcttggcc

SEQ ID NO: 14667 - DNA, 10640 bp, Human
cctgggagtctgagggcatctgctagggtcggggggaatgggaagcatggcacaatggattaacttcactggttctcagtaaccgctgcactctcccacctctcccctcactttacccgaccagaggtgagcgatgctggggactcttctggtccaaggctcaaagtgtcagagtaatcagtagtggccacagcctccactcgagaggatcctggccacacctgagtgggccagtggcctgtcagaagccgtggggagccctctccagacatactgccaccccacacactgtgcattcccagcacaacagagtatcttgtccagacacctgccctgcgtgggcagccactgctaggccaattcccctgcagtcctttctccagattcttggtcccctgctctcccttcctgctccagggagcagagccaggacagaagggccaagcctttctgacagcaagtttggaagttaaaggtgaagggccttgtatctcttcccaggacaccgacctcacacccaggctctacatcctccctctggtctcacttgctgggtagtctgagccagtaatccttctccttcttacaccttttctggggggcagcctcttccctagtccctagcctgcttgggggacgcctccacaggctggggctttatttccctaggctggcaggagcctctcgggtcagagtagaggcttctaactcagcctggatactcagcctccctctcaaggtcctttctgcagctgtctatatgtcacgtgcccttggggtcagccattcttcttccaggctcagtgacccctcctgctgcattttgctgccacatcctatactatcccgaggccctgatatgggcggctctctccctcttacctgagcaattcttccacctttggcatctgagctgcagcctcccttcttccctccccactacccttcctccctccctccctctcccctatttccctctctccttccccagaagagagcttggtgggttcctgtctgagctgggtcaagaatcctctcaggcccaaggatgctagtgttaggggctcgaatgaaggcaacttttgcacatctgcatggccagtgccccagggctggcactgtgggggtggcccctcctgggattgagatgggggctgcacatcgactgctgctccttatcaccccctccacctgcttctgccccttcaccctcggcctctgtcctctcttccttcctctgatttagggaaaccttccacactgtccacagcctggcctctgcctagacaatcaccctgcacacagactgcctagggaggcccagccaggatgggccagggagcttcgaggcaccttgttttctttgccaataatcttctctctgcccctggccaactttggaaattcccaattaaatgcctcccttatctcccggttatccctgagtattctggcaggagcacactctcccccagccttccttggccccacatcagaacatttgggcttttctggcctcaccttgccttagtgatagatagtgcagacctggcggattcggcatttgctaaagctcaggagtccccagaatagcctcccactcccgatttctggaaacacaggtttacctgtgtgaagacggggggctaagcctcagtctcccagattgcgacaggatccctgggaaagtgaggtggcgggcaacccaggtgccctgtgcacaagcctcctgacctcaggccgcaggcccagggtggcagcaggcatcttccccagcctagcaggtcctcactaaaagggtttgggggctagagaagagacccagaggcctcggatcagcacaggaggtcgctgctgtcctgcagccctcggctgagctggcagttggggggttggattactgacagcatgcccccccccgcccccaggcgtcaggcatcggtgcttgtctggtaactactgtgtgtgtttgctgtgtcccctccttcccttcctgtccctacctctccccaccccctggctgctcctcagactgtctctggaggttatgaccatcctgtgtcgctgtgagaatattgagacgtcggagggggttccactattcgtaacaggggttgcacaggtaataacccacctgcttcctcctccgtgtctaaccttctctcttcctgccctgcggggcctggcagacaggagccgatggactcccctcctgagaccgtgccttcctccctctcctcttttctctcctccactgctctgggtgccaggatggatccctgtacatccccaggtcccttgcccttgcctattggactgcaagtggggaaacagcaagggattctggaagctctgccaagtctgccagtgagtgtccctggatgccaggccttcgttaccatgcagccatagctggtgaaatctattcttgggcttgggtgttaattagctccaaatgcttactctgtcatgtgtgggttcccctcttcattgcttcattcaccagctctctactgagcaccttctcagtttgaggcatgtggactgcaggagcgaacaataaaaagcccctgccccctcagagcctgtgtgccagcgggttcccagcctggaagaggcctgaaccacatctttctcaccccctccctctgcattcagttgcccttcagcctctgcttaggcaaaaacactacaccaccactcccttcttcacccatcctgccatctctaatggggaaggggaccatccccatccccttagcccttgtagccatgggaggtgcagaggcctgggaggcttggagcaccttgtgtggaaggggtagggtccaggcctccttcaatactctatttgatgcagtcctctctccttccatacccacacctacacttgaaacacctgcaaagcccagatcccttttaaagtgggtgactgtggaccctggaggagtcagattgcatggccagaacaactctttccagggttaacactccttggccaagaagctctagtgtgacttcagtctaaattccccatgtgacccacctgggcctaataccagacatgggtttcaagtcaaaggctgcagccaccaggtagggcttctctggcaaggggcaggtacagaatcacttccatcttagcccagcagtaggcatactccaggatgccaggcaatcaggcagagctttccaagcaacttcctggggcaccctggggtgctgggtagaccaaggaatgggcaagggcccctgtgggaggctcagttgacatccacggatggcctgcacagcagggccgggaggaccagcactgacttgctatcctagaacatacacacagctacacctggattctcccctgaccaacagcccccgaccacccacaaccacttctttctacttccttttcctcagctgacttgagcagagggtgtgtgcacatatgcagcccacttccactccttcccctggggccacctgcacccaccctgccctcgtgcccacctccttctcagacactcccatctcagccccgtggagagtcctccctccaccttcctcaccaggacccagccggagcagtgaggtactggcctctttcccaacaccaccaggccctgcgcccccagacccatgcccctgttttgcgtttcttggcaggatttccctagagattatgacgttgcagccccgctgcgaggacgtagagacggccgagggggtagctttaactgtgacgggtgtcgcccaggtatagtaactcagcagccctgcgcatgtccgttgagctgcctggtcccgtactcgggttcggggggaggaggagaggacagcagccaggggcagtctctctccagcaccccagcccccgcaagtcccacaagagagggctagtcaggtcgtcgccactggaacatgctcaccgggccattttggccacccagcaggactaacagacaccccttctctcctcagcgggcccacgagggacagaaccagtgctgagggctcctggctcactaaccccacccccattctttgcaggtgttggaaatgtcaagccccagaatccaggccttccttgttccctgggtactgcgtgggaggggtggggcccagagggagaggccatgtgaggcagaggagctctggactctgggagtcggaggctgcatcatatcccctgctgagggcctaggtgagggcttcctgccccgatccacctcttggcttcacagggcagtgaggttcagccatgctgtaggcctcggcgaggggttggctgagtaactcaagaaggagaggcaccctcggttgcatcccccaaccctctcctgccctgtccaggctctttccttctctgtctgtgtccctattgctcattctgcttctcatactctctgcccctcagcctgagggtctcccacgtgtaggaagcctgcaagggaggaattagctggtgaggggacagtaggctggaggggtggggagacaagccccgaatgcccaggagaggccgtggcagggcctggggctgtcagtgcaggagaagtttcatagtgagagaagcccttgtgctgctgtctccccactagaggcttcagacagattccagccccccagggcctccaggtctgaaaaaaggaagggaggaggcacagccaccatcctgcctacctctgggtctggggcctttgtctgcctcgctccagcctagctgaagcgcctttgtcgtcactgacaggtgaagatcatgacggagaaggaactcctggccgtggcttgtgagcagtttctgggtaagaatgtgcaggacatcaaaaacgtcgtcctgcagaccctggagggacatctgcgctccatcctcggtgaggccctgttcagcctttgaggagcctcacggggcccctaagccaaggcagggaggtgtgcagggctgggcagggggcctgtttcacaggagtttcaagctaaaacacttttcctcaaatatttaatttcaaaacttcaggtgacttgagttaaggagagggtatgagtgaaggggtgggatgggggctgtcggtctgctcaggaacctagtgctgcttgggacacttttcctcattcagcctggactgtgcagcaggaagctcggtgttaagtgctgttgagaagataccccaggaagacccagctcagagtgcagcaccccgcatgcacccctacctctacatgcatgcctcctcccttccccagctggctgggtccctggggagccagcccttgatccctctgcccccagggaccctgacagtggagcagatttatcaggaccgggaccagtttgccaagctggtgcgggaggtggcagcccctgatgttggccgcatgggcattgagatcctcagcttcaccatcaaggtacgacgtgatgggaagctgtatctcctggcgtccatctgggagatggtggctttgttagaggggcacctttgtgcctctggctgctcctttgagcctctgatacccccttccctccccaggacgtgtatgacaaagtggactatctgagctccctgggcaagacgcagactgccgtggtgcagagagatgctgacattggcgtggccgaggctgaacgggacgcaggcatccgggtatgtgggttcaaggatgggaagctcaggggtgatgggaccatgatgactcaggacctctactcactcaccttccccttctgccccttttgtccccaggaagctgagtgcaagaaggagatgctggatgtgaagttcatggcagacaccaagattgctgactctaagcgagccttcgagctgcaaaagtcagccttcagtgaggaggttaacatcaaggtgagcagcctgaggacatcctgggatggggctcagggatcaggacttggtgaccagcctctaatgtgccacacaccctcttgccacagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaagtgagagccgcccaggtgccggggtcagggcttagtcaggctcctctgccttcagtgcactccctctactctcctgaccacagcttggaagccacttctccccctccactgtgtcttcttactcactgtgaagtgaggataaccccatgtcccctgtgggactgctgttgggaagactaaatagataaaggaggctccagtgcctggtgtagtgcttgggcatagacggcatcctggtttgttccctcccacttacagatgggagccggtggcctttccctggccagagccggaaggtcaggccaccccactccgttccaatgtctcccaccccgacagcccccagagcagagggtttgaaggtttgctggcccccaggcaaggcttgagaggaccctggtacgtcccactgatcctaactggcctgggctcccccagggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccaggtgaggcttccacccaagcgggtcctagggttcaagtgtccttgcttgacaagctgggcaagtgccagaacttctctgggccttgcgagtaacacagggacagatggctagaagggttaaatgaggagcatcctcagcagggggcaggaaccctacaaaggcctaagccatccctggcccacagggcgtctcttaccatggctcgagactaagggccacccaggctgctttggggttggagtgagttaaggaagggagggagagatgctggaccgggctgagaacagagtcagcgccaaccaggctgtcctcccactcttacctcctagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaaggtatgtgcctgcctagctgcggtggggttgcccaggtagcccgtcggactggcccaggcaaagtggtcctgggctctggagccaaggtctcatggcatctcccatccttgcagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgtgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgcccacccctgcattgtgtcttctgtgaggagagagactgcgaaccgagaaccaaccaggtcccctacctctcttcagcttcaaggcagcttttagcctgttcttccgcattctagccactggggagcaacagcacactggccttgcccccagttgcgccttggacatgactgattggctaagatgcttaggccaaaccccagccctggaacacctggctccatcacaggcagaaggtggaggggactagcagggtgcagttgcacatgcctgtagtcccagctactcaggaggctgaggtgagagaattgcttgagcccaggagtttgagtccagcctgggcaacataggaagactccatctcttaaaaaaaaaaaagaagaaaaggtggaggaaactgccaggttcactgcacctctgtaccggtatactgagccctactcagtaatggagcccatctctcaggcttaagagcttagactctgaagtaaggcaatgtaggtttagattttagctttattgttcattacctgtgtaatcttaggtgagtaacttcatctttctgggcctcaatattcttattcatttaatgaatttatcaaatgcttgcaatgtactaagcattgtcttagatgccagagcaatgagtcaacaaaataaatgcacagccattcaagcttacattcagatagaaacaagaaaaattaaacgtacagtatgttagataatggtaagtcataaggaaaagaagtcaaagaaattataggaagtgtgggagtccgctgaaattttagggtatccaaaaaaggcctcattaagaaggtagccctgaagaaagtaaaggattgagccattcagatatctgaaggaagagttttccatccaaaggccctgaggcaggagagtgtctggcatgatgaaagaatagcaaggtcaggatgtttggagcaagggagtaagtcagggtatcaggagatgagtcaggatctcatctttccagatcatgtagaaccttaatgaggcatattgtggtctttactctgaggtgggaaaccactgaaaggctttgaaaaaggagtgatatcatttgatacaccttaaaaggtatttctaggcaccaagacaattcaaggcagaaaggaacagatggtgctagaacaactgggtctgtattggggaaaaaaattgaattgcagctgagcgtggtggttcatgcctgtaatccaagcactttgggaggcctagttgggtggaccacaaggtcaggagttcaagaccagcctggccaagatggtgaaaccctgtctctattaaaaactacaaaaatgggctgggcacagtggctcacgcctgtaatcctggcgctttgggaggccgaggcgtgcagatcacgaggtcaggagatcgagaccatcctggctaatgcagtgaaaccctgtctctactaaaaatacaaaaaattagccaggcatggtggcaggcgcctgtagtcccagctacttgggaggctgaggcaggagaatggcatgaacccaggaggcagagcttgcagtgagccgagatccgcaccactgcactccagcctaggtgacagagcaagactccgtctcaaaaaaataaaactacaaaaattagccaggtgcagtgtcaggcacctgtaatcccagctactcgggaggctgaggcagaagaatcacttgaacccaggcagcagaggttgcagtgagccgagatcatgccactgcacacagagtgagactctgtctcaaaaaaaaaagaaaaaaacaattgaattgcaaccccctacctcacaccatatacccaaatctagtttggggtggatcacagacctaatgtaaaaactcaaaacataaagttcatagagcaagcagggaatgtttctatgaccttgacataggcaagatttcttaagaccaaaaaaaaaaaaactactaaccataaaagaaaaatttgatatattgcatcatcacaataggtcttggcc

SEQ ID NO: 14668 - DNA, 8281 bp, Human
ataatcaaacagcaccagtaaggaaggcaatggaatgtgaaacttccttccctgaaccctctcagtcccgtttcctaggtgcaactccctttaacagttttctcagaaattattacagaggtgtggccaggtgaggtggctcatgcctataatcccagcactttgggaggcctaggtgggccgatcacttgtggtcaggagttcgagaccagcctggccaacatggtgaaaacctgtctctactaaaaatacaaaaattagctgggcgtggtggcacatgcctgtaatcccagctacttgggaggctgaggcaggagaattgcttgaaccctggaggtggaggttgcagtgacccaagattgcaccactgcactccagcctgggtgacagagggagactccatctcaaaaaaacaagaaagaaaaaagaattgtatatctagccataaatatgtgtatgtttgtatataaggtgtctgtgtataatgtatatagtatgtgataagtatgtatatgttagtatataatatatatttgacacatagaaaattataagtacttatacataaaatataattccctttgtatcaaaattggctcattccacacattccagtttggcaccttgcttctcacacttaccaccacatcttggcacactcccatgtcagcacacatgggtctagctcatctttgccaaccatagtgtggcattgcactgggtggatgtgccacagttagctagccagtcctgtacagatgatcatttagatcattttcagttttttgctacaaaaaaacatgctacagtgaacatccttgcacaggtatctttgtgtgcatgtatggctagagtcgcacgggatcaattcctggaaggggagctgttggctccaaaggcgcatgcatttatgcttggtaaacattgccagattgccttccaaaatgtctgcgccaatttgcagttctaccagcggcctgtgaatgttttttgtttggttggttgggttttttcctttttttttttttttgcagtctggctgctggtggccccctcgcctaattacctgtcacttacacaccctgcatttctggccacagtgcctttgcccatgctgtacccacagcctaaaattctctttctccctagcctgctcgatgaaatagtccccttcctgtcaggccacagttcagttgtcacctcttttttatgtcctttcctgactcccctaagttgtcagagtccctttcctctgggatactacagcttcttgggcataattctatcatagaaccaactgagggcctactgtgtgcctggcattctgtgatcattttgacagtccccaccgtaagcacacaaaaaagtggttttgttctccacctccctccatcctggctctccagctgcgctgtcttttgtcagcacagtcctgccttggagcctttgcacttgcactctctatggatcttgtcctcacccatcgtggtgtcatggtgcctctctggagtctctgctacaattcacctgctggtagaggccttccctgagcaccctgtctcaagcacccctcctctagtccccgtgttacatcaccgttaccttcacaacttacaagctgtaatgaccttgttgctttggatgttgatccgtttattttctgtcctgtcttccaccactgagcgcacgaacacacacgcgtacagacacccccatggtaagcttcccgagaccaggaaccttgttttccttttccgctgcctccagccttaaacctgcaccactggactaagcgctcagtaaacattcgttgaattaaccattcctgttttacagaggaggaaactgtcattcagaaaggagagccgagtagctcaaggtcccacggttaataaaaagcacagctgagattcgagcccagcagaactccaaatccagtcgcgtgatttcttccccactcttcacacgccgcgttgtccccctccctcaactcccaacagactacgcgagtcttacgccggggaccccaggggcgcgtccgtgctcgccccgggaggctcatcgcgtacgcgctgtcaccctccccgccccctgtcagtcaggccgaagagcgcgcggcgccagcgggggcgctgagctcagtagtgccgcagcgccggagccggagccggagccggagcgcgcgagctcgcagggcgcgaggaacgagcggtggctggtacgcacccgagacccgggcactcgtgcgctcctgctcaggacccgcgacccgagcgcctgatcccggccctatcccccctccggcccctggtccacctccggcctggcctagcggagcccccgcgtccgcccgccgcagccgccgctccatccccagccccggccccgcatccaggtgaggcggccgcgcgccggggatggggaacgggatgaggatggagaggggactggggcgacaggagggagctggggaaggggatggaaaatggagggagacccgggggatgcgcgtcagtgtgcaccccggagtatgtgagtatgctccggtgtttgcagctgcccgggcggctgtggggacgtgtgtccgcgcccatgtgggtcggggtattcgtgcgcgttggagcgtctgcgtgtcctgtgtgtgcacgtgagcttgtccgtggtgtatgtttgtgtgcatgaccgtgtgactgtgccgtgcgtgtacaggcgggtcctggatattcgcgccgaacccagcactccggttcgacggggctgcagtttgcagggcccggataaccgaggcagtggcccctcccgcgtccccaggtttcaaggacgctaggactctccgcggccctgaggcttcgcactggggagtggggtgagatggggggaaagcgggagggggctcagggtccagaagggcgccgcggtctcgggagtaggggggcatctgcgtcccgcgggaggggctggggtgagagtgcggggccagtgcaccggtgcccgtgtatcgccctccccaggccgccaggatggacgtgttcatgaagggcctgtccatggccaaggagggcgttgtggcagccgcggagaaaaccaagcagggggtcaccgaggcggcggagaagaccaaggagggcgtcctctacgtcggtgggtaaggggcggggtttctggggctgcagggctgggggtccccgacagtgtggagctggggccgggtcccggggaggggggttctgggcaggagaatatgagtcagcagatggggcgaggtcagcaggggtcataggggacatagccagcccatagaagcctgggtctgtatccggaaatggggacacggggcgggctgatgaggtggggggctccagctgaaaggccagggaccagtgcagtgatgaaagcagacagcctcctttttcttatcttttttaccattattaatagttatctggtgttgaacactttctgtatgccaagtactgggtaaaatgtcataacatccatttcctcatgtaatgcttcggcccattctacaggtaagggaaactgggcttcccagagatataagtaccttgcccaaggtcagcagctggtaaatgctgaagctggggtttgaacggagctttatagattctgaagccccacccctccccttgtggcacctccctccagcacctccaaggccgagttgagttgcgttccaggtccacctgcatcacaactcttgtggttttacctttgccagctctcttccccgtccactttccttgcaaccactggctggtatcagaagaaaggccagggttggataacttgcccagggtcgtggcatatttggattgtggccatttgaaaaatattttgtgtccacttactatgtgccaggcatcctgcggatgctggggtttcacagtgaacaggaaagaatggttcctgatctcctgatggtgatacagagcatttcagcagtgcgagttgacatccagtggctccctgaagagaatgcctcatccctgagtaataagaggggggcagggctgcagaaaagccaggtgcaaaggccctggggtgagctgggggcagggcaggaagtagtggtaggaggtgaggtcagagcgatgggcaggagacagttcacgagggccctttgcaggccagggcaaaacgttgttatgatggccacgagagactgtaagcaagggactgccatgatgtgattagtttagaacggtcacttgggcctctggggacagaaaaactgcagggaggcctgatgaggccacaggatgagggtggcaggggcgagggtggtggcaatggagaccgggagaaggctaaagtgcatggctgcttgatcccagctctggcctccctcctgcctcctccccagggtctttcattcctgctggcctctggctctctgacactctctctctgataatagacttggcccctccaagccatgctgctcttccccttagattggcacttcctgctcctgcctctgcctgggagcccctgatggaccccagttcctacaagttaaagcctcggctccctgtaccctggcattcagtgcccttcatggtcctgcctcagtctacatttcccaccacacccatggctcctggcacatggactgtcctgaaagcacattgctctgccttgtctgtgtgggtccctgggcctgggataccctctgcagtctcctttctgatgtccatctgttccccatttctcaaggcctaggcagtgtcccttccctcctcacatagtcagtccttggaggctggaagtcctctccccactacttgaggtccaggaactgaatctgttcttctcttacccacttcagacagtgagcgattggcccagggcctggcacagagtaggtggaagctgatgttttgtgggaggagtgaaaggggagcatgcagcctgcccctcctgtctctgggtgctggttggccttcgccctgagaaccctgtcttcccacaccagcctcttcccccacccccccgccaggctcagtctgcctagacacccagttctggctccatcactgttgtctgtgttgccaaattgtcagacgggatactccccaccccgtttccgtctctcatcctccagcccagatcaggccctctggccttcccagcggcccccagacattttgaagttatcaagttgctaccctccgaggaaggcccagccaatgccacgggtgccagttacaatctgcacatcacctttagacccaccctgagcctgacaccccctactttggccagaagaaggggtttgcaccctcgctaggagaagagaatctttagaggaaatggagtggggcagtgggctatgggcagtggtgcatggggcacgaggggaacctttcaaaatacatggctttgtggcctcccagctccacccctactcccacccccacctgcctcctatcctgggctacgtgctgtgagagtggttggtagctaaagttttagggtcagaaaggcctgaacttgaatgtcagttcagccacttcctagtggtggaacccacactgagcttccatccgtgaaacggggacaataacagcacccgcctcccagggctggggaaaagtgaagtgcagcggggcaggcagaggacttgacacagcactggccctcagccaacatccactagaggggtggggtatcgcatcaggtgggagagaactgcaacccttgcagacagaggtgtggggcccagtgcagtgataagacgggggttaacatgggggtgcaggttgtaggatgtggggacccaaggaggcagtgacggggccaggatgcccactctgtaatcaccatgctgtgctggagtttctgttccctcagcgcagagtccttaaatgtgccgctttttctccctgcaggaagcaagacccgagaaggtgtggtacaaggtgtggcttcaggtactagcccagccctggcaccagcccttctctcacttaggcggatgatctggccgggaaccagagggcgggggcgggggagactcccaaggcttctgcgggaatgctccgtggggagggcaggccctgggatactacaaggcagggcatcggtgtttccccctggctcccaaaccccttcctcaaccccctccctgctccagtggctgaaaaaaccaaggaacaggcctcacatctgggaggagctgtgttctctggggcagggaacatcgcagcagccacaggactggtgaagagggaggaattccctactgatctgaaggtaagcgatccttctgacccgcacatgcaggcaaacacacacacacacacacacacacaccaggcacacaaataaacctgtcaccatccccgcccccctaatcctgccaccagcttggaacacaagccactttgcctcccatcctgcaggcccgtgctagactcagctcagaatgcatctgaataaaggcgtgcatgggtgtgacgctcccggtgatggggacccagacctggctgtctgcgtgtatcctgcttgccagcgtgacccagatgacttctggccacgtctgcatgtgtcaatgattgttcattcatttcttttcattcaacaaatatccatgccagagaggaattgttgtagaggctgccgcagtgaataggttcctacgttcctgcagctgacattgtagtgggagaagatagtaaaacgcaagccagcaggcaggatgctttccgcggggataagtgctacagagaaaagacagagagggcgatgggacagacaggcaaggggtgagagggctattttggctgggaagacttctctgaggaagaaccatttgagctgacacccaagggatgagagaggcagccttgagatgtgtgggaagcgaatttcaggctgtaggaacagcaagtaccaaggccctgaggcaggttggagcaggtgggagctgtgctggggtgggtgtgatctgtgcagttgtgtttccccaggggagccctgggaaccactcatgtgtgcatggagacagatccccctactaggaccccctgataagagggggttaagagttgtgagctctgaacccacctacccccagcctcagctgggtttgaatcctaactccactacttcctggctgtgtgaccctgggcagttcccaccatgtctctgaacttgatagttcacttgtaaaatgcgagtgaacacaataggaatctcatgcagattggagataatatagatattctcaaagcttgagtgtgtatcaatcaccaagaggccaggttaaaatacagattgttggccccatcgttagaatttctgattcagtaggtctgaggtggggctggaggatttgcatttctaacaagtacccgggtgaggttgatgccgcagttccagggagcatactatgagaaccatggatataaagagctgggtttgcatacagtgaatgccctgcaagagattgtggccacatgatcactcaagcagtctgggtctgcctgcaggggatcctgtgaccacaggcgtgcctggaagtggatcccccatgacatgtgtgtgcaggcattcgctgtgaatgctctgtgtctgtccatggacgcgtgcagaccctgcctccatggggatgggggctccttctgcagcgtctggtttgggtgatcagtgtacgttcagcatgagtgcatccaccaggctgtgggagaccccacgctgccctccactcctgtcattttgcacagttggttccttccactgttggaagtcaggatcttgactcagaagttctagttcaagccctgtctctgcattttactatctgtatgacttcccatttgtttttttttgtttttttttttttttgagacggagttttgctcttgttgcccaggctggagtgcaatggcacgatcttggctcactgcaacctctgcctcctggattctagcaattctcctgcctcagcctcccaagttgctggaattacaggcacccgctaccacacccggctaattttttgtatttttagtagagacggggtttcaccatgttggccaggctggtctcgaactcctgacctcaggtgatccacctgcctcggcctcccagagtgctgggattacaggcatgagccactgcacccggccatgacttcccatttcttataatcatgttaccaataatcacttccattcattgatctctttcatgagcaggcactgtcctagatgtttgactctagatgaactaactcattgactcttcccaatgtggc

SEQ ID NO: 14669 - DNA, 5972 bp, Human
ctcagttaagtggtaactgtcttgatgactctcaggtctcagtgcccacattatacaagcggctcagcaaccagacccaggatggggagtcactgaccccctgcgcccatggcaggggtgagggtagggacacccccataagatggagctgtgatgagaagcaaacccaactcagtttggtttcatttacattaaaaaggcaaatcccttggccggatgcggtggctcacacctgtaatcccagcactctgggaggcctaggcgggcagatcacctgaggtcaggagttcgagatcagcctggccaacatggtgaaaccccgtctctactaaaaatacaaaaaaattagctgggtgtggtggctcgctcgtgtaatcccagctactcaggaggctgagtcaggagaatcgcttgaacccgggggctgggtggaggttgcagtgagctgagatagcgccactgcactccagcctgggcaaaagagcaaaaaaactgtgtctcggaaaaaaaaaaaaaaaaaaggcaaatcccggccgagcctttggctcacgcatgtgatcccagcacttttgggaagctgaggctggaggatcacttgaggtcagaagtttgagaccagcctaggcaacatagcgagacccccatgtctacaaaacaataattagccaggaatggtggatgagcctgttgtcccagctactcgggaagcagagacgggaggttcgcttgagcctgggaggtcgaggctgcagtgtgccctgatcgtgccactgcacgttagcctgggcaacacagcaagaccccgtgtcttaaaaaaaaaaaaggtaaataagagttggggacacttttctgcgagttggagaaaccaaaccccctcgacgagtcttaagtagtattctcaggttgtctggcctgcggccgcgctgctgtcaaccagccggataactgcgctgcctcccgacgcgccgccagccaggccacggcctcctagacacaagcgagcatgcgcagtcgccaacaacaagtccgcacgtccggtcccgcccccccttccccgccttcttcccactccggcctcccattggctgacgtcggcgcgagcgctcaacaccgacgcgtctgaccaatgagcgctctggagggcgtggccgtgggaaaggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatggtgagctagcgccgcggccgttgccggcccggtgaccgttggggcgggcgcgcgatccctgcctccgctcgccggcgtggggaaccctcaggctccagtgaccttggtggggggcgtctgggggctccccctccccacccccggccgggcacggacgcgggtgaccgtactgcgacgcgctccgcggccctccagaccgttgtaggcgcgcgggctggggtcggggaaggggaaggggttgttccacgcgcgcgggtcgtggtcggggaaggggccgtccaggccgttgcaggcgcgcgtgccggggccggcgtcgggggtccaggcttgcagggggcgggggtccgggacggctggggcggagctggaccgttgagggccacggcggggcgtctccgggccgagcggggctgctgcgcccgagcggttgggggcgcggagggctggaaatcccggatcacgcgcccccgggcgccgccccgcccccgcaccttggcctagcgcggtggcgtcacagtcgcgcagtcctgactacggcctccgggccctttgtccccgctagcggcgctcggggtgggggagccaggaggggcgggagacgggcgggtatgggccgcgcgggcgcaggctcccccgggcgccgcaggcagcggtgccagagccggggcaggcggcggccgcgagcccctcggcggcggaaggccccagcgtgcaggcgcaggagggcgcggcgccggcggaagaagccctgtccccgcagcttgcgaccggagatccacgaatgtcccaagtcccaggacccggtgcgcgcggggcccccacaccggctaatgtggcacattttggggttggaaccctctcccggcctccgggtctccggtaaaaccggaccagaagtacaagggggcgtgtgcgtttaaggaggaggagcgttcaggtcttcagggccgcagggcctcggtgtccccgccaccgacccgctcccgatcccttcctgcctcagggtcccgggctcagcctcccgtccacgctccctgctcagcttcctttgccttgcagtgcgcgtcccgggacgactggcgctgtgcgcgctccatgcacgagttttccgccaaggacatcgacgggcacatggttaacctggacaagtaccggtgggcgctcgcctggggtggggcgcggggtcgggccctgggagggggccgtgttcttctgcgctgacgccgccgatcctcgcaggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggtgggctgctgcgtccccggggcccgcagaggcgggtgggtgggggtcggggtgggctccagcctggagagggcctgggagtgtgcagggggcccggactgagggggtgccagcccccgactcactcacacaccttggccgccacaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaagtgcgtgacctctggggacagtacggctgctggggtgggggtgggggggctgctgggatgctcacacctccctggggcagaatggctcatggctcggggggcggttgcggggaggtgctgggactctcacatcgcgtggcctcctgggggtaagatggctcagggggacatagagggctgtggaggcagccagggatgcccacacctttgtggcctcctggggacaggatggctcgggggcctgtggggggctgttgggactctcacactgcatggcctcctggggtaagatggctctgggggggcttgggggcactgtggctgtggaggcagccggggaagctcacacccttgtggcctcctggagacaggacagcttggggactgtggggggctgctggggacgctcacgtccatgtgcttcttttccagtgccatcaagtggaacttcaccaaggtaagggggctgtggggggtaggggaccagcttcccctggccacagccgtggcccagatgggcagcggacaggaagggcagcctcagccccttgcaggggtggccccacagtttggacaccgtctctccacagttcctcatcgacaagaacggctgcgtggtgaagcgctacggacccatggaggagcccctggtaggtcctctctagggagcccgcttgaggctcgggggcttgggaggtagctgccctaacccagctttcctccccgacaggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctggatctttctgcgtaggggcttggggggcccttttgccaggggcccctccatgtcagggccagttgccgtcagctgccaggctgggggtgccatggaggtggcgtgttgttgccccctcttcctccaggctcggggggctgtgctggctgcagtgctggggtgcagtgagatctgggcccgttggacacccagccctggctcttaatccgtgcagccccacctgctgtgcacaggcagggcctggtgtagtgccgagtcttggaggagataattctaagtggctgtgcttcctggccccgggccttaactgttaggaggtggctactggggcctcccctggccaggaagcagaagtgcagaggcccgaggaacagcgtggccctggtgctggggatgggttgggcacccacaccggcccttggggcctcacctggctggggggtgtgggggtggctgggtggttactgtttgcacagagtccctccgtgagggctggggatggacaggccaggaggggctggtagagcagtaccagccaccgttcatgggacccgggggctgtctggacacggcctggctgcccacctgcacagctagagggactgcagcctgccagggtggctgatcccagctgcccccactgggggtctgtggaatggacggtccatggcacctgccccagacactgggttgagaggtctgtctctcccagccctcgtcccctctcatccacatggggccagcacaggcagtgggcagaaaggcctggtaaccaggagagcctggggggatgcccacacacccctgcccttccctccctgtcccacaggctgaggagcagactccgtgggaagtaggcaaaaggcacatatatttaaaaaagtcctttacatatgtacatcagaacttgctataaatacatagaaaccgcaggcgccaccctgccagctccgcggcctggggcctgggagaggtgagcgggcaataacttaggggtcagggaagggctgggggagggagaattgcatatattagcaggggtctgccccacggagcccccgagacgcggggccctgagcacctggggtttcctgagtttctagctcttgggaccacccggtttcacggatttcaagggtttgggcccactgagcccttgtgggtgcccagtcccagagcagccacccggagccccttcctacttgggaggagaggcacagagagggccctgccacgccccggcccccagctgtcctgagtgggccccgccagggctgaccaggtgggggcccgggtcgggcgctgaaggcactgcggccagggcctagggctcctctgagcagtggtcaggggaccttggccctgctccccaccgctgctcctaggggagaaacggtccctgtgtcttggggcatgtttcgcctaaaggcgtgtcagagaggagcctgggcgccggggaagggtgggctgaactggatcacgctctgccgctcgggaccaccgcccgccgcgccccccgcccccgcgccctcccccagcgcgccctcggagggcggccccgcgtgcagcgagcgcagcatgtcctccagcacctccttgaagttgatgtcgcagccctggtgcgcgagggccgcagggtcggcctgggcgtcgggggtgcccagcggcacgacgccggggccggcgtccagggacagcggcgccgggaaagagaagtgcgggggcggcgggaaggcctcggccggggggctgtaggtgaggtccagcacctctccggggccgcaaggcagcgccagcgggcgcggggcgggcggggcggggcagcccagggcgggcgcctgcctgcgcttcacgtccgcatccatcagccgcagctcctgcagcacccggcgcacgcagccctcggggatcttgatgcctgcgggcagagcgtcggggtcagggccggcgctgggggctcgggccttcccggggcgcccgccgcccactcacc

SEQ ID NO: 14670 - DNA, 21196 bp, Human
ggagtctgggaagtccaagattgaagggctgcatctggtgagggtcatctggctacattataacatgatggaaagcatcacatggtgagagagagcaagagaggacagaacttacttttataacaaactcattctcacaataaactgctcccttggtgataacattaatccatttatgagggtacagccttcataacctaatcacctcttaaaaggttccacctctcagctcgcagtgagccgagatcatgccactgcactccagcctgggtgacagagcgagactctgtctcaaaacaaacaaacaaacaaaaattccacctctcaacactgttgcattgaagatgaaatttccaatacatgagctttggggcacacattcaaaccatagcaatagttcaattactttaaagcccaaaatgtcagtaattatattaaatgcaatttaatacatcagtaactaaatgagatagactaaattttatgataatcagactaatattatcagactagacttcaaaacaacccaacaatcatatgctgtttacaagagacacatttatggatactaaaaggtataaagtgaacagatgcaaccatttatcaaaagaaagctgttgtggcaatattactattagacaaaatagaattaggaaaaaaatcataactgtagataaacgtttcactaagttaaaggtttcactgagaagaaataaaaattttgaatttataagtacttataacaacattaagaaactagaaaatagaaaaagaatagagccaaattgactgaactagaaaaatagaaaattcatagaaaaatccacaatcatagtgggagattttatcatacatctctcagtaactgatagaaaaaccagacaaaaatcaataaggataaagaaaatgcgaacacaatgtagttcacataaggaacctatactacttccaacagcagctgaaatcacagagcatacttaaaatctgaccatatactggctcatagagtaaattgcaatacattttaaagaatttaaatcatacagaatatgtcttctgaccataatgcaattaaagtagaaaagaacagaaaaacttatagaaaattctcatatatttggaaattagtaaatttctaaataacccatgggtcaaaaaataatcagaatgaaaatcagaaaatatttttaatgacttatgaaaaaaattacatataaaaacttgtcagatgcacctaaactgttgcttaaaggaaacttacaaccttaagtgcatatattagaaatgaagagtgacgaaaaatgaatgagcaagcaaataccttaaaaactggaaaaggaatagtaaaataaatccagagaaatcagaacaggggaaataataatataagaatagaaattaatgtgctagaaaataggggatctatcaagtcagaagttgattttttgaaaatgctaataaaaatgatgaacctctggcaagacaataaaagctggtacaaataactcatctaaggaataaaattgaggacctctcttttgttaaatgacataagcaggaggccattatcctgagactgtctctacactttgagttcttacataataaactgcaacctaatttagtatactacataaacaaactgaaacctaacttaggagtctttttttttgtaattaatagctaaatttccaccaaatcataaatagccaagctttagccaatcacaggcagccaactgatcagactatgcccaaacaaggtaaatgcctattacaccatacccaaataaggcagactcctagctgaagccaatcaggtgattactatgctcttgtgtttggcctataaaagctcactgctcacactgttggatgctctctgaaacttttgtgaatctgagtgctgcctgattcatgaatcattctttgctaaaataaactctgtcaaatttaatttgtctgaagtttctcttttaacagtgtttggtgttgcaagcaggatccaaaggagacctatagtgactcccaggagctcttagtgaccaagtgaaggtacctgtggggctcattgtgcccattgctctttcactgctttcaactggtagttgtgggtaagttcctgctcagacttgagcactatacatttgcattttcagctctctgactttatttgagcaattctttgatggattggctccagaattggattggattcagtgaagaaactgaaactggactggtgctctaggaggcctcaagtagataaggttactagaagacagggaatcctgggcttatctggatttaaggagtctacaactccatctgcaactccagccgatttcatttataagaattatggaccaagaacctgtgcttttctagagaaatgtgtgagccttactaaaggtaacttagaattacaatggactgctgagaccagctcggtcgtggagaccctaacccagcagcgctagaggaatcaaagacacacacacagaaatgtagagtgtggagtgggaaatcaggggactcacagccttcagagctgagagcccctaacagagatttacccacatatttactgacagcaagccagtgataagcattatcgctatagattatagattaactaaaagtattccttacaggaaacaaagggatgggccgaaacaaagggataggctctggctagatgtctgcagcaggaacacgtccttaaggcacagattgctcatgctattgttgtggcttaggaacacgttaagcggttttctgccctgggtgggccaggtgttccttgccctcattccagtaaacccacaaccttcagcgtgggcgtcatggctgtcacaaacatgtcacagtgctgcagagattttgtttatggccaaatctggggctagtttatggccaggtttgggagcctgttcccacatgtcccccttttttgttttgcaaagcaataaaagcaaaggcagctttgtcacagtgagctacttcttgcaggagtcgggattcgcatatgcatactatacaaagacaaacaacacagattaaaagcacaaccatcattgaaatcacagagcttccaagtgtctttatctattttaatgggttaatcactgctaatctgtctgcagctccttcaagcactccagttcctggcattaaggtctggtgtgcctggaatgctttaaatatttgttcttttaatattgcaatatggaaagacaagtttgtagagtgtcttctaggtgcttttttattctttcctgaatttggtcttatttaagagccattaatagtttccacaaatccttatgtttagctcctacagcgggccatatcatttgagggtgaggtgccactataccatcatgtttccagataataggaactcttgccatatttcttgctatttctaccatctgaccattttgtttagaccagctaaacatagtgtggccatggcacgcagactgagaggtgcaatttaagctaaacatccccttaggggaccaatcaataatgattccataggaatcactgcgcagcacctctgcctattctgcaatgcaatcttcccaaacaagtatgttcattatttctggccaggtccaattctgtttacaaataggtttttgagggcaatatgcctcaattatagaaacagatttattatggtaaatactgagatcagaaagcatgtgtaactgtgtcatagaatgattacatccaggcattattgccagccaagattgataaatatgcccaataagtataattgttctctgtgttagcccttgttgaaggaatactaatggcaatggtgatcactgctatcatagctatcattaaattactcattgtgactggttgtcccactttcctcaggttttcttccaccctctatggcagtttcttgatctgtccccaggtagatggctgtgtttgatggttgttgctcgtgatagtttgggtcctcctcagcatcagtctcgacatggctgcaaccagagggtcctcgggatcctcccagaatctcttccttggcatctggctcatgataaggtttcaggtgtcttgatggtatccaaatcagctattgattctggcctggagaaacacaagcataacctctaccccaagttattattttacctatttcccaactttttgttgtcagatctctgcaccaagccagttgttctgcttctgtttttgcagctggtttctgtagatgctcttcagctgctgatagcatctggcctttaggcaggctcaaaaaatttaaagtcattaatgctagattcagttgtatatggggtgtcctgtaatccctgtttcccctttttgcttttgcaactgctgtttcagggagagattcattctttctacaatggtttgtccttgagaattatatgagatgccagtaatgtgtttaatattccatatagagaaaaatgtagctagagcttggctagtatagcctggggcattatctgttttaacagaagttggaattcctatcaccacaaaacactgcaaaaggtgatgcttaacacatgcagtctcctgattggcatgtagcccagacaaagtgagaaaaggtgtccacacatacatgtacataagctagtctcccaaacgagggaacgtgtgacatccatttgctaaagataattaggttccaatcctcgaggattaactcctcctgttaaagatgaggaatgcaccatttggcaagttgggcatcactggataatagctttagcttctttccaggtactgttatatctgcatttgagaccagaggcattaacatgggttaaattgtgaaagtgtctagcattagatattgcagtagcaactaggcgatcagccatttgattcccttcagttaaaggtcctggaagaggtgtatgagccctaatgtgagtgatgtaaaaagggtgcattctactcctaaatgctgtttgcaattgggtaaataaagtcatcagttgttcatctgtatgaagtcataactgagcattttcaattaattgtatggaatgaaccacataggaagaatcagaaatcacattaataggcatatcaaaagcagtcaatacctcaattacagctaaagctccactttttgagctgaagtatagggcgtgtgaaaaactttaccttttgatccagaataagaggctttaccattacaagacccatctgtaaaaacattctcagcaccttcagttggtttaaatttagttattttggggagaatccaattagttaatttcaaaaaattgaaataatttcattttaggaaaatgattatcaagaatacccacaaagtcagctaaatgggtttgccaagtaagactatttatagaagcttgctgtatttgtgcctttgtgagagggacaataatttttccaggatcatatccatgtaatttaacaatccgaattctcccatttcttatcatcgtagccatttgatccaaataaggagttagagtctgtgaattagtatgtggaagaaaaagccactgtacaaagtcctgctcttatacaataacaccagtaagtgaatgctgagttggaaaaattagcaaatctagggtcttttttggatctattctatttatttgaggtttatggacttgctttttgattagctgcagctctgcctcagcttcttttgttaattgctgagggctagtgagactaggatctcctctaaggatagaaaatagattactcagggcataggtgggaatgcctagagcaggtcatatccgattaatgtcccctagtaatttttgaaagtcatttaatgttttcaattgatccctacgtatagttactttctgtggcacaatggtagtgtcatttactaaggtccccaagtaggagtaaggagtagtagtctgaattttgtcaggagctatataattaaactggcatgagaaatcgagttttgcaagtgatcataacattggagtaatatttcttgagtgggggcagcacaaagtatattatccatataatgaataatgtaacactgtgaaaattttttacgagtaggttcaattgcttgcccttcataagtctggcaaatttttgaactgtttcacatgccttgtagcaacactttccaatacaaatgctttagtatgctgcaggttttttactgcaggaattgtaaatgcaaacagttcacagccttgctcagctaaggggatagtaaagaaacagtcttttaaatttatgactattaaaggccaattttttggaatcatagcagaagaaggcagtcccggctgcaatgtccccataggttgtataactgaattaatggctcttaagtcagttaacattctgcatttacctgattttttcttaattacaaaaactggagaattccaaggggaaaatgttgagctatgtgtcctttttctaattgttcagcaactaagtcctctaaagcctccagtttctctttactcagcagccattgtgctatccaaattggcttatctgttaaccattttaaaggtatataggttctggaggcttaacaatggccaccatcaaaaatgatatcctaaaccttggtgggaactttgtctttccgcttgaagcatttccttcaaagcttgcaaattttttcctagtcccataccagggacataccccatttcatgcatcatatgttgactttgagggctgtataattattctggaattagaacttgtgatccccattgttgtaataaatctcttccctataaatttataggtacagaagttataattttttgtatagtcccaggttgtccattgggcccttcacaatgcaaaatataactactttgatatactttaagggctttaccaactccaactatgttaaattgagcaggttgaattgaccatgcagatggccagtgctgtacagaaatgattgaaatgtccgctcctgtatctaccaaacttttaaatttctttccctgaatagttatttcaccagtaggatgtttatcagtaatttgattcacccaataagctgctttgccttgtttatttgtgcttccaaatcttcctgttcatttaatttcacttttccccatttccacatatggcataatcaggagctgtgctatatgctctcctggctctgctttccagggaacagaagtagatataacaatttgaatttcccctttgtaatctgaatcaatgactcctgtttgtacttgcacgccttttaaatttaaactagacctacctagaagtaatcctaccatccccgctggcatcatctgactggagacagcaaccttctttaacagtcccattacaaaaggagaacctgttccatatggattaatagcttgtttaaattctttgagtaatttaaaaggaaaaggctcaaatgtagctataatatttccctgttgatctacggggtatattctaacagggaactgctaagcctctatatcatcctctcttctaacttgctgaattcctggctgaatagaactgagagtggtcgctcgaggtgctgctcagtcactggggcgactactttttgcccagtgtcctctggaaaagaaagatctggaggatcaggctactctttttcttcgaaataatgagggggtgcagaagggtagggacaaacctctccctcctttgccactttagctttagctggcaaacaaacctgctctgtcacctcttctgttacttcattatactttccttcctcctcatctttagtgtgaaaaggttccaaggtggaatgagctagagcccacacttgcccattgttaccctgatgcttccgagctccccttcttactcaccatggggattgcttaagagtactcgggtatcctccagctttgttccacgttttccaaccattgctccagcgagccttcatcctgggtttgagtccccacgttgggcgccacttgccgagaccagctcggtcgtggagaccctaacccagcagtgctagaggaattaaagacacacacacagaaacatagagtgtggagtgggaaatcaggggattcacagccttcagagctgagagccctgaacagagatttacccacgtatttattgacagcaagccgatgataagcattatttctgtagattatagattaactaaaagtattccttacaggaaacaaagggatgggccaaaacaaagcgatgggctctggctagatatctgcagcaggaacacgtccttaaggcacagatcgctcatgctattgtttgtggcttaggaatgccttaagtggttttccatcttgggtggaccaggtgttccttgccctcattccagtaaacccacaaccttcagtgtgggcgtcatggccatcacaaacatgtcacagtgctgcagagattttgtttatggcaagatctggggccagtttatggccagatttgagggcctgttcccaacagtggacaaagaagaaaagctgcttaaggcaaacaggcacatattttttaaagctacaatagctagacaaactaagagaatcctgtgtatgttttacttttgtatttttatttttaatatttgtggatacatagtagatgtatatatttatggggcacttgagatattttgatacaggcatacaatggataataataacatcacggtaaaaggggtatccattacctcaagcatttatcctttctttgtgttataaacaatccaattaaaccttttatcataaaatgtacaataatgttgactgtggtcaccctgttttgctatcaaagaataaatcttattcattttatctaagtatatttgtgtacccattaaccatcccagtccccctgctcctccaactacacttcccagcctctgttaaccatcattctactctcttatctccatgagttcaattgttttaatttgtagctcccacaaataagcgagaacatgggatgtttgtctttctgtgccttatttcacttaacataatatcctccagttccatccatgttgttatatgacagaatttcattctttcttatggctgaatagtaccccattgtatatatataccacattttctttatccattcatgtgtaggtggacacttggattgcttctagatcttggctactgtgaatagtgcagcactaaacatgggcgtgcagatatctccttgatatattgatttcctttattttgggtatatacctagcagtgggattgctggattgtgtggtagctctactgttagtcttttgaggaacctccaaattgttctccatagtggttgtactaatttacattcccaaccaacaacagtgtacagggttctgttttctccacatccttgcagcatttttattgcctgtcttttggataaaagccattttaactggggtgaaatgatatctcattgtagttttgattagcatttctctgatgatcattgatgttgagcacctttttatatatctgtttgccattcatgtgccttcttttgagaaatgtctatttagatcttttgcccatttaaaaaattggattattagatttttttcctattgagttatttgatctccttatatattctggttattaatcccctttcaaatggatagtttgtgaatattttctcccattctgtgtattgcctctgcactttgttgattatttaatttgctatgcagaaactttttaacttgatgtgatcccttttgctcatttttgctttggttgcctatgcttgtggggtatgacttaagaaatctttgcccagaccaatgtcatggagagttttcttaatgttttcttttaatagtttcatagtttgatgtcttagatttaagtctttaatctattttgtttttatttttgtatatggcaagatataggggtctagtttcttccgcatatggatatctacttttcccagtaccatttgttgaagagactgtcctttctgcaatgtatgttcttgacacttttattgaaaatgaattcactgtagatgtgtggatttgtttctgggttctctattctgttctgttgttctatgtgtctgtttttatgccagtaccattctgttttagttactatagctctgtagtataattttaagtcagataatgtgattcctccagttttgttctttttgctcagaatagctctggctattctgggtcttttgtggtttcatgtaaattttaggattatattttattaacatatttctgtgaagaatgtcattggtattttgataggaactgcattaaatctatagattgctttgggtagtaaggatattttaacaatattgatttttccaatccatgaacatggaatatctttccattttttggtgtcctctttaatttcttgcatcagtgtttatagtgtttctttcatcagtgtttatagttttcattgtagagatcttttactcctttgattaagtttattcctgggtattttatttgtagctgttgtagacgagattactatcttgatttctttttcagattgttcactgttggcatatacaaatgctactgatttttgtatgttgattttgtatactacaatttcactgaatttgcttattacagagagactaaagatagttaggtccattaccaaatgtgttttctgtcacattgaaaaattataccatgagaaggcacatgcttctagtaattacagttcatagatatgtcaatgtacagaatgctgttgtgacagttcacaattgtttgctttatagttttcactggaaattaaattactaagggtaaagtaatcccagcactgtgggaagctgaggcaggatgattgcttaatgccaggagtttgagaccagctggggcaatgtagcatgaccccatctacaaaaaaaaaaggaattctaattaatatgtggtactagaattaccagaaataataagggaaacaactctgaaaagaaggtaagatgtgttttgggtaagaacagctataaagtatgaggggatgttttgttttgttaaggaaaaaataaaataatatttgtcctaaagtagaatgcctggttgttaagacaatgagaaagagaaagagtatagaagaaaaactgaatggatataagaaagttgtagaaggttgtgggataggaatcctggaaagggaattttatatgtgatcaaactaagatttgaagaaaattctaagtttttttttaaaaaaattgagcatgaatatcaaaaacatactgacacagaactagaaatttgtcctctatgttaaaacaacaaggttttcttggagtattggtctgctcttaataagaaattgaaagacttttctttacctgctaagtaattggcctaggaaatgaagattctgtgttttattgagataatttattgtgcttcatgttgtctttattagatctttgactgcctcagagacctgagttcaccttattaaaagagaaagagtttctacaattatgtggctttctttatttgcctttgaagtcttttaccaatcactctagttaaatgaataaatattgtttcatagggacctgtgatcctattttaatcagatattttaaaccttttgatatttttgacttctcaaaatcaaattctaaattaaaaccttttgacgttgaacaaactttggaagcttctagatgggcttctggaatatctcaaaagaaattgttttctctcctgataaaaaagagagatattaaactaattaggcttatttgatatgttatattgcatgggaagaattgttaaattataagtgatgctgaactttctttaagtcatattgtatgggtatgttattaatatgtgcttcagaaattatatgaaattcttagaaaccagatagtcgtggtataatactatcagccaaaattctaattatcgtgaaatattatgtgttgcagaagtaatacaatttccttatcaattgcattattgtgaactctcatcatatctttaaccaagtccattttaagctttgtcatctacaaagagtcacttgttttactctggtactttccggaacactgtgaaaaacaattatataaagggtgtggacctataagacaaacaaccaaacaaaaatcgcaaagtgttcttttaaaagtttcgtggaaaggactctgataagtacaggtttctgataactttaagatcatactactggactgggtaagaatttccagaactctagcaaagaagtggattggttcataaaactgccaacccaacatgaagcagaataagaattaattgaataccagggaaatgctttggcagattttcatgctaagtcagccagtactgaaattgttaagatatgcaatttgaaagaacactataatattcatctgaatcaaattatctatgataacctatttaaatgaacagcatcatgcacctgaattggagaaacaaaactgatatttaaaatgatataaatttagtgttaaatgtggcctcatggatcagacagctatctggtcctttctgagtccatatagctgccattattaaaagttctgcactctatgactcatcacagaatagataacgtgaaattatgaaaaaatattggtgttatgactgttctaaaattgctaaaatggcttataatcaatgtttggtttgtcaaatccacaatttttataagataataaaaacctcagttggtacatttccaccatccactggactatttgaacatttacagatggattgcattcagttgcctcattgggaatctgcaggaaacttaagtaaatgctggatatgtcatgttgaaccaaatactaatatgcttttaaagatcttctaattcaccctatagcagatttcactgatattccaagtgtgactacctgttcaaattgcacatctggtctttctatagggttaggctttttgagtcacatattcagatttcatgtttaaagctaacagtagacaaaacatataggagaggctttacagttaaattattccagaaactgaataataaaaccaaaaggagagataattagacagtttgtagacgaattcataaccctaattctctaattgttggtagcctccattgatgataattaatagtggagccttagataaatactactattgcttccccgttgatgacccctgtagcacacagtgtcccacagggaactgtctcttgtgcccctctagcatatatttttatctatgaaggatttaactatcaatcataggcacaggcaactccatgtcccagtcagtaggaaataagaagtcagtgtggattagggattctaacagtaccactgtcactccataaccaactgaaaatttgacattgttctatacctcttaatttgcactatggtataaaaaggaactttctagcaggtacgaatccctctaaatgggcatcttttgttcagatgctccttccctggcttggaataaatgtaaatgaggttatgattagaaatccccttcaaacattagctactacagctcactctactgcaaaggctatatagttgcccagtgaagttctctaaattctcttgctaaagtttctttaaataacaggattgccttgaactatctgttggtttgtagtggggcagggggtgtgataggggacactgtgtataatagctaatacatcctactgcacttgcataaaggaatctgttataaagaaaatgaaataaaggtataaaagttggcaagaagaaaaccatcattatgtcttgaggatgattggggatacagaaaatgagaagaatccacaaactattagaattactaagttaatttagcaaggttgctcaatgcatggtcagtatacaaaatttaattgaatttctacatatatgtatatgccatattgtgttagattgttttgcattgctataagggaatacctgaagctgggtaatttataaagaaaagaggcttatttggctcatggttctgcaggctgtacaagcatggcactagcatctgtttgaccttaggaagcctttactcatggtggaagaagggggagcaggcatgtcatatagtgagagagggagtgagagggagggagcaagagtgaagggggaggtcccagactctttttaaataacctgaaatcctgtgaacagagtgaaaactaacttattaccatgaagagcacaccaagccattcatgaggggtataccttcatgacccaaacgctttccaccaggtcctaccttcaacactggggatcacatttcaacatgagatttggagaggacaaacatccaaatcatatcacatatataaatatgtaaaactattttaaatgtttttaaagtatcaaatagaaataaatctcacaaaatatgcttaagaactttaagcaaaaaccataaaatactattgtgataagttaaagaagacctaaataaatggagagatctgtcatgctcatggattggaagattcaatactgtaatgatatgaatagttcccaaattgttctatagattcaaaacattgccagttaaaatctcagtggactttgtttttttgaaactgacaagctgattctgccatttataataatattcaaaggggcaagaataaccaagacacatttgaagaagaacaaggaggaagaagaacgtatttgaagaagaataaggaactctattaagtgtatatctcctatatattgagatacacatttgaaatacatctatcacctagatattgagatatattatacatttaatatagtgtgttgctggtatagggatagaaaaatgaacattggatcagaatagcactgaaacaagatctacccctatatgggcatgtccctattaacaaaaaaatattgttgattatttccgcaagatgatctgtaaaaaacaagttaattgaacatccatatgggaaaaaagtgaatccttctgctacctcaaatatcaaccccaggtagattatagatctaaaagtgaaaggcaaagcaataaagattttagaaaataacaaagagaatatctttatgaaaatacaggaaatattttaaaaataggctagaaaactcactattaaaatatataaaatataagaacatctgttcatcaaaagtactatagtttgaatagcagtgtctcctccaaaattcatattgaaacttaatccccattgtaacagtactaatcctaaaactaagtattaagaggtgtgacctgtgggaagtgactaagtcatgaggggtctttcctcaggtatgggattagcatccttataaaaggccttgagatggaatgtagtgcccccttgccctcttgcgttctcccatgtgaggacacagcaacaaggcaccatcttggaaggagagagaagccctcaccagacaacagtgcacatgccttgatcttagacttcccagcctccagagctataataaatacatttctgttctttataaattacttggtctctggtattttgttatagaagcactaatggactaagacaaaaagattccattatgaaagtgaaaaggcaaccgcagagtggcagaagcttttggagatgatgaatatgtttacttcctggattgcggtgatgataccatgagtgtatacatatgtgtgtatacataatgtatacaaattgtgttcattgattatgtacagtttctttgtataccaattataccttaataaagctaaggaaaaaaaaaagaaaatccagaataaatatgcatggtatgacccatttatttaaaaaaaaaaagagggaatgcgaagcagtggttttggtgcgaacacaaaaattctggcttcaacagcatttaaattcccaaaccaagcatgtttatgttttaattctttgtggccataaattgtacagctcaggcctttatagtctctcagattctgtgaatgtggggaattagttttactcataaaaagttttgttcttggggataaattttttaaaaaaatttttgtatagttagcacactgagaaaatacagacaaaggcatacagatgcaagaaatgaggtagctgaatagaccaaagaatgatatagggcccagaaggtaggcaaagagaaagttgttgggtttatggttacaagtaaactagcagttgtggtgcagatagttttatttcccccacattaatctgaacagcccatccagacttaaacactgctttttgcatttacttctaggcaggaagacagggttctgatggtgtgagtctccttcaactcagcaaaccaccttggtctgcctcgagtttccaacacccctcctgcctgctagtgataggtgtgaggcaggttgatgaacatggaacttttttcttttggtcccaaagcatgctactcctggagtttcattcagtgaatgagaactatagtttggttctgtgagatctctatgaatcaaggcggccactgaagcggagaaaagaaatgcttaaatgttaagaaagtttgaagtgcagaaaaaggtgattgtaaatccatatggttaagcttagcccatttcttaaaaggcttgattgctcattcctccattcattgatttactcactcttccaatccatgttattgagtcttgctctgtaattccggatggttgtgcttttaagtactgcatagtggttgtatgtctgtgttagcattgctgaatgtatcagggaattcatttttttatccccattcattcgttccattcatctgtttctctctctctctctctttgtgtgtgtgtgtgtgtgtgtgtgtgtgtgtgtgtgtgtgtgtgttatgcctagaaaacatttctcaagaattagaattacgatatgctgtcaaacacaatgacttatttgaacctcttttatttgtaggttgaagcactggacaatgccacatactttgtggatggtgtgggtcttgggggtcatcatcagcctctccaaggaagaatcctccaatcaggcttctctgtcttgtgaccgcaatggtatctgcaagggcagctcaggatctttaaactccattccctcagggctcacagaagctgtaaaaagccttgacctgtccaacaacaggatcacctacattagcaacagtgacctacagaggtgtgtgaacctccaggctctggtgctgacatccaatggaattaacacaatagaggaagattctttttcttccctgggcagtcttgaacatttagacttatcctataattacttatctaatttatcgtcttcctggttcaagcccctttcttctttaacattcttaaacttactgggaaatccttacaaaaccctaggggaaacatctcttttttctcatctcacaaaattgcaaatcctgagagtgggaaatatggacaccttcactaagattcaaagaaaagattttgctggacttaccttccttgaggaacttgagattgatgcttcagatctacagagctatgagccaaaaagtttgaagtcaattcagaatgtaagtcatctgatccttcatatgaagcagcatattttactgctggagatttttgtagatgttacaagttccgtggaatgtttggaactgcgagatactgatttggacactttccatttttcagaactatccactggtgaaacaaattcattgattaaaaagtttacatttagaaatgtgaaaatcaccgatgaaagtttgtttcaggttatgaaacttttgaatcagatttctggattgttagaattagagtttgatgactgtacccttaatggagttggtaattttagagcatctgataatgacagagttatagatccaggtaaagtggaaacgttaacaatccggaggctgcatattccaaggttttacttattttatgatctgagcactttatattcacttacagaaagagttaaaagaatcacagtagaaaacagtaaagtttttctggttccttgtttactttcacaacatttaaaatcattagaatacttggatctcagtgaaaatttgatggttgaagaatacttgaaaaattcagcctgtgaggatgcctggccctctctacaaactttaattttaaggcaaaatcatttggcatcattggaaaaaaccggagagactttgctcactctgaaaaacttgactaacattgatatcagtaagaatagttttcattctatgcctgaaacttgtcagtggccagaaaagatgaaatatttgaacttatccagcacacgaatacacagtgtaacaggctgcattcccaagacactggaaattttagatgttagcaacaacaatctcaatttattttctttgaatttgccgcaactcaaagaactttatatttccagaaataagttgatgactctaccagatgcctccctcttacccatgttactagtattgaaaatcagtaggaatgcaataactacgttttctaaggagcaacttgactcatttcacacactgaagactttggaagctggtggcaataacttcatttgctcctgtgaattcctctccttcactcaggagcagcaagcactggccaaagtcttgattgattggccagcaaattacctgtgtgactctccatcccatgtgcgtggccagcaggttcaggatgtccgcctctcggtgtcggaatgtcacaggacagcactggtgtctggcatgtgctgtgctctgttcctgctgatcctgctcacgggggtcctgtgccaccgtttccatggcctgtggtatatgaaaatgatgtgggcctggctccaggccaaaaggaagcccaggaaagctcccagcaggaacatctgctatgatgcatttgtttcttacagtgagcgggatgcctactgggtggagaaccttatggtccaggagctggagaacttcaatccccccttcaagttgtgtcttcataagcgggacttcattcctggcaagtggatcattgacaatatcattgactccattgaaaagagccacaaaactgtctttgtgctttctgaaaactttgtgaagagtgagtggtgcaagtatgaactggacttctcccatttccgtctttttgatgagaacaatgatgctgccattctcattcttctggagcccattgagaaaaaagccattccccagcgcttctgcaagctgcggaagataatgaacaccaagacctacctggagtggcccatggacgaggctcagcgggaaggattttgggtaaatctgagagctgcgataaagtcctaggttcccatatttaagaccagtctttgtctagttgggatctttatgtcactagttatagttaagttcattcagacataattatataaaaactacgtggatgtaccgtcatttgaggacttgcttactaaaactacaaaacttcaaattttgtctggggtgctgttttataaacatatgccagatttaaaaattggtttttggtttttcttttttctatgagataaccatgatcataagtctattactgatatctgaatatagtcccttggtatccaagggaattggttgcaggatcctcgtggatatcaaaattcatagatgatcaagtcccttataagagtggcatagtatttgcatataacctgtgtacattctcctgtatactttaaatcatctctagattacttatgatacccaatacaatgtaaatactatgtaaatagttgtactgtctttttatttatattattattgttattttttattttcaaaatttttaaaacatacttttgatccacagttggttgacttcatggatgcagaacccatggatatagagggccaactgtaatctgtagcaactggcttagttcattaggaaacagcacaaatgaacttaagattctcaatgactgtgtcattctttcttcctgctaagagactcctctgtggccacaaaaggcattctctgtcctacctagctgtcacttctctgtgcagctgatctcaagagcaacaaggcaaagtatttggggcactccccaaaacttgttgctattcctagaaaaaagtgctgtgtatttcctattaaactttacaggatgagaaatactagagggtgtattttcatgtgatctggatctgtctttctggctattagataggtttctccagccatagttacttgagagagtgagtacacagtgcaaggtacagtaaattatgtatttctgtaatttaacaaaataaatactcagtttaggagaatttgaaagacacttcccacatccggactctggtcttcctcagcctctaactaccttttgagttctagttattgtccaatcactctgactctcagttcctgttttttagcctatatctcctgcatcttgttgctttttccttcttcgaaaagtcttgtttttaattctaaaaaagcctgccctttttccccttctgaatattttaaaaagtacatgtgagctaaatagatttttaagcaaatatatacctagagtttcctcataatgactcaaaaatagtttgatacacagtaatttaaaggtagatactactaccatatgttaattttgcaatctaggtataataataccacacattaaattttgatgcaactttctttggtaagcactatttgctgattctatgtaactttcttaagctgggaaccatgtgaaaggaagtgagcctttgacccctgctcaattctcaaccagaactgggtgtatgtggttaattgggcactagagtcagaaagacctgggttagtagatgtgtaatctttggcaagtcagttgacatgacccaaaaagtttttctgtctttaaaatagggatgatgatctctatatcctaagatactgagagtatgaaatgtaggaatgtaagtaaaccatgagcctaagctccttgattcccattttctctggaggggtgttgagggcaagagtaccacgcctaagagaatgggcactatgggttcgtgtgtggggtgagggtgatgtctgtagtagatgttagctattattattattttccaagaagatatttcattcccttatatattatggcttgtaagtggatatttttctgttatggatactagcagggatataagggatcctg

SEQ ID NO: 14671 - DNA, 5932 bp, Human
gcaacccaaaactctgtgcccattaatcggtaactccccattcctccctacctctggcccctggtaaccaccattctactttttgtttctatgaatttgaccactctaggtacctcatttaagcagaatcatgtaatgtttgtctttttgtttctggcttatttcacttataatatttttgaggttcggtgggcacagtggctcacgcctggatttccagcactttgggaggctgaagcaggtggatcacctgagtttcggagttcgaaaccagcctggccaacatggtgaaaccccatctctactaaaaataataaaagttagccgggcgtgatggcgggtgcctgtaatcccaactacttgggaggctgaggcaggagaatcgcttgaatccgggaagtggaggttgcagtgagctgagatcaggccactgcactccagcctgggcaacaagagtgaaattccatctccaaaaaaaaaaataaaacaataataataataatatttttgaggttcatccaagttgtagtatgggtcagaatttcattccttttaaggatggataatactcattatatgtatgtaccacatcttggttatccatccctcagacaatggacacttgggttacttctaccttttggatattggcaaatatttcatttcctttgggtatatatttatttcctttgggtatttcttttgggtatatatccagaaatagaagcagtacacaggggcttcattttctctgtctctttgccaaccttgctctgtgtgtgtgtgtatgtgtgtgtgtaggtgtgtgataacagccatcctgattggtttcaggtggcatctcattgtggtttggatttgcattttcctaatgagtgctgatattgagcatcttttcatgtgtttgttgatcatttgtaattttctttgaagaattggccatttaagtcttttgcccattttttcccccacatagcttctcttatcagatatatgacttgcaatatttatttcatttcggggttgattgctttttcactctgattgtgccctttgatgcatagatgttttgaattttcatcagtctactttgtcagttctttctattctatctgtgctttggtgtcatatccatgaaagcactgtcaaatcctatgtcatgaacattatccccaatgtttgcttctaagaaatttttaggttttagttcttgagtgtagagtttaggtctttgattcattttgagttaatttttgtatatagtgcaaattaagggtccaattttattttaacaccccctgcccccagaactatttgctgaaaagatcaactgactctttgtcacctgctcaccccagtggacactagctgttccatccaattgctgtcctggggccttgtcatgctactcttccactttgaacccaagcccacaccgttcgttgctcccctctgggatactgaccccactataaacttctctggggctacaaccttcctaccctttgtgcctcatgaccaccccctcccttgtccccgccatgcccatgatgagtctcttctcgaggcagctccccttgcctccatctcaccctcagcctatgcaccacagccacactggacatgggtccctctgagcctgagtcccttcccattcccaccatcccctctggcaagaccttccttccaccaccttcatgctcctcccttgcccctgcagggcagcctctccccttggcccctattcccttagggggcttgtggccacccagtccttgcacctggcctacaagtttgccatcttcattcccccttcttctgttcatcagccccctcctctatcctcccaccctcacagttttctttgtatatgaaatcctcgttcttgtccctttgcccgtgtgcatttcctgccccaggaaggttgggacagcagacctgtgtgttaaacatcaatgtgaagttacttccaggaagaagtttcacctgtgatttcctcttccccagagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggtgagagtcggcaggggcaagagtgactggagaggccttttccagaaaagttaggggcagagagcagggacctgtctcttcccactggatctggctcaggctgggggtgaggaatgggggtcagtggaactcagcagggaggtgagccggcactcagcccacacagggaggcatggaggagggccagggaggcataccccctgggctgagttcctcacttgggtggaaaggtgatgggttcgggaatggagaagtcactgctgggtgggggcaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacaggtaccgacgctggccaggggctctcctctccctccaattctgctagagttgcctcacctcccagatgtgtccagggaaaccctccctgtgctatggatgaaggcatttcctgttggcacatcgtgtcctgattttcctctattgttagagccactggataaagacagagggtcagggactggaccatccagtgttgtaatcagggcaagtagaggaccctccgacagaatcctgagcctgtggtgggtgtcaggcaggagaggaagccttcagggccagggctgccccctctgcctcccagcctgcccatcctggagagttccctcctggccccacaacccaggagtccacccctgacatccccctcctcagcatcaatgtggggatcccagagcctgaggccacagtcccaaggcccatcctcctgccagcctggaagaactgggccccagagtgaggacagacttgcaggtcaggggtcccggagggcttcagccagagtgagaacagtgaagagaaacagccctgttcctctcccctccttagaggggagcagggcttcactggctctgccctttcttctccagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctggtgagcctagggtgaccctggagagggtcaggccagggtagggacagcagggatggctgtggctctctgcccagtgtataacaagtccctttttttcagggaaagtgctggtgcttcagagtcattggcagacattccatgtttctgctgttgctgctggctgctgctatttttgttattattattttctatgtccgttgttgtaagaagaaaacatcagctgcagagggtccaggtgagaaaagcgggcagtttctggagatggtaaggcccctgtctgggcagtagggtcccctcattgctcctgcaaagataggcatgttggtgacaaggcttccgtaacaggggatgaaagttggggaatttgggaagggaatgggggcagcatctccatctacacccataagtgctgcccaagcaagggtcaaacgcccagctgtggcatcctcctgctgcaggtgaggagtgggcagcagggagggctgcggcgcctgctctgtccccatcccggtctctgtgtctcttgaactcactagggcgcatccaggtggggtgagctgggaatcacgtgctgaatgctaagggcctggatgatcacggcctcagagggagcaaatagtaaaggcagctgtgatctggggagggccagaaactggagaggaatctgaggagaggcggtgcccctattcccttcctctctgcatccccctcccctgtttctccagccatcggggcggacaccgagaaaaagacctatgaggcccagcctgggggccctgcctgtgtagccctttggagaccccttgtaacagggagggtcctgagcacacatggccatctctgtccactttgcagctccccatgcacctcctccaggagctttcttggggttgtcgtgtcctctgcaccattcgaggccctactctttccaggttcccacggcctggcctccctgagtttcttgcagatgacatggatgagtagataagcagatgtccctgggccatttgaggagtggggcccagcccctcatcagggcagctgtggtccctgttttcatcctacctccgagtgttttcttctccagtccctgagggacacagtcctcagggcccatgtttttggggatttaatctgtgctctgtggcctcaccttgccctccctgagccaatttccctttctaaaggtggtcactgcctggtaagtttggagtaagggacggtcagaatcatttcccctacagtcaggttgtttgatgggggatgaaaagagacagcaggaagttttgtgtttctgcaaagacagaagcagttcaggcgacagtaagaggctggggtgtccaggaggatgtgtctggcagtagggtcgctggtttctcatccttgaacctaattgcactgtcaatcggcccctcaggcctgagcagatgggaaggtttgtcccctgccctgcagcaagagggccctgtccaggaggcacccacaacaggggcagtgcaggtctgtggtcactcctgctctcacctgtggcgtctcccgtagagggattgtcagttctggttccctgtgggcaggaatggtttcctcataggtcactggagttttggccaggaaaagagtatgaagttcatgtgccagtttctcaaaattcctgctttcaatgttgatgtccagtaaagatattcgtaatttcagctctataatcttaataggatttcctctaatattgtgaagcatattatatgaaacaggaacacaaatttctcaaaattcctgcgatgtccaataaagattttcataatttcagctctgcaatcttaataggatttcctaatactgtaaagcatattaaatgaaacaggaactcaaatttggagccccctctccaggaggttctgtgtggagatggtggctgtggcagtggcagttcccaggtgcagagggtgggcagaggcagcctcaggctaaggggtctcccctactccacatggagaaaatcccttgtaggttgcaagggcagtggccgggtggaatccctgctagggacagagcaggaaggcctcgcagcctcaccaagcagcagccctggggtggagctgcgtttccagggttaagcggaccaggcaggagtagcggttactcaagagcaggtcacaggcttgggttgtgagggtcaggagaggccaggcctcctcgagcaaggtgggggtcccagggtcaggtcaggtgcagatcctgtggc

SEQ ID NO: 14672 - DNA, 13201 bp, Human
gttcctcatttgggaatctgaggactatagatcgcaactgtagagaaaagctggagtgtaggagcaagtgctctttgcccctttaccttgcattttcttcatagcacttactgctactggttttttgagacaaggtcctgctgtgttgcccaggctggagttccagctcacggcagccttgaccccctggactcaaatgatcctcccacttcagcctcctgagtagctgggattacgggcgagtgccactatgccttgctaattttaaaattttttgtagagatggggtctcacttgcccaggctggtctgaaactcctgggctcaagcaatccttcgggctcggcttcctcaagggttgggttacaggcctgagccactgcaccctgaccacttatcgatacttgacattatatttgtgtttatgtgttttctttcctgtaatgtaaacactgtgagaacagggctgttcaccgttgtgtccccagatcctaggacaacatgtggcacaagggaggcagttgataaatacttttgaataaattaaatgatacttgggaaaataccttctatgacaccattcttgaattagttacttcatttgtcactgaagacaagcttacttcaccaagaatttgaaccaataaggtaacctgcagtgtatttactaaccagattctttgagcagggaggcagaatacaatagagaatgagagatgtttgcatcctggctgtaacctcaccagccgtactgcttgagatatgttgctttgcttcgcttctgtcaataagatgagaataacggtacctactccttagtattaaatgattaagtatgttaacagggagagggccaaacgtttgttgttttattacacagcaggacatcaggtcttacttttgtggctccccatctcaaagacggggatagcaaatgtttcattcaggaaaaaaatccaggttgaacaatggggctgttggggcggggccaagaacattctgctcgaattaacagtattaatgggccgggcgcggtggctcacgcctgtaatcccagcactctgggaggccgaagtgggtggatcacctgaggtcatacatgggtgaagccccgtctctactaaaaaaacaaaaatttgctgggcgtggtggcgggcgcctgtaatcctagctactcgggaggctgaggcaggagaatcgcttgaacccgggaagcagcggttgcagtgagccgagatcaggacattgcactcccgcctgggcgacagggcgagactctgtctcaaaacaaaaacaaaaacagtattaatggaatgtagtataaccctcaagccctactattaacacttggggccgaatccagaccccgtcttcccgctcggattcagaacaccttcctgactcactggccctagggcatcagctacctcggacagcatccttttgggaaaataccgcccaccagccccacgactgggaaagagtcgggaaacacccccgagcaatccagttccctgagacttccctcctccctcccctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtgggggggagacgttagtttcctttatatcttttgttactggaggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaaggtgagcgctttgcgcagtgatgaccctcatctatcacccttgactgatggctgctgagttaggcatccataacggtgggattataatagggaaagcggagtcttcctttgaggacttttcaggactctacttgtcatctccattttccactttactaagttattagtcatattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggaaaaatggtgaaggctgtgctcgtgattaagtcttgctttttttttcccccctccagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaaggtaaattttctcttgggcatgtagtgctcattgggctctttaagggtacaatacaaagatgtgtttgtcgttgctcaggtggtggtaagggtttatacttaaggctagatcagggccaggtgcagtggctcacgcctgtaatcccagcactttgggaggccgaggcaggagggtggccacttgagctcaaaagtgcaagagaagcctgggcaacatagcgagactcctgtctctacaaaacgttcagaaattaagcaggtgaaggttgaggcttcagtgagccgtgattgcaccactgtgcaccagccggggcgacagtgaggaagaaaaaatcgggataagtatcaaaaacaattttggatagaggaggcttatacaggcttattctttctttcgtgatagcaccaaagtgctaatgatccaaaagtgacttccaggtctgccattcattcttgtgactggcttttcttgtctgcttatttttaattttgtcacttgacttctaattttaaatttccagaaaggtcctgcttggacctgtagtctccctctgttgggccaggccaactgtggtctctggaaacctctatgactggtttagagatgactggcttctgggtcaggtaccaagtccttcattttgtccagggttgtagtagttacgtgacccgaagtatagcaacctaagcaggagaagtggtctgtggcaggtattcaaatgtcatgaattgttacagattaagaaaaataaggacagagctaggatcattgaaggtgagcggttggtagatgcaaggggtttgttactaggactgggaaggcctagatctggaggaggctaaagctaggaggaattaggagagtctgattttgaggtgaatgtaattgagcagagagaggtaaaatgggtctggaagttggcaagaaccaggtaaatactagactttgagaattgagtggtaagaaatgggcttggcatggtgaaaaaggtagagttatctggagactgaagtctaatttatcttcctccccccccaacttttagtccagcatgagtgcatccctcaggccattctgggaatggatgtcctgtgccaggccaagtcgggcatgggaaagacagcagtgtttgtcttggccacactgcaacagctggagccagttactgggcaggtatatttggggagagtgctggggaggggattttggttaggactataagggaagggtgtttttgtcctaactacatgatgcttgcagagccatgagcacatgacctctgttacccttgacaacctgacagctgtgggggatgttctgtcgcaagcgtggggttcatgatttagatcacagaattgaagtcatttattatcggcccaggtgtgtttttgtgacagtcacttccctagaggggataatgaagagctacatttaccatatgtctccgtatacttcctgcctaaggtgtctgtgctggtgatgtgtcacactcgggagttggcttttcagatcagcaaggaatatgagcgcttctctaaatacatgcccaatgtcaaggtaagccaaggtaaagagacctgagagtgagggtgtggcaagttggagggataagaaacttgtaggccaatagtctctttaattttggagaagctttagtttgctgtggtgtaacagagtgttgagttcctatgtaacaggaggattcgtaattgggctatggatgatgcttaacacaagaccacccttttcttactactttatactgactttgaatcatatcagtttaataattttggggtatgtggcagagaaagccggaaactttaaaacagctccagtggtgtgtgaatattgaggattctggccaagtgcacaatggcttacacctgtaatctcagcagtttgggaggccaaggcgtgtggattatttgaggtcaggagtttaagaccaatgtggccaacaggatgaaaccctctctctactaaaaatgcaaaaattagccgtgcatggtggcacacacctatagtcccacctgcttgggaggctgaggcaggggaatcgcttgaacccaggaagcagaggttgtagtgagctgagattgtgccattacactccagcctgggtggcagagtgagactcccatctcaaaaaaaaagaaaaaatctgattgaagttaagcatttttggcaagaatccttcataggtgatgctgtatctcctgttatgccacaaatctggtcgacttatgttagttattttattttatttttatttatttgttttgagatggagtctcgctgtgtccttcaggctgtgagtgtagtggcgcgatctcagctcactgcaacctgcgcctcccacgttcaagcgattctcccgcctcaaccccccgagtagctgggactacagtgtgccatcatgcctggctaatttttgtttttttttagtagtgacagggtttcgccatgttggccaggctggtctcgaactcctgacctcaagtgatccacccacctcggcctcccaaagtgctgggattacaggagtgagccactgcacctggcctcattaatgattttagatttaccataggattagcgtcgtgacagtctgattccacagttgttcttttcccccttgaaaccagaaagtagtttctggtgttatttgatactgtaccaaggcccagatccccaaacaactattcacctaatggttttaacatgaaatgataatatttagcccgaagcagtaatttcatggggtttgtgtgaaaagagtttgagattctgggtttatttaggaaaccttaatgttccatgtgttttttgtggtactttacactaatctggtgatttcttgctgtcctttatttatttattttttattttttgagatggagtctcgctctgtcatccaggctggagtacagtggctcaatctcgcctcactgcaatctccacctcccgggttcaagcgattctcctgcctcagcctcctggctaaattttgtattttttgttttttagtagtaaatttgtaaattttgtattttagtagagatggggtttcaccgtgttggccaggctggtcttgaactcctggcttcaagtgatccactttccttgacctcccaaactgctgggattacaggcgtgagccactgggcctggctttattttatttttatttattttatttctttttgagatggagtatcactcttgttgcccaggctggagtacaacggtgggatcttggctcaccacaacctctgcctcccaggttctcgtgcctcagcctcctgagtagctggaattataggcgtgtgccaccacacctggctcctttattttttaaatgaagcctggcctcataaatgaaggaagttggttagattaagtcagtagaactgaattattgtcctgactgctccgactagccatgtaactttaggcaatcaccctcagtgtttggtgggggggacataaaatttttaaattaggtgacctctaaagttagttttagtttggaaacatgctaaaaattggtttagctcaaacagagtgggaaccctggggggattggactctttccttcctctgttttgagactctttgcttctggctcggcaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcggtgagtggcagtgctggggcttggctaatgctggggagttgttctttggagccaaatgatgtttatttgaaacaggagcacctcagtgcaaggacgactcttatctatcacccatgactgatggctctgggttccctggttggtctttattatgcttttaagcacagtaaagggtgtcatctatcatctttctatgatttttgtttttaacctttgagaataggggactttgataattttaggcataagtcatcaccaccaccaccgttttcattatagattcatatactgggagtcataggggagattctaaactgaaagagaagacagtacccttctggcatctccagcacagcatttacagtcagaatttatagctgaataagtgtctagactcaggtctgggattaatgtagagagtgtttgtagcagtttgtgtgatgtggtattctagtgtgccaggtggggttaatggaagatttttctgtaagaattgaatcttggtgaatgagagtggggttggacataggccccataagtcattacaaatgatctttggcaattctatatggtgagctataaaggtgggctccaggtagggatgtcatatttgcctgacttgatagaaaagtaatccagagagtcatagatggactctgatatctggaatataatatgtgcttgatatttgtagtctgctgaaggctggctggggcttgggcaggaaagggttgggagaaggtcccataaagcatgttttgaaggccttgagagcctctgcactgggctttatccccatttcatagttgggaactttggggttttaccttatttcttgcttggttaaaacaaacagctggaatctgatcccacttcttgattccaagtccattgctctttccattgtgttgttactatttccagcaatcttcacctcactgggaagtctacctctaatctttgtttatcatacctgcttattttctcctacaatttttttccttgttcttgtagacatgcgtcgggatgtccaggaaatttttcgcatgaccccccacgagaagcaggtcatgatgttcagtgctaccttgagcaaagagatccgtccagtctgccgcaagttcatgcaagatgtaaatacccttctaccttctctccctccactccccgcccgctgcctcctccccttcctcgccctcttcctcagactcccttgtcattcaagtgccaagaaggcggcttgtgcccaactgggagtaatgactccttgaagagacatacagaagcagagacagctagtgttagggcctgcgcgggtgccagggaaactccggaagacttggtcgggttaatgtgagagcgggtagtgttcgactttttcataaatcacaacatttttgaacctcttctcccttcgggggagggcaggatttttctgccctaccacccacccatccatcgtctcttacatgcaccctacagccacgcaccctcaaggtggcatcgagcatacagctggagccttctgctcaccaaaactcctacttcccggtggcaggagagcaagagagggacagacagatggcagggcatgtccaaaagaagagcatcagcacaaatgaatcctccccttccccacctccaggggtgggggcctttggcacctcaatccccgataccctactccttcccacccacatctccttgcacccatctggaacctcggttgatgtgagccggcaacagagaagcaccgtggcgcggcgagggaatgcagacggcacccagcggtggatggcggcagcggaggccgcggggaaacctgaccaggaagctgaggaccaaaccagcctctttttccgttcccggtttttttcctgaacccaacgcgtgccgtgccccgtttcccccaatatgtgttggggaggggtgtcctgaatggggtggtagattttttttcttaaaaaaatttttttgttttttttaatactcagaggagagggacataggaaaggtaaagtggatgtaatcgggtggttgttagggtttggggctaggtggggccaattgcataagcagtggagtgtgttcttcccctccctgcagtgttccttcccgtgggatgatcactctttagctgtatttggggctagaatgagatttgaaggaggccatggaacttctctttagaaagcctgccttggctgggcctggtggctcacctctaatcccagcactttgggaggccaaggtgggaggattgcttgagcccaggaatttgagactagctggggcagtgtagtgagactttgtctctaccagaaaaaccgggcgtggtggcgcatgcctgtagtcccagctacttgggaagctgaggcaggagggtttgcttgagcccgggacgtggaggtggcagtaagctgtaattgtgccactgtactccagcctgggtgatagagtgagaccctgtatcaaaacaaaacaaaaaacaaaacctgccttctgggattgggcttctggtttttttcccatgacacacacatcctttcctattttgtcctctgggtcttcatattaactatcttcccccaggatagtataaaaagtgttaggaaagttgggctttggagttgtggtaatttctgtctttgttactttcctccccttcagggggttttttaattttaaagatgaatgcagtgaggtataatggtgtgtgcctgtagtctcagctattcaggagactgaagcaggaggatcacttgagcccaggaatttgaggctatagtgtgctatgattgtgccagtgaatagccactgcactccagcctgggcaacatggtgagatcctgtcccttaaaagcgtatctgctgctctgaatttggtattttaacaccacttactgatacctttcctgtaaacctgtagatggtttaattcttagtcaagagaccagtctcatctaaaactatcctgttgtggtctgacggcaagtaactcatcttgagtaatttttgtttctccttaagtggcattttgactgtccattgcagcattctgatcttaaaagacatccactttgctaatgcacacgagattctcttagttgaagtaggagaatcaaatggagcagttgtcctccccccaccccatgttcttagaagcacctctgatggagttattctgaccttgagtcactgcctcccatcatttcccagatgtttggtccttgctctccctttgagaatcatctcccattttctttcctctcccacctctatttgaggtaatggcatctgtgccattgggtggtttcactgctccttgacttcatttgcagtttctttcccatgatagtttttagttgggcagtcttaaaactcatctgataggaaggaaattagatgtaatgtgagagagaccacagtaaaatgtgggtatttttgggagtggggtggggttttcaatcttctctttcctccccatccccccatggggtgtattggagatcaacttcctccacccccccaggtttaacccccccactctgccctcctcccgttccccacccccttcctcccccccagccaatggagatcttcgtggatgatgagacgaagttgacgctgcatgggttgcagcagtactacgtgaaactgaaggacaacgagaagaaccggaagctctttgaccttctggatgtccttgagttcaaccaggtcagttagacgtccagtagggggatgagcattggagcactccagctgtagcagaaacctggatattaagtacacttttattgaggaaatcacatgtgtgatgtgggagagaataatgagggtataaatatcttaggggctgagcatgagtaaggtgggagctgcttttctattctatggctggcacgggtatgtcctcaataacctcaaggaaaataaacttcaaaaattaagatccttggccaggcacggtggcttatgtgtgtaatcccagcacttggggaggctgagggaggtggatcacttgagtccaggagtttgagaccagtctgggcaacatggcgaaacttcatcactaccaaagaagaaaaaaattagccaggtgtggtggtgtatgcctgtagtcccagatactctggtggctgaggtgagaggatagcttgagcccaggaaattgaggctgcagtgaactatgattgcactactgtgctccagcttgggcaacagagtgagatcttgtctccaaaagtccttgaaggattttaggaagttgttaaaagtcttgaaacgatgtttgggggcatgttagggttcttgaatgtttaattcctctaataactgcttattcaagagaagcatttctgactgggtgcagggcagtggctcatgcccataatcccagtactttgggaggctgaggcaggagcattgcttgagcccaggacttcaagaccagcctgggtaacatagggagacgcccgtctctacaaatagtaaaaataaaaaataaaaaaagtagctgggcgtggtggtgtgcacctgtggtcccagctgcttgggatgctgaggtggaaggatctcttaaacccaggagggtggaggctgcagtgacttgcgattgcaccactgcactccagtctgggggacagagtgagaccccatctcaaaaaagtgtttaattaatatacttgtgagtggtctatttgcatttaaaactgctttctagaattaggatagctcccttaggtttaatgttttggtgagcaggaatatcagttacccctccagatcttaattctagttttttatcactttttcatgaggtgatctcatcctcatctcctagcatgtctggcaattttgatttctgaactctgtgctacctcagaggccagcttccttagggaaaaatcagtgctgaaataaagttatatttccttttctgctctaaatatatagtgggggaataagagaaatgaagaggaattcctgagaacgtaattactagaaactcccctctcccacgtaatgtctctcacacaccatggacccctattcccccaatttgcgaccccccaccccaccccacaacaggtggtgatctttgtgaagtctgtgcagcggtgcattgccttggcccagctactagtggagcagaacttcccagccattgccatccaccgtgggatgccccaggaggagaggtgagctgaagatgggaaagatattttgtgtccttgggagaaaaagacagttgagagaagggaatctcaacatgttttaaatttcctttctcacaaaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtaaacctcacaggctgaaaaaatcccactctcccattcccttgttttctgtttgtacatcttcattcctgcctctgggtctctttcctcttcggtcttccagtgctaccctctgtctccctccaggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacag

SEQ ID NO: 14673 - DNA, 102406 bp, Human
  misc_feature (1)...(102406): n = A,T,C or G
tcttccatttgatggagtgaatcgccttttaaggatgctgattaccagcgatgaggtaacaagtgtccccctctctttttagctagagatacaagattccattctcctctgttgtcctaacaaaagtgaagccattttgtgctcagaggcaactctcctgacccctagtctgggccagaaaaacctgaggagctaaataagtaaaagaaagctagcttacctagagtaaaggtggaaaacatggaaactcagagggaagactctagtaaaggatctagagaatcatctgaaccttaaataaagggcaataattagagagaaattttggaacaagtctccaccactcccttccagtccctgtcatttttgtcattttcatccttggtcaaatgactgatacttctggtgtggcaatttagaacagtgatagtggatgaaaaagtagaaaagatggaaaaaataaatgatgacaattttaaggacagtaactaaagtttctttcttccatatggatatgcaattgaagtgtattaaaggaaaagatcaaaggttacagccaactaatcaatggattattgatcaataactgaaaatctatcaatgtgaagtatacaaaatatgcagcttttccccttgccctgctctatactcagaattaggcatcactgatgtctacttgatttctcctcttgaatgtctccaaggcaaccaaactcatatgttttctttgcaaacctgttccttttctggtttccttatctcggtggataacttcatcagccagttgtgcaaaccagaaatccaggagttatttgtttctcctagccttccaccatcatatccaatccatcagagtccttcaattttacttcctatatctatctcaaacagatccatttctctttggctctgccaccaccctaactcatcatctctcccctaaacaattactgctccaaagggcatccactccatcctttgtcaaatgcattctccacactgcactactttattcaacaaatatttttaaggaacctactttgtactgtagtgaataagacagacgaggaatttgtggaaatagaagataaacatcaggcagtcaaaagcactacgaggacaatcaaagtcgggtgatgaaatagagagtggctaaatgactattctagactgtgttcaaacacaagaaatcggtggcagttttaacaaggggtattagttttgacacaggaaaatgaaggaagtccgctgggacgatggtatctgctcctagcatataaggagtgtgtttctgatactggccaataataaaaaggaggttaaaatgtacatgaacattcaatctagggctgtttgtctccaattacctctgcttaaacatagcacttactacctatatggaagtatcttatttttgttaacttctgtatgtctcccttctttagaatgtaagctccatgaacatgcgggccataactgtcttgatctctgcagtaactacagtgcctaagagaactgagcctggcattacggtaggcatgcaaataagtatttgttgcattaacgcacaaattgctgagtgaagcaggagagtagacagagaatataacggattgggtttgggggctgaggaagtctctgctgagctgtcaaggtcatttacttccccttgcaaggttaactgggttataaaatcccggccacgctttagcaccaagcatcaagcgctcacactctaacttatacacacgctcacagccacaaacctctccaactccccgctaggaggagtcacacctccccacccagaaaccctcccaccctctcctctatttctccttccctcccctctccgcggggttccggcaggcttcgaatcacaatgctcgccgggaatagtagtcttccggtccgagcctatggcgtttttaatgcatttccagaactacgcttcccagggagcctcgcggcatagtgaggctgagtcacctgaccaagaccctggagttacaatggcggcgcccatgctgcgctggggctgccgtggaagacgttgggctttcgcccgggttgacggtggttcttgccaccgaagaggggctccgactgggtccacatccaaccagattaggggagagagctcagtggctcagcagcccctccacacggcccagaagacgaggaaagggtattctgtttcatacatttctgcccacctaactgtgaggtggaactgcaggactggggaaataatggcaattacggcccagcttctagacgttttggctgacgggagggcgttgagttataacctggagccccgaaacctaaataaaagcacaaacagactttctatcaactccgcccccatatataaaccactgttttcaaatagatgtagttggggaattcgcgagtgtaaaatagcaaatattttcttgaagggtgcacagacagaagagtggattcggtcatcttactaatagcactagcagtggggacggtgacacgagaagcgggatcatatttagctgattttatttagcgctagtatgggctggcagcgttctaaaggtagaaagggagcctttacctacaagctcttggtagtggtgggttattgtcattagtcagaaaacactagctatctgtgcaggcgttttatgttggaatatgtgtgactagacctaggaggacgcagccaaaagaagagatactccccctggttatatggagagttttgcttatttggccagatatcccctgaacagctgtttatgcttcattatgtaagaattaaatagtttctctttaaatacagaaacatatggcaagtttctaatattttgtttattctttgagactagttggcattatttttactttcagttggaggaacagagggaaattgtccagaaagaagtattcagttttgtattcttttcgtgaattagattgtttccttgtgaatggaaagtacattttttctctcatgtaatggaaatgcaaaaatactttgaatggtgctttactgcatgcagaatttctaatgagttcctactttaattcccctcccttatgggctgtgtttccaaactttaaaaagaaggacttattcttgcagtacttcagatatagaactttatatgttgaaatgattgaaacaaaacaaaacgatgtaaaatatgtatatatatatatatgtatatacacaaaattacttgggagaagagcaggataggaacatacatggatttcatagggaataagcacatttataaggacctggagaggcctatgtacagacccaacagagtaggactgaccagataagagagattattatagcatttaacagcttcttagatttgatagcaaataagcattaaaaaagtaacctgaaattaggtctcaggaattgaaagtgatttgggggaccaaaaatatgccgcatcagatggtttagtgtggtggagttttgcaaaatttttttaagagtatcatttagtggtgatttattgtatctgtgtctctctggttattatacatgcaaaccaaaacatggttgagaatttcctttttaaataagagacgtggaactatttatcattatttctctagtagtagaatgttgccatttatgttaattctagataatgtgggaaagatcagctttcatcatttactgagtgattacttgataagttacagttaatttgttaaatgccgcttttcactgaagtcagccaagcagttgtcacctgatacccatttctaaattgttttaagacgccaaattgttcctttctctatagccttcatgtttatatcatcagcctcctgatgccatgttgtaaatgaattttagtttgccaatctcagtgtaggcgcttattctaaattgttttttatttagtcactgataaaatatgacacatttttaatgtgaggatataacattgtattaagtttaaaacacatataggaaattaacatttgtggtttagacttatagaaattcattcatggtgacaaatataatacatcttaaccattatctctttcttcttagtgaacacaaatgggctgctgtggtaggtttggaaattcatgcccagatttcctccaactctaaactcttctctggatctcaagttcgcttttcagcacctccaaattctttggtttctttttttgatgcatctctacctggaactttgccggtaagattcttatttaatcctattttcattagaaaaatgtttattttatattgaacatggaaaattattttcttgttttaataataacacaactctttggaaatacttatttagggagttttgggtgaagcgggatatattaaatgttttctgaagacccatctctgtgatgctgtttctaagtctgaatatattcatacatgtattcatcacttcacaaacattttagcatgtctactaataccagacattgggctttgagctgggtcataaagatgatccttgcctttaaggagttcaaaaactagtaggggagatgtgtcttataaacaaacagagaacagtgtgattccttctttgaaggtaatatgcagaggatgatttcgaaacccagaggagggacaactaattcagtaaaagaaaggactgttgtgagaaattgaagtaggggtactttaggttaaggaagggttactgaagaggtggtggcctgagctatttgagaagcccaataaaatttaggcagataaatgaaggaggaggaggagtcaactcaaagcaagcagtgtatattacatgattttacagtgtaaggccagtaatgattgtggttattgcaaattaagaaacactcaataatgtagaaaacagccataatatgcagtgagttaactattgtactcacttaaccactcatttttacttgatcctatggaatgactgggcccagtatactcatcagcaagacttttggcatatatttttatataattggttgaatttttaagaaaagtatgaagggaacaagtaaatgttttagctaataaatagcatatggtctgtccaggacctataatatcaactgtgtttggggtttcctgccatctttggaggaaatgtgtatccatggtggtgacaaaggtggggagaggcagacattgtcatgggtaaattccatgctctcaaacatttaaataagagtggaagctggttgaggccgggcgcggtggctcacgcctgtaatcccagcactttggaaggccaaggtgggcgaatcacaaggtcaggagatcgagaccatcctggctaacacggtgaaaccccatctctactaatagtaaactgcaaaaaattagccgggcatggtggtgggctcctgtagtcccagttactggggaggctgaggcaggagaatggcgtgaacctgggaggcagagcttgcagtgagctgagatcgcgccactgcactccagcctgggcgacagagcgagactccatctcaaaaaaaaaaaaaaaaaaaaaaatctggaagctggttgaactgagcactggcaggnnnnnnnnnnnnnnnnnnnnnnnnnnnnnnnnnnnnnnnnnnnnnnnnnnnnnnntttggggcagcatctttgtcttggaacttttctcttccgcattttctgtcatggaggactcccttccctgcagaccatatcaaggatcacctttgatttgctgctgggtccctctgggagaagatagatgtggaggtgtgccctctttctctctctctgacttagagatctatctatggaaagattttttgtttatttgagaagagtgaatattttggttataaatatatgacatcttttttgggcagagattcagatatagtagagatacaataatatttattgtaaaatggaaggcaagttgtcataacacctctacattttcccttccagattcaaaacatttttttcccatgttgtagttaattatcaagagattaggcataagctctgagttcatcctaggtttttccagctgtgaatgtgatggctatcaggccatacttattacagttcactttagaaacaggtccatttgcagataagcatgttttctgtatatagactctccagctgtacctaaatttggtcaaaaattagaccaaattagaaaaattcaaaataattaaaatgccaacattttaattgctttgtaaaacttgtcatgcaccaaaaaagaaggtgcttgttcactgataagcatatcaataacacagtgaaggtgtttgggacatttgagtgttgagagcttggcttacattaattaaatggcagacaaagtctggaaatacagttttgtatgagctaggatttgttttcctcttcagagcctacaacgcttatggtttaagtagcctagatgggttattctgtagacagaggagatctacctcttcttcagaaatgtttctgcctttaagggacctcattttgtacgtgagcaacattatacccaaactcccagaattaagcattgccattcaaaacatttcaaaatcttttgatttacctctaaatagatttaaaatacactaaaacctttagacagttgtccttcccctaagccctatggagatgtataaacatgctctgatagccagactctgcttataactccattcataagaaaccaataatttgagaatatgtttgtgcttccgaggattttagtagaacattatgttattgttttggtcaagtaaaccaaagtgtaagtgtgattcatgatgatacttgaaactctttctgcgcagggcttatattgctcccttctctcctgcttcttccccgccctctacctggctgattgtgccttctcacatggctgtgttctgccactcagccctgaaatgttggtttcccatgccctattctttggctctcaattcttctgttacctgtgttcccctgagtaatctttttaccctcaaataaagctcccctctctcttttaggcaagaaacctatatctattgtgtcctactatatatttccatctgaatgattcataaacatcttaaattcagcagttacagtgttaagcctgttatcttttctccccaaagtttcactgcctcctgacgaaagaataaaccaacaagggaaaatatatgtaagaagaagcaaaaatcagtgggaaaaggataagttatttaactgatggttttggaattggttagctatttggagaaaaagtatcgctcatttcacacatcaaaacaaagttcatatatatataatataagttaaatgtcaaattaaatccagaaatatctaggagaatatttgtttgtccttgggttggggagaaactttgtaggcataaaagcaagaaaaaacagctaattaggcaaaatggcaatttgactactttattcgcccaacatgtttattgacgtagtaattcttttaggaatctgtccttggaaaataaacatgtgggcaaagacttatatgcagagatgtctatagcagatctatttttaaaggtagaaaattggaagtaaccacagtttctcagtgatgggggaatcattgagtaaattataatacatcagtacagtacaacattatgaagccactgataatgtttataatagacttttagtgacataggacaatgctaaagataaaaattctagtgagatgaatagaattttcatgtagattacttaatcttctttgcatcagtttcttataaaatggagataattgactcattggatttgtgtgagaattaaatgaatcagtacctttaaaacacttaaaacagtaattgcatgtagtaagtgctcttattaattaacagataattaacaagtaataacaggtaattaattaaaaagctcttaataataggtaaggtaaatcttacctgctagcatacccataatgattggtggcttttatctttacaaaggctctcctgagttattgtgcacagttacgttgccagtgagagcaaaagtaaatgctacacataacaattggtcacttaaccttgatttcaccagttaagtgatctgccaacaaaaactaacctgggtatctcatcacctcagagatgtatagagaattaagtaaataatgaaaaccagtaaaaactagtatatggataaaattatttctgaattagaaatcattacttttattgcgaaaaagaaggcttatgagcttttttttttccatctgtagttatttggagtgtttctttggttcaacatggtattggctcttgatttagtaaaaaattaggattgtcacttaaaacaattgttataatgtatagtctttctgtagacatttcattcttcttctctgtcggttgtgtcttcattcactcagctggcatatattggatgcccacgttatgctagcccttgtgtagctctagtgacacagttttgaacttggtagacgatagatatgggtgttgcccacatggagcatgaacaagcaagcaggcagttgcactaccttttaataaacatgttagtcgtggaaatacaaggtgcttgaggagcacataggaagagtattcaacacagatataaggaattgatgaaattggccaagtagaaagtgaataggatgtacaaagaccagaagaaaaacaacgtggcttgctctagaaactgaaacgttttccatgtgttgtagcatagaatttgaatatgggcattgcaagaggtgaggctagagcagaaagcatagcctgtaccatataagccctgataaagggtgtggatcccatttgcaaagaggtaagaagacgtaaggagagtgcagggccagaaactccaaggaagtgagtgttttgagaaggagggagtacaagaacattggatgctactgagaggtcaagtaaagtgaggactaggaagtgcccattggatttattaagaagggtatcctttgcaagaacagtttgagtggggtgatggaaacagaaggtaggtggcagtggattgagaaatgtcatggcatggaggaagaagtgagtgtgggcaactgtttcaaaaagttttactatgaaggacaacagaatgcagcaagtgaaaggagacatagaatcaagagaaaacatttattggtcatgtctttcttaatattggagagacttgggaatgtttaaatgctgatgagttatgtagtctatgatagtgtacacttaaaatgtgtttaagaggatagatctcatgttaagtgttcttactgcaataaaacaaaattttttaaaaatgctgatgagaaggagccaatgaagaaggggtaaagacaggagaggcttttgattaatatgatcaactgaacacatgcattttaatccatcctctctgtaacccagagaaaccccactgaaatcatagtgaaagaatgcaaatgtgataagcctacaaaagaatgggagaggagacaagagtgtgtgagagagagatggtaggtggaggagggcctcactttgcagaggatgcactgtgacctaagtgcctgcaggaagggacactagcgagaactgagatgatgtgtcctacacaaccttaaaaacgctcaggatgtgggggcgtcaagtattgtggaaggctggctgaggtgaaaacaaaggggttgagtcagagtctgagtacagtgcagtgagatctgagcttctctacctgaccctctgcagctgccctacccccataggaatgtatagtctttggagaaattcagctcatgacacactttccctgaggccaccagtcagagcaaaaggcggtatcagacagcatctgtagtgaactccaggacctacccagttcttttccctgccccagtgcgggaacttaggtggcctggtatgtccatctttcctcttcccctcctcccccaagcaagaatctgcaggagcttctttgaagattgtgtgaccctagtgggaagaacatgagatattgacatggtgggatgtctctcaatttaaaaaaatctgtctggccacctgattgctttacagtgaaggccactgatgaataagccctgggcatttacataggacttttaattggcattttagtatcttactttaaaatatagattgagagccaaaaatcaccaggcacttgaggagattctccaacatgatagacaaagctcaaaataaaaaagaaaactaaaggaaataggaggctatagataatgcacagggtaaaagaatacttaaaaaattaatagcttttataaatgtcctcagagagataagggaaggtagctgcctctttgaaacaagaacacaatactgcttttaaaaaatgaacaaacaggataaaaacgagctcttagaaattaaaattatggtgcctctccttcccctgggaaagttagaaaataatgtcaagaaaatcttccagagatcaaaaccaatgtgcagtgcattggacaatagaagaaaaaaataagcaaattagagaatcagtccaggaagttcagcatctgattaataagagactcgtgaaaaaatagaaaacagagtcaaggaaactctcaaacaaaacacgtggattaatttcccagaattgaaggacatatatctctaaatggaaagggcctgccaactacccagcctgaggaataaaaatagtctaacatgaaggcatgtcaagaaacttaataacactgagaataaagttaaggtcctaaagcttacagagaagaaaaaaataatcaggtccacatacaaaggattgggagtcagacatcagacttttcaacagcagcacttatacctgtaagagaatggaaccatgccttaaacattcttaggggaaaaaaaattataattctaacctagaattcggtacccaacagtgtcaatcagatgtgacagtagaagaatggtattttcagacagactctcaaaaagtttgcctttcattaccccaggaacctgctggaataatagagaagtttcaggttgccagctctaccatgagaccgttggaagaggaggaaggtggctccagaataaagaattctaggaaaaaatgagagtagggaattagcaggtatctgatttgtgtggaaaaaagatttccatataatctagcctttagaggaatgagcaataggtacataaaaaatgaagcacatgaaaacaatgaagggcttagcaagtctaggaaaaacaaaatgttcaagaaaggaaatgtaatcatagtgttttattagcttaggagagaaacatgtaaataataatagaagcaccagctactgatttaataaaaactgtgatataacttggatattgggaaaagaactaaattcttacctaccataattggaagtcatgttctaaattggtaaagcaagaaaaaagtaacctaagtataggctgtaggaacatttttggccactgattggaggcctctttctccttttcaggccttaagccagtagatgggttttattttgttgtgtttttctttggcggtgaggtgggatgtgggattgtatttgtgttttgttttgttttttaattaggtgatgggtaaatgatttggagctcccaagaaacagactagtagtcaaaagcatttttaaaaacaagatttatttttattttatatacaagataacgttaggtaataatcaaacattacctgtactggtttctcagccttctgctggtgaagtgcttttcattttgttttgttttttgttctcaaagtccaaataatgagtcccctaccacacccctgttctcacaactcttacccttaccctgattttaggagaaatagactcatccacattctagatccatccatactcaagctcatgcatgtaatggctctgtctgcttccctgggggagacatgacctaccatccttttttctaactgactttatggacttttatgttacccaacttctcatggcagggcttttagggagtgggtatattttatttttggatagaaatataatttagcagctaggcacagtggctcgtgcctgtaatcccagcactttggaaggctgaggtggttggatggcttgagcccaggagttggagaccagcctgggcaacatggtgaaaccctgtctctacaaaaaaaaaaaatacaaaaataagtcgggcatggtggtgtatgcctgtagtccgctgcttgtggggttgaggtgggaggatcacttgagcttgggaggtgtaccacggcactccagtctgagtgacagagtgagaccctgtttcaaaaaagaaaagaaaagaaaaaaatataatgtagcagcaagcttgggtaattctttgataaagtaagatataaaaatattgcaaaatgtctcatattgttattctcttatcttgtaacttatctcagttatctctcagaaatggaatgggccaagtcttaggagtccacgttcttaaaacaagtacactgtatcattgtgacagtttatcaaatctatcttttttccagattaaggaaggattgtcacatagcaaatggccaggagccttggccaacaggtgatggattttccaaaggtcccctggcacagcatattatttaaaaataggaagataaataccaaacgagacagctcaaagatctgaaggtggttgctgccaggaacaggacgggacctaggaaggggtggggcggggaactgctgcttttcatgatcagttatttaaaaatacatgtctgtgatattttgtttaaaaaacttaagttaggggctgggcgtggtggctcacgcctataatcccagcactttgggagaccgaggtgggcggatcacgaggtcaggagattgagaccatcctggctaacacggtgaaaccctgtctctactaaaagtacaaaaaattagctgggtgtggtggcggacgtctgtagtcccagctactcgggaggctgaggcaggagaatggtgtgaacccgggaggcagagcttgcagtgagccgagatagcgccactgcactccagcctggcatgagagccagactctgtctcaaaaaaaaacaaaacacaaaaaactgaggtttaaaggaataaagatataagggggagggaattgttgatagaataaggttcctaagaaagcagacaatgtctccagagctgtggagaaagagccctctcctactgtaacccgaggggaagatgtgtccctctgctcccaggtgtgaggaagttttgaggtttggttgtcaaaggttgaggaaacacctctctgatttttttcttttttctttttgttttattatatatatataattatacttgaagttctagggtacgtgtgcacaacgtgcaggtttgttacatatgtatacatgtgccatgttggtgtatttacattaggtacatctcctaatgctatccctcccccacccccaccccacaacaggccctggtgtgtgatgttccccttcctgtgtccaagtgttcttattgttcagttctcacctatgagtgagaacatgtggtgtttggttttctgtccttgcgatagtttgctgagaatgatggtttccagcttcatccatgtccctacaaaggacatgaacttatcattttttatggctgcatagtattccatggtgtatatgtgccacattttcttaatccagtctatcactgttgggcatttgggttggttccaagtctttgctattgtgaatagtgccgcaataaacatacgtgtgcatgtgtctttatagcagcatgatttataatcctttgggtatatacccagtaatgggactgctgggtcaaatggtatttctagttctagatccctgaggaatcgccacacttgtcttccacaatggttgaactagtttacagtcctaccaacagtgtaaaagtgttcctatttctccacatcctctccagcacctgttgtttcctgactttttaatgatcgccattctaactggtgtgagatgatatctcactgtggttttgatttgcatttctctgatggccagtgatgatgagcattttttcatgtgtctgttggctgcataaatgtcttcttttgagaagtgtctattcatatccttcgcccacctttgatggggttgtttttttcttgtaaatttgtttgagttctttgtagattctggatattagccctttgtcagatgggtagattgcaaatattttctcccattctgtaggttgcctgttcactccgatggtagtttcttttgctgtacagaagctctttagtttaattagatcccatttgtcaattttggcttttgttgccattgcttttggtgttttagacatgaagtccttgcccatgcctatgtcctgaatggtattgcctaggttttcttctaggtttttatggttttaggtctaacatttaagtctttaatccatcttgaattaatttttgtataaggtgtaaagaagggatccagtttcagctttctacatatggctagccagttttcccagcaccatttgttaaatagggaatcctttcccgatttcttgtttttgtcagttttgtcaaagatcagatagttgtagatgtggtattatttctgagggctctgttctgttccattggtctatatctctgttttggtaccagtaccatgctgttctggttactgtagccttgtagtatagtttgaagtcaggtagtgtgatgcctctagctttgttcttttggcttaggattgacttggcaatgcgggctcttttttggttccatatgaactttaaagtagttttttccagttctatgaagaaagtcattagtagcttgatggggatggcattgaatctataaattaccttgggcagtatggccattttcacaatattgattcttcctatccatgagcatggaatgttcttccatttgtttatgtcctcttttatttcattgagcagtgatttgtagttctccttgaagaggtccttcacatcccttgatttttttcattttgtagcagatattgcttcttacatctcactctgcttttgggcaccgttttcttcctgtgttggtggctcttgctttccaggtctgtgggtgatgaactctcttagtctgtatgtgcctccagctgtttctgtttccccctcactctggaatagtagtatagaattccaacttgacatttatttcccgttggcacttgaagacatttttccattgtccttaggcatctgtaattgctgatgagaagtctgcatcccttgtcagtaatctgttgtgtcactctgatagctttagccaggatgtgtccatatgtgaatttgtttttatttattctgctcagtgtgatttttaacttaagtactgtaccctggactatggaggtatctctatggaatgaattcctggtggcctctgccagggcccattgggttttattgaatgaaccggtttgtatgttaatttcttggccccctaactgccacacagcttagatagtgccagcgtcaagctgcacacatccaagccaggcacagggtcaagggctcagatttctcaagactctttttcacctatggcctgaagtagctggcctcctccacagcaacccctccagttggtggcaaaaggttttctaactggactagaattttttggctcacagctttatgcaggaagccatcccagctccctatcacatgggctcatggccttgacttctgcccccaaggtgctttaaagcattgacatctgatgtctcatcagcccagttaacaataataatggtagtaaaatcaactaccatgtaccaagtgcttaccatgtggcaggcactgttctaggtgctttatatgtattcacttattctaacctcataacaaccctacctgccgcagttgctgtccttatcacagttagaaagtgagtagaaaatgtgttgtcctgtctcttgtggttacccctggtgtcacatggctttaaactaccattacttctgcggccccaggggattttcttgcttgctttgagcttggctctgggcatgtacacatctgtgtatttgtaaatttatatgtatatataaatgtatgtgtgtataaatagaatacttcatttctgcctcctgcctccatctccctgttccccagcatgtctggagcacacctgctgtcttgaccaaccccctccccgttctgattagtaacccttattctgaatgttttttaggatctttttattttcttattttccctcagttttaggattttatggaagcccatcataaatcttgaggatgaaaaggtcagccagcccatttcactgcttataggcaggattacagctacactaaggacagcattctttgtttttattagtagggattcagcttcactcattatttggacctagtaaaatctctttactgtggtgccaagtcttccttaatttattaagtaattattcacctatagatctatagacaggatcttaggttgtttgcttaaagttagttatttcctatttaacaataccattccaatttttctacttgtaatactttgtatatggttgtgaaatgggaagaaaaataagaaagaaaatatatttgtttggtaaaatgtcatgggctttacaagtctgtttcataattggccaagtaatatttccagtaatggtgagatttcagcaaagaatcaagtttgtttgaaatttatgcatgtgcaaacccatgtttacacatacacacacactcactttttgtcatcggaaatgcttgccctctcctggtgtcagttcccacgcaggggaaaggggagaggacaccgttgcctctgccgtagctggctggtaggaatgctcagtgtggcacagtagataactcctgataatcaggctgcactacaattcatttaataagaaatgagaagctctgctcttgttttgcttgtctgaaagctcttatctgtatgtaacatagaactccctagcaactgtgaatgcctcttgtctccagaactggggaaaagaccataaaagctgtttttcacacatgtatgcaagaatattctcctcttttctcaggatcagcctgtttaaaaaagcattcagggctttccatatcaaaggtatttagaattggccctggaagctatggaatgaaaacaggaatgttgtttactacattttacaaaactttcttttattcacaagagtgcatactattattagccagaataaggggaatgaagaggggaagaaatatgatgtgaataaatatgatgtgatgcctgccctctgggaactaacaaacaatgcaaatgctgtgctttctgctagagattccttctggaacatatgtatgcacattgcagcagaaggggtcttgcctccctgaagaaatagtgatgtgaacgcttttctaaagtactttggaattaatttattttttagattccttatgacagatttcgttcaagctaggtaaatctgcagcattccgactctgaacatagaagatattggtgataacttttgttttgaagaacctgctagatttagaaacccttgactagtctagggagcatcaggctttctgaaatgcttttctggctcttaattctaaacataattataaaagttgtttttaactcaaaatgtagaaatgaaacagaaattgaagatagcatcattagggaaaagtctttaaatacgtacatttataatcagatctacatttatctctccgtccattcacacttagatgatgtttagctatttaagaagacaaaatgtgaccattttctatgaaatttctttccatttcaatgatttgctttaatgtaatctgaaagatttataattatgttgtatactcagacttgcttcttgccagtcactctgcaaatcacttctatagttatcctccatgcttttgagagtgaggtgttgcagggattaggtgttttgtatagtgacccttgtcaccctaaaggaggtatgtgtctgtgagctcatacccacaaatgtggaatgttccttttcagcttttactctgctgatggtctaaacctgccttataacttagttaaccggatgtctcccatgaactcagtgactcatgacaatgatgactttcatgttcaggaggcagcatgatctcacctccctccctgtgggaagcatttgactccttccctgccatagatctttttctaactttcagtgggttcttgaaagcctctctcttcacagcaattttcacttccctacctctctaccagctttgcatgcaatattccccacctgaaacctaaccatattaataataatgcttctactatttttatttttattttttttagagacagggccccaccatgttgctcaggctagtttctaactcctgggttcaaggagtcctcctgcctccacctcgcaaagtgggattataggcatgagccaccatgcctggcctctactttctatcaatatgtatttgtttcatacagttgactgaacatctttttatgttttatgtatgttgtttataaggatttctgtgtttgattatacgcttctaaagagcaattcatggatctttcttgggctacttgacagtaccttgcatagaacatgtgtatagcaccccttgtaaatatttccctatatacttgcatacacgtacatacacgtgcgtacacacacgaggcatccatataaaaggattttcctgtctaaaaccctttagctattttttaaacttctttatgggtctcttgtcctggctgaacataagacaaccttttcttgattacccaagcttatcagcaacatcagttattgctcagtgttataatggtggcttcaaggtctattgaggtgtgtaaagctttttgatcctacagtaaatggctaaagatagccattgtttttaggtttcatattacagtgtttttccctgcttttatggttatgtgttcctcactgggtttttaaagctgctgtcagtatatttggctctaggaatcccttcttgctcatttttcacttctcaatgattatttctgattagttcacaaagtcagattatcacttttgtaaatataaataagaacaaagctctgagtagaaacctgtcctacaaaagaaagtacatggatgctatgaaagctatttagcatcaccatgtgacaatagaataggaagaggtcctgaaaatcattcagttcagtccttttaatttacagatgagagaactgctgttgggacttacccatggtcacacaatttcttaacattccattcagattagaaccaaagtttctcacttccagttcagtgattagctctcaacctgttccactatagttgaagttgctggaagtcagatttatgtaggtggctattattttacagatatgtatatatgagtatacatccaaaaacattaatctcattaacagatgtgtgtgtaatatgtttatagatgtatgtccacatgcttatacacatacagaggcactgactacacagcactgatgctggttgtatgcaccatgtgttatgatgccctctaggtgtgagatctaaacctagggagagagcaaagacaagaatgttgagtcagaagaagaaatggataaaggaaatctcacctaattagcctccaattcagggccctgtgcatcggatttccccagactcaccatgaagaaagcaggcctgtctatgggcagctcttagctgtatgttgatcacgatgcaaatagcggtcatgggaaaattcttttaggatcttttctctaggcttcattctggccagttttctctacactgacttctagttcactaattttctttataatattcactcttttacatatccattgaggtttttagttcactagatctttcaattacagaaattctgtttttctcttttaaatttctctagccttttgaaaataacttgttcctttttcatgtattcagttctttatttctttcataattttacagctacttattttatagtctgtattcagtaattccattacctgaagttcttgggtgatcttattatgctttttgcttgactgctgattctggctggcagtagatgattctctggtgtattttgtaatttttttattatgaagccatatctgacagggctttatttgtgggatcttgttgagagtgcatctctttaaagcacttttgcattggcttttgcctgatgctccaggtctaagccagggccattttccatatttacctcttagcttgggggcttctggaccacagagttagtacatctgaccccaagcctgtctgagagcagactatcaattcttagggcagactcccataccccctgtcccattgccacccaccaaaatctataatctggctgaaactttattaaggttgaaaccttatagaagggaggggatgaaacaaaggctgtgaatatgggtgactcagaatggagcagggaaggcacctttaacctttctctggcccccttgccctgtcccattaagatatccctcccagccgggtgcggtggctcacgcctgtaatcccagcactttgggaggccaaggcaggcggatcacgaggtcaggagatcgagaccatcctggttaacacggtgaaatgccgtctctactaaaaatacaagaaattagccgggtgcgatggcgggcgcctgtagtcccagctactcaggaggctgaggcagaagaatggcatggaccggggatgcagagcttgcagtgagccgagatagcgccactgcactccggcctgggcgaaagagcaagactccgtctcaaaaaaaaaaaaaaaaccatatccctcccttcccattgtaattcttctgtgttgttgtgtatgtattgcagttcacactagttagggccaaggttggtgcacatcccagtaccttttatctgtcctctcatcacagacacagatcaggtgactgagctctttccaaattcccgctagatgtgcaaggatgcactctctcacttattgcctttaaagatgatcattttcccaaaaaaagcttcatccttaataaaatgattcccttaacctttgtgtagaaatgatgatgccatctcactcctcctaaagaacaacaaaaagcaatatgatggtgttgacaggagcagctggctctagtgggagaaatcaatgaggaaattgagagttcgctttcctctccacctgagccttggcgaacctgagggacctcgtctggcctccccctgggtgaatcttctgggtctgcagagcatctccctgactcagcagtgtttcttaggagcttgatgttcctttcctagtaatggaagtctccaggcagcttgctcatctccccacaaattcattcctgagcaagaaactgccagtattgtttgggaaagccttttctcccatttccacatccttttattggtttgttttccctcaaaaatatgcacatggatgagatatggagcaaaataataagcccttattagagaaggcagtgttatacttagaattattaactgttcaaaatgaattttgtacactactgcaaccaaaaatctgtaatacaatagtactcccttatctgtagtttccctttgtgtagtttcagttaccctcagtacaggagaataagatattttgagagagaccacattcatataactttgattacagtatattgttcttttttattattgttgttaatctcttgctgtgcataatttataaattaaacttcatcatacatacctatggataggaaaaaaaatagtctatatcggacttggtaccatccgaggtctcaggcatcccccaggggtcttggaacctatccctcatggataagggggcactcctgtactggaaagagaggtaggagtgtgcagaaaataaagtatgaacacattaccaaagatgcctgagagtacaaaagcttaggagtcttttggtgatataaatatgtagtagtccaaaaaaaaaacctaacagtgttctgtgacactatttttgtctctgccattcgagtagttcatacaggctttgttctggtgatttatactagaagcctataataaaaacgcagcctgaaatcatgcagctgggtaccattcatttttcttccatggacagttcccgaacttaacaaattacggcaggcctggcaaagctcttcctgcaaaggcaatacatgcctggccatggcagctgccctcttgggtttcttctgctttgtggcatcatcggtgatgctgcggggattgctagatggtttttatgagtacatcatgtactgcataatgacattttggtaacaacagactacatatatgatggtggtcccataaaattacagtggagctgaaaaattcctatggcctggtgatgtcatagccatcttgtcatcatggcataatacatgacaatatgtttagatacacaaatacttactgttgtgttacagttgcctacagtattcagtacataacatgctgtacaggttagtagcgtaggagccataggctataccctgtagcctaggtgtgtagagggctgtcccatccaggtttgtatgagtacactcttacgatgttcatgcaacagcaaagtctcctaacaaggcatttctcataacatatctccattggtaagtgatgcacgactgtactaggaaagagtttctaggaagatattgtgtagttttagtgggtcaataaaaataatactcgcttcctgtcttgagtcagaaccaactgagaaatcagcacagaagtcagacagatggaaatgaacataccagctttattacagataatagcttgattgaaaaatgcaacgtgatgtttagccatatgctttttagtacttgctgcctctgttgaactcagctttccaaaactgcaggcttttcacttgtagaggacgaacttgcttctgcagaaagcttatcatgtcgccagagtagagctgactgtcccatcattgtgggcatgttgattaggaagaactcatgcaggctttctcctgataatttatactataagcttctataggaatgctcagccatggggccaacccactcatgtggttccatttcccaaagtcacttgtcacaaaagtcactcttttggggacaagagaatacagagtagaaagcaaagtcctgtcacatggaaacctaggggcaggggaatgaccgttgcccaaattgtgccctcaaaagcatgaagccagtgtcacatcatgtctgggcatagatgtgagaagctgtttttgggtgagtcttgcggaattctttgtttatactgcaagtagatgcacttgtcatctgaggccattggcttggcctctcttggccatttttatgtgtgtttgcggcttcacatgtaacattgtggggagagttggctattttctacgctgcggcatcttggggagtttttttcctcagctcttttaaaaatcttggcaaagttaggaggtcattttgccattggcataccagagatgacaaacgtaggcttggtgattctggcatgggtaggtagtcaggctgggctcctctgaagagcattctgttcctcatggcagaggattcttgctagtgagcctttgtgttccccagcctttcaccactgggtacatcattataataaggactggagctgaggcagggagaataactgggaatcaaaaggcattagtgcttctgggagccttaaaatattctattctaaatttttatgcacgtatctccttttacaattatagaagcaagaagcgtaatcaatcaagggtctttgtcatgctttgcagctttcttaggaaatgcagacaggcaataatatgtgattgtcaatagcattttgaattttcagtgatatttgccaactcataggccatcccaatgagcaaggtcaggggctccaaccccagttgataggagaggaaactgatggtcttactgacttatccaaggacacaaagaggtcatgaacccagctaaaaatagaagtgagaattgcctggtccctattcttagtataagcaccagattacactcgctgctgcaatacttgctaattgttcatttccgacaaaacatagcggggaatttttcctttatagctggttgtaaacatttaagatgcctgtagtcactcataacctctgtttacttatcacagccagctagctatcttatttaccttatctctgattctttttcatttttacatctgtgcagagaagttaatatatgtgaaagcacttcatagactctcaagtagcacataaattttatttggtgttattataatacttgtattagtcatttttacactgctgataaaaacatacctgagactgggcaatttacaaaagaaagaagtttattggacttaccattccacctggctggggaggcctcacaatcatggtggaaggtgaaaggcatgtctcatatggcagcagacaagagaagacagcttgtgcaaggaaattcccatctttaaaaccatcagatctcgtgagacttactcactatcgcgagaatggcacaggaaagacctgcccccatgattcagttacctccaaccaggtcaaatcttaaatctccaaaatgatctcctttgactccacgtctcacatccaggtcacgctggctgatgcaaaagatgggttcccatggtcttgggcagctccaccctgttgttttgcagggtacagtctccttcatgattgctttcacgggctggcattgagtgtctgtggcttttccaggcacacagtgcaaactgtcagtggatctacctttctggggtctggaggaaggtggccctcctctcacagcgtggtaccccagtagggactctgtcttggggctctgggggctctgactccacatttcccttctgcactgcccagcagcagaggttctccattgtgaccccgcccctgcagcaaacttttgcctggacatccaggcatttctatacatcgtctgaaatctaggtggaggttcccaaaccttggttcttgacttctgtgcacccacaggctcaacaccacgtggaagcttccaaggcttggcagcttccaccttctgaagcaacagtccaagctgtacctttgccccttttagtcacgctggagtggctgggatgcagggcaccaagtccctagactgcacacagcaggggcaccctgggcctgatccacaaaaccattttctcctaggcctccaggcctgtgatgagaggggctactgtgaagacctctgatgtgccctggagacattttccccctgtcttggggattaacattctgcttctcattacttacgcagatttatgcagctggcttcaatttctcctcagaaaatgggtttttcttttctaccacattgtcaggctgcaaattttccaaactttatgctctgcttcttttataaaacggagtgcctttaacagcacccaagtcacctcttgaatgctttgctgcttagaaatttcttctgtcagataccctaaatcatctctctcaagttcaaagttccacacatctccagggcaggggcaaagtgccaccagtctctttgctaaaacataacacgagtcatctttgcttcggtttgcaacaagttcctcatctccttttgagaccacctcagcctggaccttattttccatatcgctatcaggcttttggtcagagtcattcaacaagtctctaagaagttccaaactttctcacattttcctgtcttcttctgagccctccaaactgttccagcctctgcctggtacccagatcgaaagtcacttccacattttcaggtatcttttcagtaacaccccactcctggtaccagtttactttattagtccatttttacactgctgataaagacatacctgagactgggcaatttacaaaaggaagaggtttattggacttacagttccacctggctggggaggcctcacaatcatggcagaaggtgaaaggcatgcctcacatggcagcagacaagagaggagagcttgcgcaaggaaattcccagttttaaaaccatcagatctcgtgagacttattctctatcacgagaacagcaccggaaagacctgcccccatgattcaattacctcccaccgggtccctcccacaacatgtgggaattcaagatgagatttgggtggggaacagccaaaccatatcagtactcatgtttttaactttgcatcattaaaatgtgagcacagatacttccacttcatagtggccaatagagttgggctgggagtggcagtggtaaacacttacatcatactatcctgacataacttaggatggcatgtattcacaacagtatgagtaacaattaatgagaagttttcagtcacagatgtctttcagagaagcacaaattgataaatatacatatacatttacatagtgaggcaacagaatggaagcactgatagaaaataagacacacatacagctttgggggaagctaaaagtattttcagctagaaaatatataattggggaaaattattttcctaccagttaaaagaacaaatcttcctttcatactcttgattatgcatgtatatggtgtctatttgcagggtttatatacttttctatagatactgtggaattctcttaacagattttggttgcaccatacttgattacatacacaagggccttaataatatcccatagcttaattgaatctatggcataggaaagtttaggtagatagctttaatatgtaatgttttctttctagagctgattttcagcagcagtgaatggaagtggcaggatgtggggtttacaagtcagcattagtttcttcttttttttcccattagttattggggtacaagtggtatttggttacatgaataagttcttcggtggtggtttgtgagatcctggtgcacccatcacccgagcagtatagactgcaccatgtatgttgtcttttatcccttgcccccttcccactcttcctccgagtccccaaagtccattgtatcattcttacgccttagtctccagtcccatccaggtcattgcaaatgctgttaatttatttctttttatggctgagtagtattccatcatatatatatatatatatatacaccacagtttatttatccacttgttgattgatgggcatttgggttggttccacgattttgcagttgtgaattgtgctgctataaacatgcgtgtgcaagtatctttttttttcaaataatgacttctttacctctgggtagatacccagtagtaggattgctggatcaaatggtagttctacttttagttctttaaggaatctccatactgttttccatagcagttgtactagtttacattcccaccagcggtgtagaagtgttccctgattgctgcatccaggccaacatctactgttttttgattttttgattatggcccttcttgcaagagtaaggtggtatcgcactgtggttttgacttgcatttccctgatcattagtgatgttgagcattttttcataatgtttgttggccatttgtatatcttcttttgagaattgtctattcatgcccttagcccactttctgatgggattgtttgtttttttttttttttcttactgatttgtttgagtttgttgtagactctggttattagtcctttgtcagatgtatagattgtgaagattttctcccactttgtgggttttctgtttattctgctgactgttcttttgctgtgcaaaagctctttagtttaattaggtcccagctatttatctttgcttttactgcttttgcttttgggtttttggtcatgaaatccttgcctaagctaatgtctagaagggtttttcaaatgttatcttctagaatttttatagtttcaggtcttaggtttaagtccttaatccatcttgagttgatttttgtataaggtgagagatgagaatgcagtatgattctgctacatgtggctaaccaattatcacagcaccatttgttgaaaagggtgtcctttccccgctttatgtttttgtttgctttgttgaagatcagttgactgtaaggatgtgggtttatttctgggttctctattctgttccattggtctatgcctatttttatgccagtaccaggctgtgttggtgactgtggccttatagtatagtttaaaatcaggtagtgtgatgcctccagatttgttccttttgcttagtcttgctttggttatgcgggctcttttttggttccatatgaatttttctaactctgtgacgaatgatggtggtattttgatggggattgtgttgactttttagattgcttttggcactatggtcattttcacaatattgattctacccatccgtgaacatgggatgtgtttctatttgtctgtgtcatttgtgatttctttcagcagtgttttgtagttttccttgtagaggtccttcaactcttttgttaggtgtattcctaagtatttttttttttttttggcagctattttaaaaggggttgagttcttgatttggttctccatttggtcactgttgctatatagaagagctactgatttgtgtatgttaattgtatctggaaactttgctgaattcttttatcagttctaggagctttctggagaagtctttagggttttcaaggtaaaagatcatatcgtcagcagacagggacagtttgacttcctcttcaccaatttggatgccttctatttctcttgtctgattgctctggctagggcgtccagtactatattgaagaggagtggtgagagtggcatccttgtcttgttccagttctcagagggaatgctttcaacttttccccattcattattatgttggctgtgggtttgtcatagatggcttttattacgttaagttatgtcccttgtgtgccagttttgctgaggatttaattataaagggatgctggattttgtcgaatgccctttctgcatctattgagatgatcatttgatttttgtttttaattctgtttatgtggtgtatcccatttattgaattgcatatgttaaaccaattctgcatccctggtatgaaacccacttgatcatggtagattatcttttttatatttgttagattcggatagctagtattttgtaaggattttagcatctatcattcatcgaggatatattcttttttgtttgtgtcctttcctgattttggtattagggtgatgctggcttcatagaatgaattagggaagattccttctttatcttgtggaatagtgtcaaaaggattgataccaattctttgaatgtctggtagaattcttcagtgaattgtctggtcctggactttttttggttggcaattgttaaattaccgttttaatctcgctgcttgttattggtctgttcagggtatctaattcttcctgatttaagttaggagagttgtatttttccaggaatctattcatctcttctaggttttctagtttatgtgcctaaaggtgttcatagtagccttgaatgatcttttgtatttcagtggtgtcagttgtaatatctcctgtttcgtttctcagtgagtttatttggattttctctcttcttttcttggttaatcttgttaatggtctatcaattttatttatcttttcaaagaaccagtttttggtttcatttatcttttgtattttttttgtttgtttcaatttcatttagttctgctctgatcttggttatttttcttctgctgggtttgggtttggtttgttcttatttctctagttccttgaggtgtgaccttagattgtctgttggtactctttcagactttttgatgtaggtgtttagggctgtgaactttcctcctaacaccttcttagctgtatcccagaggttttgataggttgtgtcattattgtcattcagttataaaagtgtgtccaaagtttcctgaattttttagtttttttaatatttatctttttatttctacatagtttttaatataattttagcatctttttatttttccatgtttttgaacaaaattataatgatagtattcacagatctttgtttcttaatttttctcattaaaattataaaaattctttttttttttttttttattgatcattcttgggtgtttctcgcagagggggatttggcagggtcataggacaatagtggagggaaggtcagcagataaacaagtgagcaaaggtctctggttttcctaggcagaggaccctgcagccttccgcagtgtttgtgtccctgggtacttgagattagggagtggtgatgactcttaatgagcatgctgccttcaagcatctgtttaacaaagcacatcttgcaccgcccttaatccattcaaccctgagtggacacagcacatgccccagagcacagggttgggggcagggtcacagatcaacagcatcccaaggcagaagaacctctcccagtacagaacaaaatggagtctcctatgtctacttctttctacacagacacagcaacaatctgatttctctatcttttccccacctttcccccttttctattccacaaaaccgccatcgtcatcatggcccattctcaatgagctgttgggtacacctccctgatggggtggtggccaggcagaggggctcctcacttcccagaaggggtggccgggcagaggcgccccccacctcctggacggggcggtggccgggcggaggctccccccacctccctcccggacggggcggctggccgggcgggggctgacccccccacctccctcccggacggggcggctggccgggcgggggctgaccccccacctccctcccggacggggcggctggccgggcaggggctgaccccccacttccctcccggacggggcggctggcccggcgggggctgacccccacctccctcccggatggggcggctgctgggtggctgccgggcggaggggctcctcacttctcagatggggcggctgccgggcagaggggctcctcacttctcagacggggcggccgggcagagacgctcctcacctcccagacggggtcacagccgggcagagacgctcctcacatcccagacggggcagcggggcagaggcgctccccacatctcagacgatgggcggccgggcagagacgctcctcacttcctagacgggatggcagctgggaagaggcactcctcacttcccagactgggcagccgggcagaggcgttcctcacatcccagacgatgggtggccaggcagagatgctcctcacttcccagacggggtggcagccgggcagaggctgcaatctcggcactttgggaggccaaggcaggcggctgggaggtggaggttgtagctagccgagatcacgccactgcactccagcctgggcaacattgagcactgagtgagcgagactccgtctgcaatcccggcatctcaggaggccgaggctggcagatcacttgtgattaggagctggagatcagcccggccaacatggcgaaaccccgtctccaccaaaaaaatacgaaaaccagtcaggcgtggcggcgcgcgcccgcaatggcaggcactcggcaggctgaggcaggagaatcaggcagggaggttgcagtgagcggagatggcagcagtatagtccagcctcggcttggcatcagagggagaccgtggaaagagagagggagaccgtggggagagggggagggggaaggggagggggagggagagggttttttctttaagctatctatttccttgaatatttctcccttcacttcttgtatcatattttggatttccttgcattgggcttcgcctttctctggtccctccctgattagcttaatagctgacctcctgaattctttttcaggtaaatcagggatttcttcttgatttggattcattgctggtaaactagtgtgattttgggggagtgttgaaaagccttgttttgtcatattaccagcgttggttttctcgttccttctcatttgggtaggctctgtcagagggaaggtccagggctgaaagctgctattcaggtctttttgtcccatggggtgttcccttgatgtaataatattctctcccttttcctgtggatgtggcttcctttgagctgaactgtagtgactgttgtctgtcttctgggtctagccacccagtgagtcttcgtggctccaggctggcactgggggctgtctgcacagagtcctgtgatgtgaaccatccattggtctctcagccgtgaataccagcgcctgttctggtgaaggtggcagagggtgcagtggactccgtgggagtccttagctttggtggtttaatgctttatttttgtgctggttggccttctgccaggaggtggtgctttccagagagcattagctgtagtatggagagggaccagtggtgggcggggccctagaactcccaagattgtatgtccttcgtcttctgttaccaggttgagtagggaaggaccatcaggtggcagcagggctaggcatgtctgagctcagactctccttgggcgggtcttgctgcggctgctgtggatgatggggatgagattcccaggtcactggagttgtgtgcctaggaggatttatggctgcctctgctgagtcatgcgggttgtcagggaagaaggggaaagctggcagtcacaggcctcacccagctcccacacaaaccaaagggccagtctcactcccaccacaccccgagtctgtttccaggcagagggcaggtggggcttgaaaacttgcctgaggctttccacttcccagagtatttggggtgtctcccgggtcctgtaggagcagttttctcaggattgctggcctgctcttgcagctgatctggaggtaaaattcacaatgcaagcctccgcatgctgctctgtctggagctgcaatctagtcctgcctcccgtctgccatgatccgaccagcatcagtttcaatagctcctgcctcctttagggactctccttcttctcttcatagttaatagattccttgagttttgtgtgggaggcttgtaccatctcacctagatagaagaattacccaacacttccactctcttcaacattttttgttttgaaaaaattaaaacttacagaaaagttgaaagaatagcacaatgaaatccatcctgcacctagattttttttttcctcctttggatgagccatttgagagtaagttgcagacatcatggcacttcctctctaaatatcttagcagctatctcctaagaataaaaatgttcacttctatgatcacagtatgattatcacactcaggaaagctactgttgatggaatactgttatttaaaacatagttcatattcaggtttgcacagttgtctcagtattgtcctttatttttcccccaataaaagatccagtcaaagagcacccattgcatttagttgtcatgtctctttagtcctttttctttttgtttcttttcctttcctttcctctctttctctctcttccttctttcctttcttcatgacattgacagttttgaaatgcccaggccagctattttatcttactatctactcctaaagcaaacataattaaggaaatagggagtttgccctatgaaagtttgcagttttttctttctttctcttacgaacctccatgattttatgacttactaagaagcctctaagatgatgctatatgcattcctattggatgtgtgaaattaaaggtagctttttcttcctaaaagtctctgtcctgatagactcttccagagactcacttctcaggacatttgtgaggctggtgaatatatagcaggtgcacttttgacaaaatggcacgtatctctaggaatttgtttctgatattcataggcctcgttcatacctgatcctgtattcatatcaatagtgaatacttagctgcatttcttacttagagtttggttggttcaagacagttgttttgtttcttagcaatagtcaaatctttcaacttaatactaatcttatatataaagaagaaagtaaatctcattctgattattagagcttttcagtcatgaaattaatgtttcttgttactatcactgattcctcttgaggtttcagtgatgtgaaatagtttgtcattgcatcagatctctccaggtgtagagtctcttgagtaaattttaggacacatcagaaaagacttgacagtttcagtatggggcaaatctagatgaatgagtttgtgttttagctttttaaatattaatatactttttttaaaaaagttataaacaagagaaagacaaatattcagagttgaagtaggagaaatctttcttcactaaagatcttggccatatcctaaagttgtattcaaaaagaacaatatttttgattgtttgtttggttttgtgtttttacatgattcccatatcctttatacatctcttcttcatcaattctcattgaatttcaaaagtagctactagcttagaagacaggaagttacagatgtgtggcaggcaagaatgagatgggagtaaaaattggctcagttaactggtttgtaacttcagcctgttagaagctcgtttcttttagtgcacatgggagctttttttggccatgggaaggcatacaaggttatccaggaaatttttgcttcattatgaaacaaagaaaatgaagtcctgtaagctccctgagacattaagaaatatggtctccagtccactggagataacacaagtaattatcacaaaaggtgttggttatcatttaagggggaaatattatgttgacataatacataatttcagcatctgttgtgccttattttggattataaatccagactaatagatctgtggagctgtttagcccttttcacatcaaattcccatgcctcctggaaaagttaacatatgaaagattcgattgagataggcactttgcatttaataacattttcattctgaaactaatattactaagtgtctgctatgtgtgaagttattttatttaattcatagaacaatcctgccaaataactattcttccctaaacagataaggaaagtgaggcctagagaggtaaggtaatttgtgcaagataacatggctagtgtgaggagtaagattcagattctgttctttctgactaaattttgccctagttcatcaattagtatatgtcttctcagagatcaggttaatcaccagtgagtaatgccagattagtaactgttgagaatgttgtgggaacaaggaatagagaccagttaatctacacacccagtcttgtcttttactggccaccaaccactgtaacctccctatctaacatggctaactggccaagtatgagatttcacaaatgtatgccgtagcagttgggccattggcctccaatcccaaagtgaaatccaagcaaaccaaactgtatcatgggagagctcttttcatccatattaggggtggacctaggactgatgtaggccaaagacttttctgtcctttttctaaaatccctgaggtaaatctcagatcttagtattccagtggtacatggaaaagcaataaagggccgggcatggtgactcaagcctgaaatctcagcactttgggaggctgaggcgggcacaccgcttgagcccaggagttcaagagcagcctgggcaacatagcaagacctcgtctcttcaaaatataaattaaaaaattaaccaggcatggtggctcacacctgtggtcccagctattcgggaggcgaaagtgggagtatcccctgagcctggaagatctaggctgccttgagctgtgatcgggccactgcactccaacctggacgacagagtaagaccttgtctcaaaaagaagaaaagaaaagagagatagccccagtgccaaaagccatgctgacatcaagtgcctcatggtgaccgtggcctcctgagcttgctaggtaggcaaagacaggaagaggatggaatcccagatgagaaaaatgggacttttgacactctggaccaaggaaaatttcctccccttgctcctgaccacccctggggaatggaattagtataagagagctcagaataggagaaaactgggaactgaggatagttgaacctgccagactacacttctcttctttggaatcagagttgcttcctgtgcgatggctatttgattttctttccccttcgggaaagagggatttaaacaaaagaggaaatgtagccttcacattctccttgtccctaggcaatgcctgtgcttaaggataaagaacatatatatttatgtggttctgttaatataaatacttaatacctgcataaaaggagtacctttggatggtaaaattccactttaaaaaattaactgaccagtttcagcaagcttaattattatagcacaagaggttttgtatttgttttgggtgatgataaaagggctcagtggtgagaagtggtgtaggggtgcggaaacaggggagcaatattctcaactgtaatgaaaatttatccgtgtggtaacttttgctttgaatatgaatcagagggagttcatgctttgagacaaatttatggttagcagtaagataaaggcctgttttactgccttctttttacttaataaatcttaattgctttctctccataaattaaagcatttaccatgctatatcctaattatcagatttgtcatgtatagcatcagtttcacagagtaattgccatgtgggctttttggaaaacatcaccttctactctttgttttgatgcctgagaggaattgccagctggattttcagtaaggactctagtcttgccatgtcacctcaattttttaaggatgtgctgatacttattggactaactttgggtgttacagcatcatgggctcaccaattgagggcaaagtaggaaggggagagaaatggtgtgaattgaggactatttagaaagacattcaatgttattcctttgaagtacataacaagatatttctcagtatagatcctagagactggcttttgtgaatagatttatttgtaattagtggaatttcacataaaagtactaaaatcctagagaatattttatggacttaagtaagttatataatcttctttattctgttaatttgcttagcaaaccctttcctggtatttaatgtagatttacagttgagttcaatccagatgagttatcacaaatgttccttataaattagttggatttcataattcttggctccacgcatgtgaaaagggtgtccacaaaatgttcagttttaagttgattggacagactagagagtggcattgtttttttgaatagctgtttatttatcaaaagaaaaaaggacagaaatgaacatagaactgtatgtatttgctgaggtagtcatggcctgtgtgttctcagctctgtgctacaccactttgctgctccactctgaatggcagggaggctgctcctgcaggctacagatcctagagccccagctcggctggcttctggctgggttaggccagcaggaggctctgatagaagactagaggtaggaggaaaggagcaagagggtatttcgcctttgctctgcctccagcaacatctctgatagaggatgggtcttacccatggctccagcttctagtgtgtttccagcatcctctgatggccccaataccctgtgataggagtggcctcctgctgttgagaatctcttaacttgcccaaatgtgccctctttgacgtttcagctcttctctcatgtgtaataaagcctctgtgttaaaagagtggtttccttttcctgattcatacattttgtagaacaatttgcttttatgtcacagcttatagtcttttgaatgttgataaaggaaatgttaaattattcattatctcatttaatcagcttggtattatatttaggtgatggggcaaagaagaataagacaaaatgacctgattgccctcagggaactcagtctgtttggggaaacagtgtgttccccaagtgccaggggagctaaatggaagaaagacctagactgtagtagtggtgggaaagatgtcacaaaacaggtgacatccgaaagtcttgccagatactaagatcttgctcaagcagatgaggaagaagggcattcccagcagaagcagcagtttgtatgaaagcatgtgtcacgtttggctgcaggagcatggtggtcagggggactggaggaagaggaagctagagaggtggtcggggtagaccacaaagagcattgaagcctctgccaggcaattggactttatcctgttaggactgggaagcagtgaaaaggattttaagcagaggaattacatgaacagatttatccttcaaaaaggtcaccttaggagaggtgtggaagagagactagagggctgaaaatggaggcagagaaacctcctggccaggtggtgagtggcagaagtcctggtgggagtgggtggtgtttaaacaaagacctgaattaaaactgaaggcaagaggaggaggggaaaaatcaagaaatgttaagaaagtagaatgtgtagaacttggtgatttgtttgaaagtgttgggagttgttgttaaatgatggtctcagagatcatggaatatttgtctggtttagctaaataaatgttaaaactagaagcctgtttctcaaattggggtcgctgtgtccccttagaggtctcatgcaaactctgagttgtttatgctgccttatgagctagatgtatcttaggtttcaaacaattatgattgcagcactactcaggtcttacaataagccagacaagcaattctttattaaaaatcatttgctactcccaccacccaccaccccaagatctttttcctggccattatgtgccttatctctctctactagtcataaaatttgttggccacccactgtgtatttatctcatctcctacctctacccatcacagctttctcatcttctgattaaatagaagaattagcctcttatttgataaatcattgtatgggtgcctgtgtctaagggtttctgaagtctagcaatagaacatcctctgctcgttgagaaaacatgtagggtcacccatcaccaagcactccacatgccagagactgcactgaaagaacactcaattctttcatgtagttaaaagaacacaatgcttgccctctgagagttcaacatctggaaacaaatctaaagagggagaaactggcaagaagaaacacattagaaatagcatctgccttaaatgatgtacagtaggatttgggttgaggtgctgctctggagttatggcctgctgttagtagtcttgatagctaaaactaacatgcttttttcttgtaagatttcagattgaatatagtggttgagagcctggattctgggatctgacttcctggctctgccacttccatgtgtcaccctgaccaaactgtgtcatctctatgcttcccttcattgtaagatgaggatcataatagtatttaccctaggaatgagaggattcaatggcatgtgtgtgtgatgtgcagcacacctcctgacacagtgtcagtgcacaataaatactcgctgctgacccttcctgaagccaaaaagaagcctctgaaggctcagctgagaaaggtgtgctgcgtgagtaccaaaaattactgccttctttccaaacgagagctgctatggctaaccctgagatcctttgtagtcatttaattacagagaaattctggaacatactttcttcaagccaagttagtctttttagtttttaaattacatcttgatcgtatcacacacaatcagttgtcacttcagggcacttccagaaacaagtttgcaggccagcatgtggcaggtaacaccttagaggagactggggcatcactgcctctctgaaatcgtccattgatatcatcccctccctcctcctttgagctcagcacacattaatcaaataccacaatttttcaggttctgtattaggctccagggatacaagggtgaacagacaattcccgtcctcatgaaatgtgcaattgtgtggaactacatgtgaacaaattcaatccactgtgatggaagccccaatgggagtgtgtagaaggtcagaagaggtacacagaaaggacaacaaggaaggcttcacagaagtggtgacgtcccactaggattttgaagggaataagaatggggagaatcagaagatcagcacggtttgcacagaggaactacagcagaggtgttgtggggggacatggtggtagatgaaattgaagatgtaggcaggagtttgatcatgtaagagcttggcctttgtcgtgggaacatcaggggccattgagggacttcaggtaacagaatgccacagatccacaattttagcaggatcaccctagtatgaaagacaaacttgaaaagggtttgcagatgctggcaggttcatgtcaccactgcggattcattgagggcagagacagagtcctatttatctatgtacccctaaagtttagtgctttatagacatttaagaattttttttttcagagtgaagacagcccaagttgaattttcccattctgtatcctatcctcagaacatgctgacctggacttccatctgtcacaagcagcttgactaagatcctaggaaattcctttttttcttggcattcttctaactgacactctctgtttactgggccctctgtgcatctgtaacgtgtgatgactgatgcttataattctgaccttgaagtacttcatggcttctaaatcatcaaaaaaagattaaagcatattctcagtatcactgtaatgtttgtgtgttttactgccttcttctctggaaagtggtggtttatgaagtgcccgtgcgcttgtgtgcacacggacacagtgagagtctgtgatggtcctcaactcttctcccacagggaggctatggtgcgtgcttgaaaataaacaaacaaaataacctgggttctcttcatgcctagcaggaggaagcagcttggtcccaggggcaaagaagcttgaaatgagagcgaaagcagtggttaggaaagcagagggaatgatgaggcagaactggtgcagaccaggagtcaggcagtttacgagccagccctggctgactgcattctgaccccaggaagagcaaagcccagggtcgggactgcagcttcatgttctgtgtgcctggacccgaatcatcaggcttggatttggcgggattctccaccagctatgtttgtatctcagtaacaaccgctcagtaaaatgccagacattaggcaagtgaaaacatcaataattagagcctcctgttccccacacatcttttcttgaaaacctttattgctgcagagctgacattattaggcacagaatgaagaactccaaatagaaactgtgaaatggctccatcttataacctgagtcctgaaaaataagggtgtgatgttgtcactaggcgggagatttgtttaggttttctttttttcttttctttttccttttttttgagatggagtctcgctctgtcgcccaggctggagtgcagtggcgagatctcggctcactgcaacctccacctcccgggttcaagtgattctcctgcctcagcctcccaagtaactgggactacaggtgcctgccatcacacctagctaattttttgtatttttagtagagacggggtttcactgtgttagccaggatggtctcgatctcctgacctcgtgatatacccgccttggcttcccaaagtgctgggattacaggcatgagccaccacgcctggcccttgtttgggttttctttggggaccgtatattgcagtaaatagaaatgccccttccattttgttgtagaaatttgtttttaaaatctgtgtttggtctacactcgtcatcccagcctaaagagccagtccctgaaccacagaagttctgtttgccgcctctcagccacggcatgtgtgggctttacaggcagctttaccacttgccagttctgtgaatttgggcaaatgttttagactctttgggtcttagttttgtttttttaatctgaaatattggaataatgcagattccttattttacagcgttgctgtgaggctgaaataaaatggtggatgtggaaatgctcaactagaaggccctatctatatcaataatagtatattaaatatactaaagaacatcataaatatcctaacaaaaatagaaatatatttcatctgcaaacatgacatcctccaaaattgtcccaaagtagagtagggaaatgaactatttattgaatctctaccttaggggaggtgttccagctatcactttatctgttctgcaaagtagatcttaaatcccacttttagacacaaggaaactgagactcctagtcacagcagaagtgggatttgaacctgactcgagaacttaatgctccttctccttggctacattatctcgttgtctagttccagacccccagtgttcttaaaagctttgacattctttggtgctgggaagtgtgccagccatttcttggtcattcactcctgtaagtgggacagggtggcacccagagggaactggagcaccaggtgcccccagagagaccagcagcacggagtcgtccagtgtgtgggacaggccctccgttggcgttccacttttagggagttggcctggcatggacagaaagccaggcaacagctgtgccacatttcctagcccttgagaaaatggctacggccctgtcgttttcagaagttcattctttttctgtcaaagtgaagccacccttcctcaggactcctctcagcaatcagtgcctcttgtgtattctgaccggccccttattctgtttgtagagggagtgagattagatttattctatgtagtaaccactccgctaagcttttctgcgactcttcctgttagctttgatgccgggcactgggggaaagggttcccgatgtggcagttccttaagtgcccggtgggacccactgctgcatacattttcttctttatatccttccctgattcccaggcaaacagactcggcttgtgaactggagctgcccacccagagaaccagagataatgcctgttgaagggccaagttgcatattcagcgaggatgtcagtgtgtgggagaagcatttgttcagcctgcggttctgagaggaactgtgtgttgtgttcccataggttctcaacaggaggtgtgtagaagcggcggtgatgacaggcctggctctgaactgccacataaacaagaagtccttgtttgacaggaagcactacttctatgcagacctccctgtaagtacactttgtgatccaccccactgcaagttctcagagctgggccagccctgctgtggggggtcggagcaagggaaaggggctgtgcctctcatgttttcagccagcactgtgtccatcccagcaggaagttcggcccagccctgatgcaggcaggtgcccctgatggttactagatcggatgcagttgtcctgattgctgacttcttgcttacctcatgcttctggtggctcgctcataattgcacagggagtagaagccagtgtttgcaggctcagcctggccgtggtatttggtgctaattgcctgttagtacaaaagctaaggctctggctgatgcaacagtaaatgcatactgtagttctgtcagcagagcgagagcgaatcgcttttaagttgaagttcccaataatagggctgtctcctttggagacatttctgtcatctcacaaggagcaagtaagtggacaatagtaagcggaaacatgaaccagaaatctggaccaagaacagtaaactgttggtccagttacttggctgagcagtaaactccatattgacccgcttttttctgaaaattaaaaggtttttttctttaagccacaccatgtgagtgagagccaatttttcatactattgaacaggaacaaaactgaaatgttgaatgggtttcccaaaataatgttttgtttggtctgattcagaaaaacaacagtgatgatgttgcttcacctctttctccttgaactgaagattggggcgagctgttttttagtgggtgagggcacgagtagaattaaataaaaaatacaagtaagacctgcgttctccagtggctgctgcttttcccctctggcctccagcctctcagcaagtctactgtttggtagggcggaaagaattaaaccgcctttctttatcttttaagagtgacagacagtttggttgaggtgggagatttagtaataatatgactaaaatgagatgttttggtcatctgtggctttctggtctttctggcccagatagttcaaataatccagagtttcatgggacatactcatataataaagcatttgttgttttttctgaaattcagatttaactgggtgtcctatattttatccaacaaccctacccagagcttagttttacaaattgagacttcccgtctcagcatagaaaacgggttagccttttgcaggattctcaaagtgtggtccccagggcactgacatcatcatctcctgggaactggtaagaaatataaatcttcaggccccaccctcgacctactgaatcggaaacctttgaggtcgggccaagcagtctgtcttttgacaagcacagtagtatttctgatgcagttaaagttcttaaactgggggcctgccaagtggtgaaagacacggattttggagcctgaccatctgaattcagacattgacattgatgctcactagctctgtatgtggctgtgggcaaggtcttaatccctccacgccttgttcctccttcctagggttgttgtggaattaactgagggaacacagtgagagcagcacctgggacctaggaagtgccacagatgcctttgcttttattctctgttcttctccaattctcctcattgacctgctgtctctttagtgcgtattggtgcctctgtgcgtttgcaagtaattcttcctttccacttagaagcaggtgagggatccttgcaggatccatcagtgctttagtaccatgtgccttccattaatggagggggagtgtcacagcattttctgactggaggagctagggaggttgggtcagggagggcagctgccatgattgattcctttaaaaagcagaaacaaaacaagcttaaacacacactagcaactgctgttggccgtgtggagagtagatggcaaaatgcttagccagcattccaaataaggagggtctgccaggagcctggtaatgagatgcagagtttaggctaatgagctggatggaaacaataaattcttttcttaggggtccctgacaatgacattattgttattccccaatacagcactttaatgagggcaatgggatgaattcgtgttgtttattgcatcgttatcaggggtggaggatttggggagggtgaaggggtgatggcaggggcagaagagaccaggctcaatgatggctgcaatgcagcaactaatttttttctccttttcctttttttcttgttgtttttgctttaagtaggcctgtcgttgtgtgacattgtaaaagggatagtaaactggatcccagcttttatgtgtggaccagtgactatgtttaccctatgtttgtgtgcaggcaggctaccaaattacccagcagaggctcccaattgctgtgaatgggagcttgatatatggcgtctgtgcagggaagaagcagagtcaggtgatccccaagacggtgaggatcaagcagatccagttggagcaagacagtggcaaaagcctccacgacaacctgaggtctcagacgctcattgatttgaacagggcaggtaggcttggagtgttttcattatttctccttcctacttcagttcttggatagcagggccctcttttcaccgctagagttttcttgaacaaattgagaaagcagtcacaggagcctgatagatggagactaaaatatcagcattgggattggcatagctgactagcgaacatggcttgaactgtaattattaggcttgctaataactcaccctgaagttagacaaacctatccacctagtcacagacccagcagctggatattttaagcagtcattaaaagaagtgaaacatttaaaaatcaaaacgtggagcctaggtgcctacacgtgtaatgctagtgactcaggaggctgtgggaggatcactgtacgcagagtttgagatcaggctgggcaacatagcgagacctacttgccaaaaaattaacacctaggtgtggtgccatacacctgtatccccagctattcaggaggctgaggtgggaggatcacttgagctcaaaagttcagggctgcagtgagctatgatcatgccactgcattccagcctgggcagcagagcaagatgacgcctctttaaaaaaaaaaaaaaaaaaaaggtgggagggaagagaaatgattgagaggctagaaccactctgagagtccttcagtaaggcagggttttcctgaaacttaggcctaatttttctgttggtgaaattggagagctgcagtgaggctgactctgcccctctttggtaggagtgggccttctggaggtggtcctggagcccgacatgtcctgtggagaagaggcggcaacagctgtcagggagctgcagctgatccttcaagccctggggaccagccaggcgaacatggcaggtagaagccacagaagcagtattcttctttccctctcccttcctgccttctagaacctctctgactttagttttattttctgtctattatattgaggttgtttgcagccattttttccccagccttttgcaaccctgtttttttgttgttgttgtttgtttgtttgtttgtttagaattttccttggattctttgatgagcccccaaccaaatataaatatacgaccaacaacattgcagagacaccaaacccttaatgaaataatggctttgaacagttcagtctttctcaggaagaagacactgtttatcaagaacagttcttagttagtgagtaccgtatagatagcacttcataattagttgcctcttttcctttgggtctgtttctttccttttgtagatttttcatccatatacagcggaagccaaattatattgactataagccaagattatgaaaactttaccctgagataaaatcttaattaagttcagtggaaatacagtgggaaactaaaacaaataaaagaaacacctgcacccttgggaccagaccacacattataagcatttgtaaattacatataaagatcataggttttggtcacactcaatttcctcatggctctaggtatcctttgccctggtctggtactgctttgctctcccataagtccgtaaagggtagcctctgctatcattttctcctgttctctgttcctagggactttttgaaaacttcttccaccctcagagcacaccctgatggagaggagacaaaatataggttctgaatctacaattgtacttttccatagcactgtacaatggtcacagcaggtgcccaggaaatcccgttgatgatgatgttcatctccatgctggttgataatactgtttaccaagcttagcatgtcacataatgtatttgcatgttacagggggacttctggatttgtaatgccacatttgtcacataggatgtgtaataagcaacaaattataacatcagagccctggtacatgttgaatctgaggacagaacttgcttatttgctattttacttaaagactggaaaaacacagccacatgagtttgagtggcataaaggttagctgcctacaagtttctttacagagacaacactctcttttagagtaagagaattctcaattttagatttatcactcatgccagtttttttttaatccacagaacataaatgaaatgtgggcaagttggatggttatccatttatgctccaagtgttgattgctttaagaaagtttttattatcccattcttcttcaaaataactgtgattcctaccaaccctatgggatcataaataggtcacctgttaactgagaaatagtcccatctgggtccttgccaagagataaacgatagtggcaagaactcatcagtcagtgacagctgagagtgttcattaaatctcacttgttgtgacactttttgtttcttttaaatacaaatccaacagcttttaacacagcagccgagtagctttggttgttctaaagttccgtgggagctgaggtctgcctggagtctgcagggagccagctcctttggtgctgtgagcattttatcagccccctctcctttgctcatccttctgtccctcctcccacccctttaggaccactgtgttggccttggagcctgcagcttaggagctgagggccaccctgaagaggtgacactgaagactagtggacacccagggtgctgtggaatgaagcctaattgcttctgggctgtggttctgtgagttcctgatagttttgctgatgagcatagaccagcttagcccaggttccaagtcatttcattctcagtggacagccttttgcccctgttgtggagatgcccaaagtattaatagtttggtaagttgaatgtgtacagaagtagacatgctaagtgtttcaacgataataatatctatcagttggaacatttaatatatgctcctcagttcactaggcattttaaaattaatttgacatctcatttacattttatgacattgctgagaagtaggtggtagtgtttgcctgttgcaggtgaggaaactgaggcttagagaggtgggagttatttgcctaaggcttacaagaagtgacagagctgggacttgagcccaggtgtgtctgggtccaagagccctttctgtaagcacagcttcgtaccacttccctagtggcagccatggcagtgtcatgaccatcacagatgctgacttaagagaggcaggatagcaaggtggggtgccaagggctgccaggtcctggatctggcttggaatcctgtcctgcaacttctagctgtaggttcccaggctttgatttatctgagcctcactttccacacttaaaaaacatgttcccaaataattttgtacagaaggggaaaagaagaaaccaaagaggaaaggaaatcatcaaggccatctgatagagctgatggagttgcagcagctggctgagaggaatgactttgtgggagaaaacatagaattccagtttgggcaggttaagtttgaaaggccttgggaatagctcagtggctttgtcaccaaaaccaagagttcccaaccattttagctccggggaccggtttcgtggaagacaatttttctgtggacttggggggccgaaggcggggtggtttcaggatgattcaagtgcattacattgatcgtctgctttatttctattattacattgtaatatatagtgaaataattatacaactcactgtaatgtagaatcactgggagccctcagctggttttcctgcaactagatggtcccatctgggggtgatgggagacagtgacagattattagatggtagattcttataaggagcacaaagcctagattcctctcatgcacagttcacaatagggttcgtgctcctatgagaatctaatgccatggctgatctgacaggaggcggagctcagatggtaatgcaagggataaggagcagctgtaaatacagatgaagcttgtctctcttgcccatcactcacctcctgctgtgccatctggttcctaacaggccacagaccagtacctgtccatggcccccgggttggggacttctgactaaagctatattacaatgaatgtactaatgtcaagaaatgtactaatgaatgtactaatgtctagaaaacttaggacagggcctcgaaaacagcctgtgctggatacatgttcggtgctcttattaacagtaataagtagtaatacttttatggaattaccactcatctagatgagtgagctttgtaaaatacgttcagtaaaatttgttcgctttttttttggtcaaaccttgttattttcagtgatcagaacgagatagcttaacaaaccttacccactgcatctttgggcccctgctgtttgcagaaacagttttccatcttgatgttatatttctgttgtgtgagtgtgttttagagaaaaatatgaaactgcactttatcactgtgctcagtggtatagttttttttagttttgctgttataaatctctacttctagaagatagaaattgagcctgatgccattctcatgatgtgtgaatgaaggctgtccctcagtggtgcagaatgcattgaagtaaacctaactagtaaagcttttgtgcacttgaggcaatttaacttaatttgtttaaaaggtattttgtcttcactagatagcatgtcttttgttaatgtttgatactgcatttgaatccaggctggtgaactctctttcaacactgcaggatactaaatgattcctctcaggtatttatggagtgtagtcttctctgggagagaccgaaactcatgcttttattcctcttccaaattagaattctaaattgtgaaagatgctttcatttttaaaagcaggcgaggtccaattcatggttccctgagttcaaaaaaagttgtctcccaagtattgcaatttggttcgatggagctcagcacactttggaagttttcctttgagcttaatgggcctttcagaggattccaactgcagattagtcctattcagacggaactgtagaacttaccgggaacctagtgtgagacagaaaccagtctgcttactcattgctcaggaaaatgccagcgttctggcattcgtcgctcaataagatttcatttattgaacagtcaccaagtgccagacccaactctaggtcccacaaaaggcgttgttcctgccacatggatcttatgttcaggagggtgacaaagacattaacaaataaactaattacagcaacaaatgcctcaaggaaataaatggggtgccatgctacagagtaacattggaaagtgacaatgttgttttttaaaggccctcagaggaggtgacatgtatttaaaacctgaagaatgattcaaggcccaggcagcatagagccaggagacgagcattccagaaaacagctaaggccaaggccctgaggtgagaaagagctaggaatgggccacgaggtaagcgaggtagcacaaggccactgtgccagaagcagaaggagcagtggcatcaggtgacactgtaaaggcaggcaaggggtagatcagagagaatggcaagaagtttagctctcaacccaggtgcagtggtaatcactgaaaggcttttaagcaagggaaagacatagtctgatgaatgttttagaaaaccgctctggctgctctgtgggaagtggatttccgatgggtaagagtagaagccaggagaccagttaagaagcttttgcaatagttcagatggaagatgatgctgttttggacagcactggtggcagtgaagatgaaggagagacaagagagacatacaagatggtttttagaaataggctggtgtggaaggtaagagacagggaggaagcacaaatgcctttagggaagttggaggagctagatggtggtgctgtttaccgaaattggaagatgagatcgagaatgtctttgtgcaggggcaaatcaggatttccttttggaaattgagatgcctgtgaaacctccaagtggaggtgtcaaatagataccagagctgtaagtgtggagctcagagaggtctgggctggagagagaaatgtaggcatcctcagcatgaggtggtatttaaaactgtatccgtccacccagagagtctagataaggaaggggatcctgggtttggatgggaaggaagccatcagcaaatgaaatggaaacaaagcatccagaggacgaaaactgggagcaaaaggcagcagaagctgagctaggaagataattcacgaaggaaggattggttggcttgtcaaatgttgctgaggcgtccagtaggtgaagacaagcgtgtcctgtgtccgctggatatggcagccaggagactgttggtgactctgacaagggcatttttagagagatggggagagaagctaggctgacgtgggttaaggaataaatgggaagtgaaacagcggagacagtgtatgcaacaaacaaacaaaacttgtttaagaggctttgctgaaaaggaaaccagagaaacgatagatgagtgactgatagagtgagaactgggttcaagggaataggttttggggttcttgtttgttcatttaataagaaatactattgcatatgtatacgtcagatggaatgctgagaaagagtaatgactggtatgggagagaagggataactgagagtgatgcccttgagaaggcaagtgggagttaaaatctggctcagtcctcaggggcctttcattctggtcttaaagatggaggccagtgcacagaagactatggtcatgtactgaattctgtagtatagattataagtattctgatagtttaggggacccaccagtgcaggccagcttgctgaggagggcttctaggaggaggcggtaacactcaagtgagtccttgagggatgaggagagggacagtagctctgataaagagagcgtgctggtggagcagacagggttgtgtatacagaaggctgccctgattggaggggagctttctcccggaatgagcagtgggaacatacaggttatgtcgactgaatccagatgacagctgtggagcaccaagcagaggagcccagataatccggtaggagctgtctgtgctgttgagtaaacagcaggaatgatgaacccagactatatatagcaggatgaaagttacagccacattgccagtccctggacaaggagggaactgtgttgagtcaggatgtgctcttatcacctaagcctaaagttcggagacctcgggcgaggcaccttgggcaagggtggtagccatggaaatggaaaggccgtgacagacattagtgatatttgacagcttccaaactggtaggggctagttgccagtttggatataaggggcaaagaaaacagagaagtagaagatgacctcagggttcctagaccgagagtctcacggtgtcaggaatagttgggacttcctgagatgcagatacacacaacttgtcaaaaaagggattaaaaatcaggggttacagaattcttgtaaaagtgttgagaagtcagtgctggagagagtaatgtctgagctaagagacatcttttccctgtcagcacgggtggcaattgggcgagcccttccctttctctgagggtgagtggtgaggtgtcagccacgggccgccggcgacctccagcttggtataggccccacagcccagcactgggagaatgacagagaaccagttccaagggtctccttttcttgacatggaattcattttgactactttattattttaatatgcttttgctttggaatcttgggaaatgaatttattcagcccatcaagacactcaggtttggcagattacttttaatttaaaaacgtaactaggaaaataaaatccagcattttgtcttctcactctgttctcttttaaatgttgtaaatgaaacgaggaacagagaatctgagagctttactttgtagggtgccaaatgtgattctttcttacctacatctatttgtcttgggatttttctctctctctcttcctcaagagccttttagtcctccccacacattgcctgcttctttagggcttgttgctcctaatctgaggggcctccagggtcaaagaaggtcctcccagcatggggtcagcacctctctgagtcccaccacagactcctgacttcgtaacagtgctgtctgtctgctgtagcaaatcgttagagcagtcaggaaggattcggagtcatgtttgtggaaggaagagattattacagtacctggaggaaggaggaggggggaaagcccagatttcagttcttgcccttgagctgcaaattctcaaggactctcctctaaatctcctggaatcactgttagaaatccacattccaatggagagcagtgtagggttatcagatatatgaggcctttcctccaactcagctctgacactttgaaaaaaaacttcagtataaaactgcagagtcaatctccattttaatagttttgtttttcttgtttagcacaaaaaaattagatctctccagctggcgaatctaaaacttctcttccatatgtgcataagcacacacatctgtatatgttcacatgtacaggcacacactgtagatgcctcaggactgtaacccctctcgagtggccagaagtaccagccacgacctacttcagaaccaaccgtgccttctctgaagttaggctgctataactaaacagcaggtagagttagatgctgcttcctttgacactccctgcctttaaaagactatgtcacctcaaagaatttctaaggagttgttttcttctctccttccagagggccagttgagagtggatgccaatatatccgtgcatcaccctggggagcctttgggcgttcgaacggaagtgaagaatctcaacagcatcaggttcctggccaaagccataggtgaatgccagctgccgctcctagtgtccttcttcctattgtttctctcttgctgggtaacaaacaacccagaaacttagtggcttacacaagaactactttcgttttcactggtccgttctgttggtcctgtgtcggctcactcatgtggctgtgggaaaccggcaggccagctgaagcagagggtccatggtagtcgctctcataccttggggccttgatgctgatgtctgctgggcttctccatccatgtgatctttcttcatgcacttgcctagccttggctttcttatgaggcagtgggagcatttcgggaggatgaaggcagaagtgagtcctaagctgtagacctcacacagtgtcacttccaatgtgttctattcaaagtagattgaggccaggcacagtgcctcatgcctataatcccagcactttgggaagccaaggtgggtggattgcttgaggccacgagttcaagaccacctgggcaacatagcaagaccccatctctataaaaaattaaaaatttagccaggcatggtggtgagcacctgtagtcccagctactcaagaggctgaggtgggaggatcacttgagtccaggagtttgaggttgtagtgagctgtgatcacgccactgcactctagcctgggcgacagagcaagactctgtctctaagaaaaaaaaagaaaattacattgaattcaaagcagacttgaggggaaattagactccacctctttatcagaggatccacaaaagatcatggctgtgttttaccatttaccaccttctttctgaccagcttgagatttactaggtcatggttgttcattttagattgaccatggcttgacctaaatggtcattatgttttcctgctttttatattctttttaactgctagattatgtgcccatgcagtgaagtagtagtctttctggagcacacactgtgggtatttctttgatgataaatgtataataactaaaatagtttagcaagataaatatctgagcagtcccgtagatataggtaactgtgaattcaaggggaggacctcagaggactaaaaagattttttaaaaccgaagctatctagagaggaagagggagggatggagtttgaagtgcaccccttcaagggtgcacagagaccaagacaactgaatctgttgccaaagttttgctgtagccaaaatgtttaatagagccctggtcttgtcaagaaaagtattagaaacagtacagaaaagatgattctagtcttgtattagaccttattgtcctgaacctgaagtgaatcaaccagcctcaatgaagacagtcttcaggaaaaaggcattaaagtggtcaaacggatagcttatgggagcagagagggaagggataggctcctatatgaaggcagactaaagatggtgaactgttctgcataccggaaagggacatagcccatgttcccaaagccatgaaaggtttgagtcagggaaaacccttataagccaagttggtgaggaggaagcctggaacaaatggaggaagttccacctccccctgtaggtagtgggctgggacccgttattttaagaggtggtgatggtaaccttaaaaaagcagcccaattttaggtagagtcatccatgagttctgaaggagacccctaaccttctcctgtcctatgaagaactctttggaggaccagtctgagggagaaatctccctgtggtctgactcagagtggaagagccaaagctttactatgggttcaattctccaagcctgtgatttttcaccacctttttctccctatgtcaggccatttagccatcatctcgtgtcaaccaaagagatcactggagttggggagagatggggagcaaaaactgacacgttttgctgttgctgcctcttagcaactcagataaaagggtttaggtttgggcaagggaaggtagtacatggtgggagggagagttaaggtggaggctcaagatattttcataaagcagtttagcaggctgggcttagtggctcatgcctgtaatcccagcactttgggaggccaaggcaggaggattgtttgagaccaagagattgagactaggctggaaaacatagtgagacccccatctctcaaaaaaagaaaaaaaaagcagcaacagcttagcaattgtggttgtgttttgattcccacagcctccctcatttgatgctgaggcatgggtccttggatcttaatcatttggggtcgtgggtccctctgaaaagataatgtaaatgctggaccctctctccaaaacctgcacatatgcacacaacccacactttgtgtataattttggggataccagagcctttgaagcccatcccagactcccagggtaagggccctgggtaggcagcaatctcagaccgagatattgggcccagccccacttctgccaagtcatgtcatctgcatggggttgcttaatctctctgaacctgaattgtctcaacacggagtgagcctgccttcctaaggccctttccaacaccaatattctacgatggcagtgagaaggaaatatagtgtgtaagggaaggattattataaacaatcttcttgattttttttttttttaacttagagattgagaaaggttgtttctaattattgcttgactggatgaaaggtataatcaaaatatgatgctaaattagtgtgtttttcctagactatgaaattcagaggcaaatcaatgaacttgagaatggaggtgaaattctgaacgaaacacgctcatttcatcacaagctggggtgagttcgcattgctgagcgtcctgaccacagccgggggtggtgcgagagggctgggctcagccactgaccagccatgtgaccttgaaggaggcacgtagcgtctccacttttaggtttcctcattagtacaattagaaaagtactgtacccttcatgcctgtaatcccagcactttgggaggcaatgggcagatcacgaggtcgggagatcgagaccatcctggctaacatggtgaaatcctgtctctactaaaaaaatacaaaaaattagccgggcatggtgatgggtgcctgtagtcccagctatttgggaggctgaggcaggagaatggcatgaacccgggaggcggcgcttgcagtgagctgagatgttgccaccgcactccagcctgggcgacagagcgagactcctctcaaaaacaaaaaagaaggccaggcgccgtggctcacgcctgtaatcccagcactttgggaggccgaggcgggcggatcacgaggtcaggagatcgagaccatcctggctaacatggtgaaaccccgtctctactaaaaatacaaaaaattagccaggtgtggtggcgggcgcctgtagtgccagctactcgggaggctgaggcaggagaatggcgtaaacccaggaggcggagcttgcagtgagccgagatagtgccactgcactccagcctgggcgacagagcaagactccgtctcaaagaaaaaaaaaaaagaaaagtactgtaccctatagggatataatataccctagggctgccaggaggcttgaagtgacccagactgtgcccaagggcttcgttttaggccctttccttctctgcttccagcttacctgccttgtggcaagaatttttacttccttaatctatcagatctttcccagctgaagctagaggcggaacagagtgaagacctggttgtagagatgccttatttttgtttagataacttgggccttaattttctcactcagaattttgagcattgtatacttaaagcagaatactgaaaaaagctcaaaagccgagtttgagctggctgaaagatggctacattgaagtcatttcctttaaaaaaaaaaaaaaaagatcattctgtacatttcgctttctttatgattgttttttgaatgtattcatttaaggtttccccatggaagtccacagagtttgattttgcctgtgccccttattggtaggggagcccttccccacatataggctggccagtgctgctttcaatgtttaatgttttcttatttaactattgcaggtgcaccatgtcaatgagagacaaagaaggaaaacaggactacaggtggttactccttatggcaaaataccgctatatatcgggggctggggcgtatttcaagttcatttaaagttcaacataatgatcctgaacaatttttagaaaccactttttgtcattgttgtaacatgatgggacatctagacttcctctttgatatgcataccgagagaagtactagtttcttgatttggtagcctcagatctggtgccttgtttgactgattcagcttttggaagaacttgttcatccactgctgtgtcaaagttgtcatagttgagctaggaggatggctgtagaggttggggcctaggctgttcttattctaatgttcagtaactgattcagtaatacgctgaatgaagctccttgagaagaaatgagaaaagagatgttgatagcgtatgttgatggtagttcccttgaacctcatatgatgctatttcatgataaattaagttgaactacttaatatgagacccacaaataaagcaaatgctaagaacaggcataagataattgaaacttttatttttttctcattgagtttagcaggttgaagttttaagcaacaaagttgtgagatcggccacctttcctttgtgaagggcagaaagatgcaaatgtagctattatcaatgaggatcaaaatttgcatgtttatgtgggaaagaagaaactcataaacgcttagcatgaacctcaccccaagaactcccattgtctgtctgctagagtcaaaattattttaattaaccgtgaacttcccgggtgagtctgttctcccaggggcccactttattcctgagtgttgctccctcccctgttggtgcgccttcccctgagtgtggagtccggctttccatccgcccgtggcttcagcatgatgcctcaaatgatagtgagctgcaggaagcttcccctgggtttcctcttgccctcagaagccagactaactcacagaagagatctggcagtgagccgatgggtagcgtgtgcttcgaatccattccctccaaaccaccacttcttctgaataccctgctttttctacataagccctttgacaaaaatgggcagagagtaaccattagtgctggacgagaacagagggagggacatcttgtttcataagattacatgcaatggtgcagctttgacacttaaaaaaattaattcccttcattttttagagcagttttagctttacaataaaattgaatggaacgtccagagttctcacatactcccgctccccactctccccccagagtctcctgttaatgtgccacagtaatgcaagatgctcatttgttacaatgatgaaaccaatcacacttccttattggctagagtccatggtttacactagggttccttgtttgtgtggtacattgcgtgggttttgacatatgcacaatgacatgcatccaccatcgtgtcacactgagaagttccactgcatgccctgtgctccacctcttcatccctccctccctcttctccagctgtcacattttgtttaggcaaaatctattcatttcttctatttctcaagggtaaatttttttcctttcattttttatttatgtaaatgctgctaaaaatagtagaaatgttgaaatggggggaaagtcatctttccttctaataagcaaattgctctcatttggtcctgttttttccagcctgtgtctttatgaagacatagtcctgcatacatatggatgtttctgtcaacagtggattacgtatgctacaggagtcccataagattgtcatatggcatttttaccgtccctttcttgttcagacatgcttagatacaccaatgccattgtgttacagttgcctgcaggatttgggacactcagtagccttggagcagtaggctactccacatggcctatctgtagtaggctgtaccatccaggctcatgtgagtgcactctgtgatggtcccatgacgaaatcacctaacgacacatctctacgaacatatcgccgttgtgaagcaacacacaactgtgggcacaattcctgatgaacagtggaatgaatgatccacagttacaaatcccagtgtgacttcaagcctgtgttgtgcttctttcactcatcttatttataagcatggagaggggtgggtttggaggttttgacacttatgcaatggcttccctgggaaacagaattgacgtaataggacatttgaaaatatttgcaagtaacatggcatctaaacacagaaacattcatattactgggggaggttttgttttctcattaatccaagtactccagattcaggtcccgtctcctctgtctgcccaggttcatgccagaacccaacctgcctcccctggtgctctacgacgccacatctctgcccgcaggtgcagacccacagcaagtgatcaatattgaccagattcgggagacactcccggagctccccagtgtgacccgagagaagcttgtccaacagtatgggatgctgctggaacacagcttcactttgctggtaggtatcgatcggatgccaagaggatcccggctcagcagatggggcagtgcccttcagaggccccgccacacacaggctgccatgggctctgagtggggtgggcgtgtttcttgggttgtactatagatgctactgagaagaataagatgtagtaacctttgctcactaccctttatggtaaatgctcttcatacaaccagaagatgaaacgcaatcttgtgttagtcatttcttctgtgtagaaatgaacgcctgaccacagcagctgtggagacttcttgaagactgtccaaatgttatggatgagtttttcccatgtgtctgaaggacaaaagaaaatcaatgtatagggtttctggatgtctagcggtatcgagccatgacagggctggcaggatgttgcgttctcaaaagccagccagttgttttgccaatttcagaagaaaacatttattccacatgaaacactaaaaactctgactaaaagtatcagtcctttgaggcttgaggctgcgtctgacggggccggtagagaacctgacactgtcaagatctgcttagggattttccatccttttcaaagctgcctggggctttgtggttttctttgtcatggcagcattaaagtgatgcggcatcagtgagggtagtattttgtcaccgttgtcgtcgtctgttaggaaggaagtgggaagttttgttgctgcatcttccagggaatcagtatatgccacacctatcttttggggcagcaggatctgcggaaactggatttttgctttttggatggccagtcataactacattgggatgctggagtatatatatttatatgtctatttatacacttccaataacaacatcctagcatttacagtacaacgtaggcagtcagatgcatgttgaatgagtgattctctcttcatcatccataaatcagctacttggagaagcagagttggtcactgcctcctgtgggctgctgtttgatcttcttcttacctctctggcaattatatcactgtcttttaagtacttattagtgtatgttgttcagcatcttgaaggcaaggactgcttcatcctctgtgctactcagcacagatgagcacaacatcagcagtgcttaatgccacactttgactatgactgagtcagtcagcattccgtacagagcacctcttaacccaaagcctcttacaattcatgtatttttcctaggttgacgtaacaaaactacgttttagtcttatacatcttccccaccatcttgaccacttgagtttccaacctacttgaaataaacactgaattctagccctaccttttattactatttgtgaaattacataggagatgggaggaagggaccaaggctactcagcctcgaagatttaagttacctccctccactcagcaggagcccaagccaaccctttgaggtagtgtatgatgaaccaagaaatggccaaggtttccttgctcaaaatgtgatttcatagagaaattgactatatataacattaatttgtgtgtgtgtgtgtgtgtattagctgtctccataagagagtgaaagaaactttcagaatctcaagaatacagctgtttctgttcaaggcactgtatgagaatctgtgcccccttcagagggcatttccataggattgtcactctcggccgttcatgagcggtgatggggacagtgcctgccttacctcactgagcataagctccatgagggcagggacatttttgtatttgtgtttgtgtccttgtctttattcatgggtcctgcatggtgcccaaacctagtaggccttaaataggtgtttgctaggggctggcagatgagtgagtctatattttaatagtttaaaggcctgtatagggaaacctaccttcagttatttaattcagcacttttttttttttttttttgagacagggtctcaactctcgcccaggctggagtgcagtggcacgatctcagctcactgcaacctctgcctcccagattcaagacatcctcccacctcagcctcccgagtagctgggattccaggcatgcgccaccactcctggctaattttttgtatttttagtagagacagggttttgccatgttggccaggctggttgaactcctggcctcaagtgatccgcctgcctctgcctcccaaagtgctgggattacaggtgtgagccaccacacccggcctggttcagcacttttattagcatcttctgtatagcacgtactgagacagaaacaaaagatttttttaaagattttttttgccttccaagaatttatacatacacatgcacacacacacacaccccactacaataaccagcccacaggacagattacactagatagatggataatgtaggatcagggcccacaagaggtagtggttaacttgattggaaaaaaaaaaagaagggtgaattttttggccatttttgaaaggactttttttgataccttaaaaacgtccttatttttatggcttgcagataatgtattgggtgattagtatttttcctttaaagggctagtacttgaaatttccaagatgagtgagattagaatgagataggaatggaaagagaatgattcagacaaattgttttcctgaaattaggcagcctgagccctttatgactttgtaatcattggaagcggcgttactcataacatacccgaaaatgatatgttcgtgttttttcctgccttcatcagaaacacaacagattgctgagaagggcagatgcacaaatctaatgaaccatctttcaatttaaagagcgcccaggagtattcattaaataaatagcagtggtggaggtgtgctttgcagagctgcaactctgtgctctctgtctttggattgcttattaaattaagcattatgcacatgcccacccccatgcacacctcacccacaaatgacgaaaaacttcagaatttaactctagtctttaatttatcttgtcattttatcgtgcagtgagcaccaaattattcttaatatttacagaactctaatgttatgctttagcgtctaccacacacaatacctgacacggtaggtactccatgactgggtggacagacgggtgagtgaatgggatgttatcacagcacacaggaagatcctgggagaagcagtgttcctgataaaagcatccctgtttccaaaggtcagatacataaaccatgctttgacaacccagagaatcatggggtatcttgccccacctaaaacttcaacctatttagctaaccttgcttctctagcttatgtcaagttgccttcatttcatatatatatatatatatatatatatatatatatatatatacacacacacacacacatatatatgaaatcgatttttgtttgtttgtttgtttttgagacggagtctcgctttgtggcctaggctggagtgcagtggcgccatcttggctcactgcaagctccgcctcccaggttcacgccattctcctgcctcagcctcccaagtagctgggacagaaatcaaggcaacttgattttgtgcatgtgtatgtatataaatatatatatcaaggcaacttgacataagctagagaagcaatgttagcttttctatatatataaatttatatatattataaaacatatacggaaatatttatgattataaaatttattataatataaatgtaggggctacaagtgcaattttgatacatagatatattgcatagtgtaagtctggacttacagtgtaaccgtcacccaaatcatatacatcatacccagtaagtatttgtcatcccttattcccctcccacccttccaagtcttcagtgtctgttattccacactctgtgtccctgggtacacagagtgtacccacttataagtgagaacatgtggtatttgattttctgtttcagtgtcgtttcacttaaaatagtggcctcctgttcatccatgttgcaaaagacatgattccattcttttttatagctgaataatatttcattgtgtagatataccacaacttctttatccagtcatccattgatggacgcttacgctgattccatatctttactattgtgaatagtgctgtgataaacattcgcttgcaggtatcttttttaaatgatgatttattttcctttggctagttgcccagtagtgggattgctggattgaatggtagctctatttgtagttctttagggaacctccatactgttttccatagaggctgtactaatttacattcccagcaacagtatataagcatttccttttctctacatgacctcatttgtaaagattaaagaatagaaatgttgaagctgaaatccaggcattaggattctgaaaaaacgagagattctaatagcataacaagtttttctctgagtcagtatatcagtagtagttattataatacaatgatcagaattatatgcatgtgcatttttcttagcaaaatcctccctggctgatttctgtggggcatctcttcctaaactctgtgctttacttcactcagagaacacaaaagcattgtagccatttgcctaagcagcctagaaaaggctgcctgcttctagcatgctctgcaattcacattgtacgactttttaatctatccttacagcaaccctctgaggcagggactgctgctctccccatttacaggtagggaaatgtaacctctttggttcaataacttccccaagcccgtattggagccacattcagatcatgctgacttcaaggcctacgctcttcattcctaagctctgctgcccgcttgcatatataatgtgctataatgtcaaacagaaatagtgtttttagttaattgatgtttggagtcacttgtgtttcattagtggagaaaacagagtttgtacttttgttaacattcatgccactagcgttttgtacagcacaatcacagaacatagattcatttaaaagtttttaccactcctattgatttttaagatgccagactgccctataaataaacataaagtgccatccactaaatttagtgaaaatcagtcaacgccaatgaaaagcagaaatcatgtctattttccaagtgaaaaaataaagttagaagaaaagtaatataagccgtcctctgcagctttatttattttgtttcttaaaccttctgctggaagcacttgagtcctgtctgaatcgttgggaagttccaggcacggtgactcacacctgtaatcccagcactctgggaggccaaggtgagaggatcacttttggccaggatttcgagaccagtttgggcaacaacgtagtgtagtgagacccctatctctacaaaaaaaaaaaaaaaaaaaaaatttaaattagccgggcatggtggcacacacctgtagtcccagctactcgggaggctgaggtgggagaattgctcgagcccagaaattcaaggctgtagcgagctgtggtcgtgccactgcagtccagcctgggcaacagagagagaccctgtctctaaactttaaaaaaagaaaaaagaatctgaggagtgtctccacgtagggcagagtttgtggcatttgtggtttgattttgcctggtgcctcctgtccttcaagactggcctttaataggaacttggtaggaagcagagatgagcttgcagggccctggctgtgcatgcagtcagtagacgggaagatctgaagctcgtcggtgggagagttcagcggaggaagccagagcatcccgagttgagtgtttcttgagggcctgccaccctgactgcagtgccggatgctagttccaaatgtcagtgcttcagcttttccatgtctctccagagcagccctacagggaattgagttaaaacactgacttggggacagacacccttgattccacatctgacctctgacactttggagctgggagggctctgcagggtaaccagagctgtttccctccccagctgaaagagggggcgatgactcacttaccccaaagatgacagacacagccaaatcttcattgaatctaaagcctaaatatagccaagcagactcccaagaatatgtcgccagggagaagagtgttgacaccaagcaacgcgctaaaacagttcattgagagccacgaaaggcagggctgtagaaacatcccacatggccccagtgagactgtaggaagatgtacttgcgagccctcgaatcagcaccctgggctgccatatgcttgtctttgtctttatagtcagcctcaggatctgtcatcttacttacacaacttcattctctccagctggttcttccacttttaaaatcataatcctttgtttctgacatcatggaaaaggttaaggtgtctccaagggacaaagaaacagaaaagatatcatgactacagctggttgttaagtggattgtttttcaagaattttcctttaagtggctagtaagccagaaatgaccaggtttgctttctggatgaattgcctataaaataatttcccatgataaatatctatatatcccatatgtaatactactttaaagctaatagtatctacaaacatattgactggttttagactggccagacttactgaggtgcaaagtactcaccttctaactactgttgaaggaaaatctatttggtcaacatcatcaggcaccatatttcagctccgtgcaattttcaaaattgattttattcttcattttataaaaattgcatccagtgcttgctagcctaagggtgcttttacagtgactctatacactagaaaaataaccaatgttttgttctggtaaagttgaataaaaagatgtatcatctaactctacttctgtaaaaccagcagttcatttcttttggatgcaagggatgaggagctttcagaggggaagatgctctgggctcagagccgtgtgacacctcaggatcctgcccagtagggagacagtgcagggaggagtaaagtcctgagtgccagccttggggacccacagggattctgtccccaacctatcccaaagcccaatttcctgtggaataatttccttttcaggataaatatatattatttcaggtttcaggcagatcttggaggaaaggagcaaatcctcactgcctctgttgctgtttttaagctgcagccagaaagctcctattgagcaactcaggttccttccatgtggggacgattggacagtggtggtgttaggtgcgttggaacgtgactacaattggaattgatttcttgacaacacactgcctgtgtcccattcgtgcagatagtcttttagcagtgccggtctgctgtcagcttgtagtacctgaattatttggattttgattattcgggggaagttgttattcccaaactggtttccttcagcatctcccctggagttactgcatctcagaggatgtaaagtcattttcacattagtttgaatatcccctaaatggaactggtgcctgagttgaactcaagatctgtctactttccagctttcctgggaacatagcacaagtgaaatggttggggccaaagttttgctcagattttaggggctcccaagccttgctggggaaatgacccaggaataaaaattgtgggcaccaaaacaggaccctggacccctagttctgtgttccttgggagaacacacccgtgatgtttgtgggtccatttcagagcctctgcagatccctgtattcttgccagcagcagtggaggttctgcattgttctagctttctcctgacactcttgaggggggggtcgtgtttcctgtgccagcctcacaccaccagttaacttctgtttgttttctccactgacgaggcctctctcaatgagtaatttttctgttcacaggagcactcgctgaaagattattgcagcggcttcttgtttctgtgaaaagcagaaggggcaccgattcccgtgaacccacccaagccaccgccccactgaacattccagtccttagccttgccctgacgcctgctttctggctgagagccatcactgtcctgggcctctttgcttcattgccatccccagcactagcatttggtgttattttcagggccatttttttttttacatagctgttgtatttgagttttgtttttctcactttataagaatgaccaaatccacaggaataataaagcagcagtgcctgcgttgatacgcaggtgatgagcctcctccagcgtctgcacaaatgctcagcagctgctcaccccagcacccccgccgcaaaggggacggatgcaattccagtgtgcgcctctgcaaaatgacacactgtgacgtgggagagccttgtccagtggaaacccctgtggttccgtctgcagatgtagagcctttgtatagtcagcagctcccatcacaggcatgacctgctcaattaggtaggacttaccctattagaggaattagaatgcaataataaataaaatacaatatgctcaattggtatgagaaataacaagatttgtcttgttcaggactgtgcagtgtccaggtctgggtgtgctcgcaggaccttttctggggcagcagtagcgtggggaggggatgcagaggcaaggcagggggcaggagaggggcagaggagctctggccgccctccatccccggagcccagtatggcctgtgcagtgggcgtgcagctgtcttccttcctggtctgggaacaggtgtgtgtcatgccacagctgaatgccacgtggcctaggtgtacactggcaaaggcagaaagtaaacctgccattttctccttctgatttcaaagttaatttccttgcaacatttttaatatgttaagaacctttgaacagctggcagctctcaaataaaataatggaagtgtgggaaagtgctttcttcagatgagctggctgcctcccattgcgcctggcactcctaggtgctcagtttcggtcccaggcaggcaaagaccatgaccttttcttcctcaaaggcagtgccacacagaggttaaaagcacaaaccgcagaggtttggtcctagttctagtgctctcttgctgtgggacctcaagcaagctagtgcctcgtgtcctcatctgtaaaagtcctgagagcgctgagctcagagagttgttgttgggatgaattgaggtaatgtggagagagtgcgtagacagtgcctggcgcccatcaccgctgctgctgtaactctggttatcactgtcctcagcagcagcagtagcctcacgcagccacccacagggcctggttctgagctctgtgtctagcagatatttagcagatactcttgagcacctttgactagcccagaatggctcatctgggggtcccttgtagctgtcagaacgctccctgtcacataaccagctgttcctcaacttgcattcttctgggctgcttttccttctctgagtctgccactgggcagctggctctatcaggtttccttctcgtaaataaatatagtccacctcgttcctggcctatcgtcagcttcacagggtgtgtgacttagaacaagaaatgcagttgagaaatcagccttcatcctattccaactggagagtcttccagcatttgcatttgatcatctctgaaggtgggatgcagaagaccgcttcgaggcaggttgctcccagggcctagtgcagggtagactgaggttccttccctgagcaggcagtggtggtgagcaggtccctctgctttgcctcacaccagcattgatcacctgacaaatcattagtaatcaagggttcctgttaatgtctgagaggcggagccagcactggttctgggtgtaattcagtgctttgggaaatctgattaaaatgtgaaaaagatgcttcccagtcatagagctgtagagactgtcaggtattatacaaaagacaggaccgctcatgcctgctgctttagccatctctgaaggaacaattagagtcgcagtcagccagggaacttgactctctgtgtcgctgaagttgcagttctattgcatgtagggtagattcatcctgagtcgaatgcttgcttgttgcttttgaggaggacattaaaggttccctaatgctgtagcctttctgcattgctcttcatatgatttttatgtaagggaattaccagctcactgtttttctgagaaaaccagatggctgcactgacatgttcaccagagactctgagattcgtgccaagcttattagcatttgccaatctcatggaaaaactaagaagatgaggaaactagaatgtgtgtgtttcttccctcagaagcagcttctgctatgaagagcagagcgggcagcccatgtgcagcttttattgatccatcatttcctgggtggctgcagctcagcctccttcagccccactcgctatagctcaccccatcaccaccacagattttcctgtctgctttaaattgtggactgaaactatgtatcccctagtgaagtacagttccagctcagagaggcttcatcacagcactgacatgaaaagacaaacagaaatctgacttgccgtgttatccatccaataaaaaaaccacccaagggtagaggaatagatatgcatcacgtcccagcaactcagccaagcctgtgagtttaagtgcaatatttctaggtggatttagaaaaccctttccctggcaaagcaaagagttctcctgacagctcattttaccagtgggccagcctgtctgggttagaacaaagggaattctgcccgtctgatttgggccagatagcagttttctgcttccccagtgatttgtgtactattgtagaagtttgaatacttttccataagttaagcagaacttcctcttcaagttgcctggctctgcctttatctgtagtcaagcttgggctgccgaggtggcctctgccctggtttagcatgagcagaataatagcactggcttgaaaagagattaaagagatgattgcaggattattcagcaggcttgtcaccagagaatttatctgttacaaagaacatgtagggttttttattattatggaatttctgctatgcctgtgtgtgtattccagcagctgcaatagctacacttggagagcacttttgttagtatatcttgcttctttccagtatctcattttttccagaaaattcttttggttaatgaagggtctctgaaaggagcaggggtagaagccttaggtgcagtgtgaacttaaaaggaatatttcaagaaaagtttgtttgatttgaatttccatgggtaaaggaaatctgctacttaaaacgtatatcctctgaatttggaaatttcagccttccctttctgagcagcacagtttttatttttcttattgaaatagtaggggtggacttacctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaacctttatactgagcagctgccatggcccagcatggacttagctgtagctatatcgtgaacagggagggcacagccctgactcgtggggctgacagttcagagggggagaagtggtacagtcttgatgaaacaagtctccagctgatcatttccccaggaaacgatgagaggcagggcatcttgtacctggcccagctcagaaggctgggacactgctgccctctccacctgttattaagtggcctaagtgggtcacatgtgcccatgttctccctcactttgaaaacatttcagaaccattcctgtctatttcttgtcatgatgtgagaatcagtacaggtatgatccacttttgatttttcagaggtagaatattctgtttgttctttcttgattttgctttgttttttaccctcttttctagcaattactgggacttcagcagaggacaggcctggaaagaacaggggcattaaagtcaggccaaacattttaggcccagttcacagctcagggatggagagtgcaggttacacacagcagacacggagaaagcaagtgggtttgggggatgtggaatttcaccatccctctggtctgcaaagtcagggctctctaaaatgtgtttatccttttgagaaaatgctatgtaaatgcacagtgacagtagtagaatagttgtcattagctgaaagtgatcagaatgttctggtgacatctcagggtttagcaaagaaaaagtggctgtctcagaggaggcagaggggacagtttcagatttgccttcagaatgctgatctttcatttttggggaggctttatgtaattttctttttttttttttaacagaacgaagtcggcctactggagttcttccaaaatgtgataaaagaaactagggcagagccaaaaaaggtgactagttgggtcctcaacacttttctgggctatttaaagcaacagaacctcgctgtcagtgagaggtgagtgaggtctgggatttctttcttcctttgtgatgagctctgtccagaagtgctggaaatagggcaggtccatttttttgctcctgctgttctccctcaggatatcctgacatgacacaaacatcccctgtggactccacattctaaatatgttctctagcccgtgtaaaaatgtatttattccttcaaatctgtgactgtgcactgtgtcctctgcactgtgtcagaggctgggggcacaaagatgaatgagacagacatttacaaacttgtggaggatacagatctgtaaggaaacagccaccccagggtgatcctgtcatgccagaagcatgcacggggtgctgggaatgcacaaaaaggggagttgaacagaggctggggaaccaaccagggctcccctcgggaggggacgtttgagccatgccctgaagcattaggggagagtcgctctgcagtgggagggacagatcacgcagacaaagcagagtgcgaagctcagagagcagcagcacagcaggctcaggaacgccagaagctgcaggggccggaggcaggcaggtgggaatggtggggacagagccgcggagatgaccaagggccacctggagaactgtgtctgcctttatcaccagctcttgacagccatagactacaagctcatgccagtttcacactgcggaaatgcagtgtgtctcactcaactcaggccactatattccatagactgggtggcttcagcaacatgtctttcccatgattttggaggtggggaaggtccaggatccgggtgccagctgatgcattcctgggtgaagccctctgcctggctcacagatgtcctcacatgacaggcaggagttgaggggtgaaacaggaaggggggagggagagaaggccctccaatctcttcttataggatccccattcccactatggggaccacaccctcgtgacctcttctagacctcattactcctccagggccccatcccctaaaaccatcgcgcttcaatataggaatttggggtgggacacaaatattcagcgtctgagagcagactagaagcaggaattccatttgggaacctctttcaggaatgcggatgagaaatgccccaggcctgagccaaggtggcagtggctgggttgaagtgagctaggccaagttgagagcaattatctcaattggcagaacttccagatttcttgcttgggcagaggtgaaacagagggcagactttttcaatgtaggaggagctaaaggaaaaggaataaactttataggccgggggtgagggaagatgccgtattccatttcagacgtgctgacttcgagctgcctgcaggacagacatcacccccacggggctaaccagtaggcaagatctatgagtctgcagctgataagatcttggggaggtttgcagttgagagttatctcgttggttcattattcagctcatgttcacttagcctctgctgtgtgctaaggtctgtgcccagcatgagaagcgcagttcctgggacagacaccagccctgaatcaaagcacaggcagccttgaagctggtggctacagtcagtgacaggggtgctctgagaggggaagaaggtagcagctaagctaagacctgaggagaggatgagcagggacaggccaaggctgacagggaaaagtgttccaggcatggggaaaagcacgtggagaaatctgaggtgagtctgggcatgagagtttggggaatccagggacacagcacaacgtaagtggaacatggactcagcagcatctgtacttgaagctgttggacagatgagaactttcagggagggtgcagcgtgccagggtggctggggaacgaacctgaagctctttagcctttaactgggaagcgtgcacagagaaggaaatgcaggcgcgatggcacagaagtagaaggaaaaccaggaaactggggggtggggggggggcggggcggggactggtgacacagaagccaagggagaggcaagtttcaagaaggaaagaatgggcagtaggtgtcactttggggcatcagaaagagagttctctgggggcacataggcaggtggcagggcccttgcaaggtcccggggcagggggagcccaggctgggtgggtgtgtcattgtctcagcagcatcccggggagtgaagacagacagatattgacaaataactcccaacagttgtttgcccaaataagttaactctagatggtgtcaactccatgttcagccactggatatggatgcacacatccatgtgttagtgtggcccgggtgttagttcccttcccgactcggctgctcagcttgaatgagttccccctctgaccctcagtttcctcactgtaaaatgaaaatggcaggacgtgcctcagagagcttttgagggaaaaagtcacagtgcccggcacgttgtgggcctcggtgtgagccaccttctctttgccagggtggtgtgctgaataccagagcacctgccaccctcctgaactcttgtggcatctgctgcctctttgtcttttttttgttttgttttgttttttagacagagtctcgccctgtcacccaggctagagtgcagtggcacaatctctgcccactgcaacctccacctcccagtttcaagtgattctcaagtctcagcctcctgagtagctgagattacaagcacccgccaccacacccagctaatttttgtattttctttttagtagagacagggtttcaccatgttgggcaggctggtctcgaactcctgatctcaagtgatcagcccgccttggcctcccaaagtgctgggattacaggcgtgagccaccgcgcctcttggtctttcatccctgtcctcccgggtttggcctctccattcagaaattctggtgttggtgctgaaaatgtgtggctgttctgtggaggcaggagccgtgctgaagagtttatggatgggatacagctctaccagagtcttcaaggctcaacaggatttggtgagggagagggcagtgcctacctggagcccaggtgcaggaacagcaaagaactggaatgattgggaaggagaggagcgtagctggcaggagcagagggtggaaagaggccaagaggtgtggctgtgtgcagagccagagctgagccggaatagggagcctctggaacgtcagggggattcagccatgaacccatcaggtgcagagccccactctgcagtgtgtgggggatgaccaggacccggttctaccccacaggtgctgtcagcctcctggggaggactagaacttgtgcatcagaattttaattcaaggcagaatgggatgcttccagtgttagaactagacacagtgcagtgggaacagagaggagggagattcacaccagccagaagagtccaggaaagctccaagaagatgaggtgtttgcgcttctggaggaaatagaaatttcttagctttaaacttagtttttctatgttgttggttaaaatgtacggaattgctgaactttagtcctggaagagaacttagggatcttcagctctttcatttagcagacgaggtgacggaggccctaggagataaggtgacttgcctcagatggcacagccacaaagactggaagccaagtcgcctggcttgtgatcggcttctgtatatgttggtctgtgaagttaggggtttaacagtcattttggtggcctctaaaggagctgagagataaattagcctgttgagtggacctggagcccctggtatttacccaagcagtttataagcagtaaagttttaagaacctgaagggtacccaattctaaataaaggtaggcttggttgttccaaaatcaagtaaagaggaagcaggcaacagttgtgttttacagtttaaatggaacaaggactgagaagccaaaaccaaaccatagcagctcttttcctacacagttcaaagaacgtttagctggactgatatactaggctacccatagagcaaacattaattaatgaacagcctcagctatgagtgctaatgtttccagagcttagaagggcagtagctgcaaaactagctatagtctcacaatgatacccaggcaaggaacactctggagatcaaattggtagagaatgattacgtgaattagcattcatctttaaagacctctcagaagactgatgtttgaagggtccaacctcttgttgaacttggctttttaattgagtatattgcttgaaaggttggtttatttggttgacagcttctgaattatgagtaacagatttggtttagttaagaaagtagacattgtagatttcctgagcaagcattttgtggtaaaattaggcaggtacagctatccagctgtccaagccagttgagtgccccagtgtttcaggtgagctgtgggcaacaatttctgagcactggagcagggaaggatttgaaaccaagaagggactggaggtgagaggaagatgtgtcccacagcatgaaatgtaggatagcatccaaggatgggctgcaggcattggaaacctgttgagctcactgtggccagacccacagcaagtcagaagtggtggtgttgggaatgcaaaaggcaggatggccgtatttcatgtttggaaggatcactaggatctggtaataaggtactagatttttcagggagtaggtgatgaataaagcaaagacaacatgataatttgcactctgatacctagaagcgtggtgttgtcatcatttgagacagaagatgggtggtgggaaatgcagaggagctggtctgtgaggaagacaagtttggcttaggataaggattgggaaactatagcatgtcagcctctggcctgtttctgtagagcctgtgactaagaattgcttttacctttgttaaaacaaagaagcatatgtgacagagggcactcaccaagcctcaaatatgcgcaccctagctctttccagaagtttgccatcctggtttagagcacattgtctaggtgtgaacggggcctctcaggaggtggttgacatcaaccagggagagaaacaggacctgaggcagcagcggcagccctgggcatcctcctcacggctaggggtcaagtcagaggacccagcaagaggacaccggagccacctggcatgaactggcaaggagcagcagagggacaggcaaggaagaggaggacattccggaggcccaagaaggaggtttcacaaggagcttacggtgcagccccaggagtcagggtgcagcgggatggggagaagctgaatgtttggccacaagcaagggggttgatttttaagagaagagcttctatagaggggtaggcacagaatccagatggcatgtgcttacacagggtaggtagtagccactggtgctagatcgttattgttaaagcaagaaactgggcagacgcaagtgactgcaaggtcagccaaaggcattgtcaagacagggaagatcggagcatttgtgaagctgtgagattcaagccacaggacacgggaaaccagcatctttggttcggaggagtggaaagagtggggttctgagcaggggtggaggggttgtttgatggaagaggaggaggagagtgccctagaaagttctcaaccgtggctcagctgatgtccttgtgaaatgggaggtgagggcatgtgcagaggaggggagcagaagggggctgcctggaacaggcgcttggtgggacgccagctaggggcactgcgaaatccgtgagatgaacacagaatcctgtgcgcagcaggtaccacctggaggcccaagtcccaatgtcttccttcttcttgcatcctgttttaacagaagcagagaaggtggactttgggcctgagataagctgggggattgggacagacagcatggttcacggggggtcgggggtggttgtagaagcatcagcgttgtctgctctcatccaagcaggagatggagctgtgatcctgaatgagctctgagggactggacaaattttggagctttgaaagagcccctttcccctcctctgtcgaaccgcggcctcagagaatgggagggaagagagcagcacacagagctgaaggccgcggtgtcagtttcttcttcagcggagacgcattcactatccagaaaccagtattacctgacaacagcaaattagtagcctgtgctgctgctgccattgcgtgtcgagtctgagggtttatttatttaggcgatgagtggggtctttcggggtctgtgtgacaggtactgatctttgtcatcgtctgactcaagtttagccctggcatatgtggaattaacatgtgcagtctgccagacatccctatgggtgtgaggaagcctgtgacacaaatatgatgacctactgtgtgacaggcatcgtagggacagaaaagtgatggagaaatcccaagtgtgattacgtcagtggaaagattttgtagtctaaatttatgacccaactgatgaattaaggtccttagatgaacttctcaaaggcgacgttatttttagttattttgtgttccttttctgtccctctccacccctacgtcttttatgtcattgcggcgatctgaatgttgggatcctcccccaaattcctgtgttgaaatcctgacccctaaggtgatggtgtgaggaaatgggacctttggtgggcgattaggtcatgagggaggggcttttatgaatgggattagcaccctcatcagagaaacttctgagagctccctcgctccttccaccacatgcagacacagcaagaaggtgccaccagtgagaaagtggaccctcactagacatggaatctgccagcgcctttatcttggacttcccagcctccagagcagaaataaagtttccatggtttataagccatgtcgtctttggtactaacctgttagagcagcccaaacagaccaaggcaatcatcgacttgtatgggcctagggaccttatcttttgcacgctcaagaaatccagttccacctcagtgcttcttatgggttctgcacacagtctgcattctaagataatgggccatggtattttctaggattgcagaacatccaggcaacccacgcttttagaaaaatccggcctgccttttacttgttagtaaaggtaggtttttttagtttgtttagccgcccgctgcccctcttccttttgaggtttaatcagggtggttcacagatgttctgaataccaatttagtaacaccagatattctccaaacctaagtttcacttggaattgccttttagtcatactttgggataaacagacacttacaggatgatgggctgcctcagtacatcagctgttttaagtggacagccccaatagggtttcactgcacttgaattagagtacagtaagtcagttggttaacacacactccattggtttagagcccgggaaatcggcatagggactaagctgtagtttcctttgtattttctaagcacatccaaagaaattaattttgcatgatgggaaccaagacttaaatagaagatgttttcaagtggcatgaagcatttcagaagccctcatttacacagtgtaacactaatgtgctattgatgtcattcctacctttttaaaaccagtccccaaatgatctcagataggcagcatctcatgagcctagttgctataaatacaggttgagtatccctaacctggaaatccaaaatgcttcaaaatctaaaactttttgagcattgacgatgatgtgcaaaggaaatgctcactggagcatttcagatttcagactttcggattagggatgctaaactggtaagtataatgcaaatattccaaaatccaaaaatatccaaaattggaaacacttctggtcccaagcatttcagatgaggtaactcaacctgtatttagaagtcagaaaaccgtgcattttaaaagaaatagtttgtaattcactgttgtcttttccataatttaggcactcacccctaccattaattcaccttcaagtgaattaatgacacttcgctgtttcactatgcttggatgcccctgaccttttctttcatgggatattggcaaataagtcacatcctagaaatataggtatagtggattctaggcccttctgtgtccagaaagctgtgtgagcctggagaagagagttatgtatcaggttcctgaggatggatgaaaatgtggctggtagtcattgtgttcccttgcagaaaatctcttgcaatttaaaggaatttatatttgcacagaaacactcagaaacgtgactttgttagctggttttttttttttttaagtaatttttaggctgatctttccgttgaaaatatttaattactggagtttgttttccctttcctgttgtggttcatgaattttgcagccacctccttttcttgactaattacactgagcagttgtctgttgctacaacttctgccaaacagctgttattgttgggtggtgaaagaaagaacactagtcacaaaaatttgttatatcctaagatataaaataaataagtaaaataaaagagagcccagttggcctgctgttttcatccctaggcgtgggtccgatatttacccccactagagcaagtgttctgattccgaacagccattcatggatgccctgacagtgtgcaatgtaaatgtgttttctcttttgggggccaccagtcctgtcacaccctctgcactcgctgagcttcttgacctgctggacagcagaacaatttcttcatcagcagctaaacaggtatgtccacactcccgacagcttctgactgtgctactgtcccaagaaatgttttctgtgacacccaaatgccatcactgagtgactttcatcatggaagtattaaatgccagtagtggtgtttttaatgctgaaaggtagaaacattttatttagcaagcgtatgaagccaatatgtgcaatgcaggcagtttgcttctcgtcatcaccgctaacctggggaaatagttattgtctggtcttgccctgaacatctccgcctgacatgtctcctgtagcccttttacacctgagaactttccctcgtgcccaaggcagcctcagctcagctctcagcctgctggggctcttgtcccgcccccacaccgcctcccagccagtcccagggctcccttgtccctgctgcatggttgccctcagagagtctgtcctcaacaaggagggtgaagtcagactctgcactttgtagataaaatgttacagacatgcccggtgtgtgaaaactcagaaaaatagcatcatcctaagcagccttttgtctgtctatacctctgcctaagtgctaggcagttgacagactcgtggaattcagaagattcttacaaatacatacccagagggccgggcacagtggctcacgcctgtaatcccagcactttggtaggctgaggcgggtggatcacgaggtcaggagtttgagaccagcctggtcaacatggcaaaaccccgtctctactaaaaatacagaaattagctgagtgtggcagcgggcacctgtaatcccagctacttgggaggctgatacaggagaatcacttcaattagggaggtggaggttgcagtgagctgagatcattgtgccactgcactccagcctgagtgacagagcgagactccgtctcaaaaaacaaaaacaaaaacaaaaaaaacacataaccagaaagatcaagaacaccaaggtggctgcctcatctcagcttcagtgatcgcagctgtcaatgcttcagccagaagtttaatgttattttaatggtgccttttgcatgtaacgtttatctgcaccgacagtagtggcaggttacaaagggaggcttggggaaagtggctgctttgggataattatgaggcaccatagtgcacgcaccgggctgggtgctgtggaactggagacgggactaataaaagctctgtttacccacctcgagtgaggctgtcaactacagggacctcaccgcgtttaggaaaggctcttgcttgtctggatgtcaggggaatacaaatgtttatgacaatgctgagcagttgcaggaagtttagatggcctgagggcagaaaaagcactatatatatatgtagagagagagagagagagagaagaacacattgaattattgcacgtgaaatgaaagaagggaaaaaccttccccttttcctactcatcctgccccacaacacaacagaacaaaatacctagtgcggtgaataagatagttccagtaagaagaaatggaaaatgttggaagctgacagctgggttcagatgtagggacgctttcagattttatcagcttccagcatgtttaaaggaggggacttctgtgaggcagtcaagcgaaaatacaagcctggctagaagggtgtctagtgtgtgttgcttaagggggtccccgtgatgtatcattgccttggggttttttttgtttttctaccttttttttctgtttttaggaaattactgattttctgggggaaagtaatatatgttgatcataaaaaaatataagtaatgtagaaaaacaaagattctcaggttctaccaccttgaaataactacctttaatatcagatgaacatcatgaaggaagaaggaggaggagggaggaaggaaagatagcaataaagactttcaaaaactgaagttatggtgtacttttttttagtttatttcttattattaattatatagtgtcaaacattttatctggatattttatgtatttattgactttgtattatttatttatttttattttatctggacattttatgaaaagtacatctgtgttgcggcacgcatcagtccttcacccctttttagggctaaatggggctgctcgtctgccaagccccttcaccattgtacggacacattccattttgtctgtccattcatcagttgatggacatttgagttgtttccacattttggctattaggaataatgcagccttaaacattcatgtacaagtttttgcacacaggctgggtgtatacctataggaatggaatttctgggtcatatggtaatgctgtgtttcattcatataatgaggaagtgccagactgtattctaaaatggccgcaccatcttacagtctcacctgttagtgtgcaagggttccagttgctccatgtcctcaccagcacttgttattgtccatctttttgattctatagccgtcctagtgggtgtgaagtcgtatcagggaggatttgatttgcatttccataatctgttgagaatatttttgtatcttatttttatagtgtacttttttaaaaaagaaaaatgtgttacagatatttttttccaaatttaatagaagagtccaagcatggcttgggttttagaaagctgtgagccagaacagagactctctgatcctactggttattggtgttgcctctggcagaactggaagaggctccaataagtgattagatagatgaccaggggataaggaagaaaggtgactgagtgactgactcctagggatgacagacacacagaaagaagaatcatgtcctgagagcagaattccgaattccaaagaacctcccactttgtgctctaattggttatgaatctgcctttctctgcctgtctctcacccacttccttgtgcattatcttcattccttctgcctttcactgcaccctcctcccaggtgtcctgccagtgctcccgacatttacaaacctcatcccttcagcaccccagagccaggggagttaagaggttgctgccacaaagcagccttgttcttcagaatcagaaatagaagctgggaaattatatatcatcatgagcagttatctcctgggaactgtagacaaaagcaccccgtgtgcccctcacaagacccaggctgtgtattgaagtggcaggtggcaccccgtctcctcccctcactaaagacagggtcagcttggacacatcagactcccaaactgtcagagttacagctaacctgaaaacagcctcccaggattcccaagcctcttgtgactcgccctggatgtcgtccagacagctggttagtcatggttcaagggaaatcgcatgggttgtgtaggtgtacgaaggagatccttcatgcacgtctggaaacagatgcagatgatccaccatcccctgaggattgtccagttaacgtttctggaattgggtgccgcagagatggaaatcgcgtttaacacacaagtgttccataataaccaatctcttgtctactttgtggtctgctttaaagagaaatcgccaaaaaccttttaatgtacaaaatgttatatatcatgcaccaaagctgtattacaaatgactagatgtctttttctctctttagtgcttcagttatctgcacagtttactgggccccgctttattaggggcttgggttgatgtttgtgcctttctagaaaagtaacctttcacaatacttgcctttgaccaaaaagggggctcccttctctgtaactgtgacagctccctccatgccatgtcccttgaacaggtctttccaccatatcctgaccttggaaacccaggacaggcagggagaggctagagtcttgtgtgctttccttcaggatacttcaaaaatagctttagctagaaacagttgggtggcaactaagagggtgtgtaaattcagtcctcagggaaccaaaggccgagtctctgccccatgtgtcagagccggctccagtgtctgtgtgtgatggggagttcccagcttgcattacccagtactcctggtcggccatttattaacacagaggaccagcactgtgctagaaattccttgttacatctgtttgtcttgggtaggcagcagcagggcctgggagctgcgctcctggctggaaacagttgcacttggatatcacttctcagggtgggattaaacacagacaaaagctgaggatttatgctgcagcacagggctcggcagccacagaggccactctgtgagcgtcaagagggccaggagcaggagagtctggcctggagacagggccgctccactaccacccagtggctcccaccctcctggactccagccaggagtgcacaatcctcgtcttaaataggattgagcaaaggatgggacaaccggcgtctgttgtataagcctaggggactggggactgggggcctcgactgtcatggccactgcactaatttgtggagttaactaacattatgtattctaactctgggaggaaaggacatttcagccaccgggctcccatgtgttccaggaggctgctgaatgatgtttctctagcggcactgcttggtaccaccccgcctggccctccttctcggggagcagccagcctcttcgtttgaaggcatctgtcctagaggtgcactgcttctccttctgaatggtgtgattggaagtgatccccaagcactctgccactcttccgcttattttggcccaggcaaatccagccaacattcgagctgtgggtcccgtcagaaagaggctggctcactggccagcctgctcagggtctgccgtgtgcttcccaccgcagcagctaccacaggcgctgagaaatcgctccctggtctgtgtctgcagacgcagacccaggaggggccccgcctacttccaggcacaggctgctcgtccgcctggttttcctggagggaactgctgcgtagatttttcacgagcaagtccttacaggtggtttctgttttgagccaggttttcagctaggagcttttttgggagtctgtgcagatgaacaaaatcaacactggtcaaagtctagatatctacgaggaggggataaattatgataaatacatctgatggatactagctagatctttttattaagaaagtacttctgtgctaaatgaaagaaagcaggacacaaactgaatatacgttatgatcccaagtatgttacaaaacagaaagaaaaagatgggaagaaaaaacaccaaaatattaacattggttttcttgagaaaatgggaattccggtgatctcttttgatctctcctgtatttccttatattttctgcagtgaatgtgtattaacttttattattagaaaatgatttttaaaatttaagtcctagttcaaaaaataaacgtgtcagagaaagggggcagatggactcctccgacttacagggcagctccatggaacgccatccaggtccccagtgcttctgctggcagcactccactgataagcatgttgagagtgaggaagtttcttcccgcttctgtgccccctttctcccaatggtttcctcattgtcaggccacgtacatatctgctgaattgagttggaggcacgtgcattctgtatttttctaagagtagggccaggcttttcctgagcagtcgggcagcggcagaggggtgccctgtagggagcttacccaggacctgccaagcacacctccttggccacagtcacagcgcacgttctgaggcaccaggctgaaggcgcagtgcctgtcccagcagtgataagtatttgtggtttgtttttgaatcagactggggaagactttgagccctgctgagactcagagcatctcccttttatttgctttgctgttcgtgctaattatggaagagctctgtttttccaggaggaatggctcctggttggcccgttctcggccaccaaggtaacagggaaagttgggtgttcagtcatgactgtggactggacggaggtggcaccggtgggagaccaacagaggaagccctcctcccggctcccaattctggctttcgctagaagacaagagaaatgaggaaaacagctaccctaggaaatagccttccttgaaaatggtttcctttttctcaggtttgatgaatttggggatttgttgttgtcattttttaagtaaaaaaaaaatgccccaaacattagcgttcattatcctagtctgatttgggtccggctctacctgtaggagatgaatgtggtaggccagggggcccctgtggattctaatttatgttttcagttgtttgccattttgtatcttcattacggggctactttcctgcctccctaaagtcatctttcccagcatgctgtttctggactttatttagtaccgtggttacctcctgcaggctgtgtggccccatccttcaccaaaatgtcacctcaattaattcggcggccatgagacagatccatcagtggcccgccgactcccgtcagcaggcgcccatgagtgatgggcacctccacgcctcccgcggcccccccccgccatgtggagtcagccgggcaggactcaccatccctctgggcacgagggcatctggctggcccgagtcctctcacaccttatgctgagggagacttcagcctcaggaggagaccccaggtgcattcactccacctagctggccttgttccccagccctgcactcagggatgcctcaggagagccaacgctctggcagggcagccaggtgccctttccctttgggccaggcccaggcagtggggacttaattgaatctgctcattcccaccccagctccacacagcacagcactgcaaatggagctggcagaagagctgacttctcatttctctttcctctcccttctctggtccataggtgtttgaggaactgtggaagagggaaggcaagactccagggcagattgtttcagaaaagcagcttgaactgatgcaggaccagggggcactggagcagctctgccactctgtgatggaggcccatcctcaagtggtgactatctcgggcaggggagagggccagagccagccccaggacatgcccaagagcctcgccatcgctccctgtggcagcccagaggctcttcctaagaatggctgacccagtttcatcaataattccctcactgtcatctttttagttaaggtcagaagagatgaaataggtggatattggaaaaacacaacttcttttcctataagaaggatgccacccctggagtttactctccatggaggtgtagtttaaaagggtgtcagcaagctcacgaaatccaagctgtgacctcccaggtgtgtcgccctctcccagggttggcatttcgaatctgttgtggttagcgctacttcctaaggacctcccagtaaagaaccagcaggtgtgccggcagagcagggagagtacaggaacttcagcttcatgcttctaagaggtgggaagaaaggcagaagggaaaagtattcataaattgtggagaaaatccctgacaggagcatgactgaaaaccaggtcattttgtgttcttagcacagcacaagacataaaagctaaaacgagtggcatccctccctccccaagtctaatcatattgtctagagatattttttcagtggggaaaaaaattgtcggcatctttttcagaataatacccacccacccatcagcttgccggggacactcacagctctgtaaagagctctcgataaggaaaatgagcctgcactgggcctccacagcctcgtcttcctgcctcatctgtggtgactgataaagacgtgccagtagtttcaggcttgttctgtggcacttgagtgcagatcctcatgtcattgcccttggagacgctgcagagcaggaggtcacgtggtggccctaagagtcagtggctatctgataggaattcagcacctcctggcttcctcactccccctgcccacacagcacactccccccgacccagcgctctggaagactcggccagtgtgtagatctgctttctgataaaggaatcttcttggtggggagcagggggagaaggaaagccacacatttcagctgaacatcactgagaatcagagaggtgtcctcactgattagacgcagtgattcatcatctcagagagattatccctccccagactcagtgtcctcggtcattgtggcgtcgcagaggggagggccctggctcccacgtgccagcttctctggctttcggcaatcacttcttgctcattttaatcagaaagcagagtagcaaaaatctcctttgacaggagcctagaaacctactcagaagtgaggcccctcccctttttctgttctacattttatgtctaatactagtggaaataagcggaatttaattttcagtaaacttaagccttagtttgggatttgggggcatgaatcccttcattttctcctcttaagtaagtaatttctgtccttctaggtaatggatgtgaagaacagaaaccccagagctataaataaactgattgggttggtccggaaagcgactcaaagccgagcagatccagtcatgataaaggagatcctggagaagaagctgtcattgtgagatgtttgggatccccttgcccaagggacaacaacaaacagtgcagcctgactgggaacaggatcctgtgaaagctgatgcccatgtgccctgagagctgcctctcaatccctgtcccaagccacagctatggcattaatgtcaccagtgttctcaccctctaggccctgtgcctggaggtgcctccacagccgaccagcagccaccccgcctgcttcatccacatcaggagggtccggtgaggctgcagcagtggttaaggagtaacaccttcttgtattaaggaattttaaactaaataaaatgtatgttggagatactgttacccattctaagaaaacttttcattctgcagttccttcaacaaatatttttgagcaactcctaagggccagccattgtaggtgatgggcattagcagtggtcaagagagactgtaatttggatgtattgttttcagacctaaacacaggttaacaaagatgaaaatacaaccaaataaactggcacagtataaacacatttgtttgtttaaggaggtctcaagagggtggggaaggaggatattattagaattaatcaacctatcgactgagtagaagtgatattgcctgttaaactccctccccatcccagaaggcacagtctgagaataaatgaattaaaaaaataagttttccaataaatttaatcaataaaatatatactgaaatatcacataaaaattaacttacacttcaaagattgtgcagctgacaactcccccaaatcccccaaccctcaggccaaacaagataaaaagaaacaagaaaaaagttgtaacatgaaattgacttgttttgcttggaaataagattataaattagtaaatcaaaatcttgacctctcatgataatcgtggtgtgctgcaggcatcacgatgaaggcggggctgtctgcactcctgtgcttgcgacactaatactgttctctccactgcaccggagcacctttgttcggtatatatatgcctttgttacctctgactcacgtcgcttaaagaccagttttgcaaatgttgttttttaaaagcatacttgtcaaaactgtgatgtaagagaataaaatccttggaggccttgatttgaagctgtgaacctgtagcctaccaaggacagtaaaaacattcccgttgtgaacactgctccagaagcagctgaggaactagaaaaaagtggacacccctccatcaccaattcagcgactcatgcttcctggcttgcacagttcctcaggacttccctgagagtgatgagaaaggtgcccctcttccccagcccaaaaggtaggcagagaaaggtaaccagttgcgtggttcattttggacaggcatgaggaggtggctttttaaaaaaagtcgtttaaaaaaattagtgacagaattttaagagactatgtgaccttacccgggaagccaggtgccccgcatcctgttgcggtcctgaaaactactgggtctaaagtaacatgattttcaccaaatctctctacaagacagtaaggctgaagcagttctctcctcactctgcaagtctgaattacaaatgggcaaaggtggtctgagactggagtctgacaggatctttattttgtaagaaaggagaaggttcagtttcattttataaattctgttttcaccaaaagttctggcttcttggtgactaaaccttacagaaagcatcgaagatctttccagaccatttaaaattaaaggcttacttaaaagggggtgcagccagaaaaagacatttaccaaaactattatgtcaagtgcaaactgtattaaggactgattattcccagaggaagatgcccttgttaaagcacttgatttgtccaggctgattctcattcagctctgacaaactgcctgttgtcttgaatgccagcttctgaaatcctgaaagccaaaccttgtaagttgatatcatcactgctgctaggaaaaacccaaagcatggctctgactgaaacccgatgagatattctaaagatatgtttacattaacaccccaagaaattcgcaaagatggctctgcttataaaggggcctcagtgaaatacaattttacattcttgcatgagtgtgcgtttagtctggtctactggttcacccttcagggagaaatctcattaaaatgtatgagttggcaccacaggtgatgccattgccatctgtctcaggaatccacacacctgtaggctgggtgtataatgctgaggctctgactagaagttagaagtgtgctggaaaactggctctgccccaggctggcttgaaccagctctgcctggtcaggcccaaaccctgtgttctgttgcctggggaggaggttggagggttctggtgggaaggcaggaatgtgccagccctagcactctgcatgctacctaacagagggagtattcagtaaaagctcgcttactgtatgaaacaaattaatggacagccttttgtggggcccttttgaagagacactggtgataccaactactaggcttctgcgttctgggtcatctgggtctagaaaggagctgtttgatctctgtccagggtcacacatcacagtgaacttctgttcctgtctttcaaggtggaggcctaggcctaggaaaaagaacctagatcattattgcaccaaagtaaggatattttagctgagctcccccaccccatgtacattttagtaattattgctaaaataattactaagatggcctcgaagtttcggaaagtacacaccctccttcagcttggagttggttagttcaggacacagcttatggccatgacccgctattttatattgtatctttcatttccattgaatttagttgcatagtttccacatggtgactattggggaaaagccaccagatctatctgaaaggccatattctttacccattaccaaaagcagcatggaagtggctgccatgcctcttcagcaggttttagacaaacatattcatggattatttgcaaatagagctgacccttgcttgtgaggtgggaagcatctgattgaaacccttagtcaaatagcttagcaagagtcgtgtaagtaagattgtcaacaccaaattccctcttttaaaatatccacagggcaaaaaggggccttgttacaggtgggcctttcatagacttgtcccagtaaaaagtcagctgacacactaagcagcacagacttctgcagcctccgttccatgaaatttaatctggcctaagagcttccatcacctttgttgggttctgaaatgacacagtaaatctaaactccccgaaagatgcctggaatgcatgtcgaagtcatgctgacaggtcctattggccgtcttgttacttgtgtaggtaacagtgaactaggttaacttaaaccttttaagacatgaacaaaattcacagtgaccctacaagctaggaaaggtcagtcctagctaaaatcatgatcagttttaggattctacgtgcaagaggtcaaagaactgaaggcttccacccaccttctcctggtcattcttttccctaaagaacctctgaaaatctttcactaaagtcctgtttatccagttattgagctgccaggataatctgtagtcccaaaacaagtaatggcctaataaatgcctgaatgtagagaggatttactgaggcaaaattatcctaaaaaccattctcagtcttctgagagctctttctaaagcattaggtttacgaggttcattcaaaaagaagggggggaaagagtcaactgcattctcttacagtgtttcctcagtgatgtgatttaagggtggaacataaagtggtttgacagtgttctgttttaagctgttacttgatggaaaattagtgttgtgttatttatagactgatggctgaagcaacaaggggcctagaatatcttcctaatgacttaaagctgatgtggcatcagctacaagagactgctgtttccaggaagagctcacactgcaaagcaggctgccgtttgcagcaaaccacacatgacaccagcctgagccagtgacttgaagtagcacgtgcaataatagctgacctgcaataaagtgtttcataaaaatggcaagcatgacagacagccatttcagtaaatacagggctggtaattagcaattacattgaactgcccttaaatgagaactggggcatatgcagatactgaacaccacgccgggaccatttaaaattaagggcttacttaaaagggggtgcagccagataaagacagtttaccaaaactattatgtcaagtgaaaactgtattaaggactgattattcccagaggacgatgccatcgttaaagcacttgatttgtccagactgctgcggctgtgcttccctcctgaacacaacctagacacactgatccagattcagaagagcagcccatccacaaccctaaacctcaaacagacctgggaatcagtccacatgacggccacagccaagctgatttggagacactggaaacaactttcgaccctgagtacccactggctgcccaaattaaacaggcaaccccaatattcatgtagcctgtttctagattctgttcataagaggatgctttcctgacaagaccctggctccatgatgtcttatcctggacagaaactaactatatctgacctaaataaaatccacctgctaaggaaagggtactcctgatgacctataaaaataccgaatgcgtcctacctaacacctgacagacatccactccaacccgagcacatcaaagcattttccaaaatgatactccacaaaatggggaccacttcacaattcctctaaataccagggaaaggaggtatctaatggtaaagaaaaatcacatctctaactggctattccagcactcccatttcatggttgggaaattgtattttaccacccatgaaattatgttttaggctgaacctaagttggaatttctttgtgtaaaattttaaaaaacatttacttggccatttccaaaaaatcaattttaaatatcccagtgctctcatatattttgaaccacagaagtcactcagtctggaactttaagtcgggccctgaattatgaattgaggttaatgttgtgatactccaggaacccttggctccctcacctttcctgcccaggccagacgcagtgacgccagctcaggggctgcgccagcgggcggtacccacggtttctcttcccctacattcttccagcaaggagcacagcgactggtgtaggagcctgtcacatagagaagtgtccacactctcggaccatatctttaagcatgccaaacatatttaagattttccccccaactcattataaaaaaagatatttctaagggcttgccgatttactttaggaccagaatattctacttcattgccaatgatttttttcctgacaaggagttcccattctcacccacccactccctggtttcttcatatccgcctagatcaatgttcactcccccgaatcgtgcaggatttgctcttctcccgtggatagactcagttctctgctgtttttctttggcatgtccacgtcactccctaaataacccactctcagttatttcacccagccacatgggttttcctgttctctctacatccagctccattttctgacttcattttgcaaaaccatggacaaaaacctctgaggactgtaatggattcagaaacaggaaccagtttccaaatccaaataggaagttagtgttatcgtgtgagtttgctgccagcaccccagcatgggaagttacattctcctgcctgtcactgcacacaccagtcatctctgtcctcatttaaagtaagtctacttcaggctggacccagtggctcacacctgtaatcccagcacttcgggaggccaaggcgggacgatcacttgagcccaggactttaagaccagcctgggcaacaaggtgaaaccccatctctacaaactataccaaaaagttagctgggtgtggtggcacgttcctatattcccagctactcggaaggctgaggtgggaggatcacttgagcccaggaggttgaggctacaatgagctgtgatcacaccactccactctagcccaggcagcgcaagatcctgtctcaaaaaaataaaataataaagtaagtttatttcagtacctattgaaaaaaacagtaagaggcacaaaatcaatcttttcccaaaggaaactttccacaaaggggaccatggtattctacaatgcagaaatatggattcaagaagaatcaacaccaccaccagataatggagaaaggtgtaaatcaaactacaaagctaaagaattccatttacagatgtggcgttggcattttatgactttgtaagtccaaacaagaagataaatacttgtgcaaaaacaaacagagtataataaattacagccgaacttccatcttcaactgttcctctttctctatcttaagctaccttcttttctaatggagagttgtgggctgtgcaaatacaaccagacatcaggaagccagaagcagaccagtctgctgtgcttcatcccttctggctgctgcaccacagctgagcaaaccatttgtcaagacaaacagaaatgtacagtgagtaggaatctttggtgtcttgcttggactatgaaacacgaaagcaaggctggctcctaacagctcaccctgcccaggccaggtctcctgttgtcatttcacaggccagctctcaatttctcattcactcaatacaaagctgcttcaagattcctgaagcacaaaagggcctccactgctccacagcattgcaggtgtggttcttccgccactgccctgcctgtgcatgaaaggcctgattaagaccaaaccagtgctcctgaggcacaaccaccagacctgtggctgccctcagggctccacagagatgcccacaaagaacagagagagacaaaccttccaatttccttccaaacaggcaggctcaagctcgttacttgcttcgcacctgcagaactgggcccaaaatagaggggagtggaatttaatatccataaaaatcagttgtttatggtctcattttcagctcacaattattctgttttcccctcttggtggtggtttaacatggctgtggctctaagtataatcctgcctcttggagcaggctgcaaagcagcagagggacgctcatacagcacgttggggccttctaatgaaccccattactcggaaggcagcatttccatgcagagtgagtcgccagcaggcacttggctttgcagggctccaggtgacctgtttgcatttacatccaaggtcccaaagtgggctgtacagttcctgtttctctacaaagtgcagcttactagcaaaagggaatagaattttaaataatgatcagtgtttttacaggctgcatttagtttatctccccatcccacccagcataccctccctgaaaaaacccactatgaaatggcttcacaagttaatcagtttgtttttataaaacacttacaaaaataatgatggttgtcttcttacatatatatgtgataccattacttcttcatctgatcaaactcctaaaaaccaaagtaatagtttgcataggtatacttaattttgtgcaaatcttactaatataaggccatcttcagtgtttaggtagtgtcatgctgattaaagtaagctctcaagaaataagaaaaattatctgcattccaaattctctccaaggacatccgacttcccaggcagatagctgaggctctgccggcaccataaggcaacacacgctggggacgacacacgtcctggaagtaaaatccaaagggacagatgatatgtgctttcgtgatggaggcaggaggagctccatctttactcttcctttatagaacagaggccaaaatgcaggaggcaacaggaccattcgcacagttgcaggtgtacaatcttcctgtgctgctgaacagctggaattctgacatggggcacttccagacatcaccagacatcactgaaccccaatatctgcttgacgtgatctgagctgcaagaagagtaactcaaagggataggagaatgacaaccaaaaaaatataaggaggaaaaacagagcaaagaaaactgccaagggagcaaccagcttatgagacttacattctatatataacataaggtggaaaggcccggctagagagagagaggaaagatacagaaaattcccctccccacaaatcaagtattgtcaggaaacattaaagtagaaatctttgtaagcagctttgcatttaacattcagtcaagacactaaaaccttacaaaacaagaacctctattaaaaaaaaaaaaaaaagctaacagcaggagtcctcaaagtcacccaagatcttgtagcacagaatggagtgttcctgggccaaggccgccagctccttcaggaactctgggaagagggcagcagccagcatggggttcctcaccggcaggggcaggttggggggtgcctcagccaccttggttctgtgggtcaggaagggctgaagcactcttggaggtccatccaaaaggttcttgccacttcctgtcctggaagcctcctgaatgggatctgaaagcagaaagaaaaccatcatggtgtccctccatagccttctaatccaccctcttcagtgaagcatgtgtttgggggcagagttgctggagagtatctagttatgagtgcagttcctataacggactaaatcctgaagatgcagcccttgtgcactccatgacacacatatttgcccaacagatatcctccaccatatagcatctgatatgagactttcacccaaaattccttctaaggaacttcatgcagaaatcatggcaagaatataggtttgtcaagaatcctccatgccagaatgtggaaatgggagaaactgacaaaggcatctcctgtcattggcttattaaggggcgatgagtagtcccgcctgctctgccagcctctcatgctgggatgactgttctccctttgccagttaagccctgacagcacagcatagctccagcagggaggctgggtgaaatgggtcactccaagctctctgcagcgggtgctccagcctctcgggctccccggtgacctccagtcttctggccaggacctccaacgttttacataaaaggagagcggaagattccttgagatcagcagaaataatggaagggaaggaagttgggtgctggaaagaccagattaagaacttcctgcaaccatggggaattagtagcagcaaatggcttagaagcctatattgaaggagggttcccatctcaatttcaataacataggcttaagatgagttcaaattttaacatatccaagtgatttgcattttcctatcaaatcagtttttactaattaaaatggttcaacatccctatttgattcctgaacatcatcagccctcatatatttgtaggaattatttatgtcttcctctgccccctacccaaacaatctcattactccttataaatcattatattcaagttcttcattattttggctgcttcttagaattcagtaccatttttcaacactcttctcagagtgttgcttaactacagtactaaaaattcttgacatttatagtactttccacatctcactactatagtctttagtgttaaaaaaaaaaaaaaaaaacaacttccacttgactgctttaaatatccttttagattaaggcttatcacagctttaatgccataaagaactggaaaagttgctgagaatctgtcttctgctacctttcagcagaaattcatgtcccggcaacagagtgagcacaaaagtgttgatgtcactgaggtacatgtcaaccttggagagcaccccttctcatccccaaccctagctcaggccctgtcactctccaaagcgcccagcaaagctcacaaaggaagctggcctgcgttccaatggggactgggacaccatggacctactcccagaccgagacctgcactgttcatgcttgttcctccacctggaattccctgccccattctctgctcacctaaatcttactagccttagaggcattatttgtacagtggttaagaccacagagtctgccacttgctggctgacctcaggcaaattgctttacctctctgtacttctatttcctcacctgccaaaagctattcatagagttgttataaggattaaatgagtcaataggtataaagtacacagggacctctgaatgggtgtcagctaccacatcatcctcatcagtacagttgccaccaacttcacaatgaatttccagtttcctgcccccagaagtcattcctatagtctttatgccttcctctgccctctacccaaacagtctcattctagcctcctctccatgttattgaccaactaaggcctgcattgcccttcagcctcacattgtttatgttttatcacctctgctagactccaacctttctcagggctga

SEQ ID NO: 14674 - DNA, 36851 bp, Human
tctctctagagtttgggtttatctctgttgtctttcagcacccctgaagccagctccacctgagtcacctgtctcaatgttattaagtggcatgagtgggtgtgtgcattggggttggggggtgcacatgggagccacctgcaaatctgcactttcacagcctcctgtgaatccaacatcagtgcccatatggaggcatctcgtccttaccattaaccagtctcccccaccactctggtctgcattaagccatctagcaaacagttaataagcacctgctgtgtgctgggctttgcactgaccctgagaacccagagaggaatagaattcagcttgtttacacaggggaagaaagacccacatggcagttttcaaaaacaaggagatatttgagctggtccttaaaggacaagaggaagtttgcctggcagggaagggagagggacccacctgggaggagcagcagaggtgaaggcacagaggcatgaaacagcccgtgttcgggcagccatgtgaggaagtgacaggtgctggggagatgcagctggtgttctgggagtctccaggacaggagctaatggtgttcacacggccctgcggcgggcacagggccagcatgaagcaggtgccaaagactgtgtgtctaatgtgtgaaggggagaaggaaataagggaggcactcagggaagggataagtctttgcagcatattcatatcatggcatctatagagcagttaaaaaggaacacactagagccataaacatgaatgaatctcagaaacagtgttacaaccgggcgcagttacagccgggcatggtggcttacacctgtaatcccagcactgtgggaggccaaggcaggtggattacttgaggtcaggagtctcattaggttaaactgcatgaacttgcccatatttgaccatttttgacattcaaaaatagcagtttccattggttcaacctaattgaactcatgagggacagtctgtctgtcccatgaaataccactcagcaatcaaaaggaacagattatcagcacgtacagcagcttgcttggatctcagggggattctgctgagcaaagaagccaagctccgaaagttacagactgtatgattccatttatataacaggctggaaatgatgaaagcttggaaacggggaacagattagtggttgccatggccagggagtcgggggaagagagaggtgaccatagctttaaaaaaagggtagtacaaggacccttgtgatgaactgtcctgaatcttgacagtggtggtggccacattaactcacatgtggtgccattgcatagaaaatacacacgcacacccacacacaagctcatgtaaagccggtgaactctccacaagttcggcttccttgcgtcagcatctccatctcagttgtggtacttgtgttaatactatggtgatgacattgggggaaactggatgaagggtatacggcatctctgtattgtttcttattgcatgtgaattacaattatctcggaattaacagttaaatacacacatggtaatgattaatgctaaatttaagacagaagttgtttctgggacaaggagtgaattatgcagatggggagaggtttgcggaggggattcaactttatctgtaatgttttacttcttaaaatagaaaaatctgaggcaagtacggcataatgttaagatgctacaaagctggatgataggcacgtaactttgttacatcattctctttttcatgtttgaaataattcataatttttttaaaagctaatcttgcttcactcctttcacccggagtcaggactggacctgggatgcagagccctgagggtgcaggggatgggccaagggctccctgagggctcagcccccagcccagagaccacctaagtggcagtcccagagcctcagtggcagccagggcagaggctcccgacacaggccccaccaggtgccagccgctccttcctctctctgcagcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtaagcgctgggcagggcaccggggctgagggctgtgccctggtgcagggagctggggatgtcagggtcatatagcactggccgccatccaggccaggctcagcagcctgcccggctggagtggccgtctagcacccagagccacagagggccctgcccaaggtcacccagcaagactcatcttcacttgcatgccccttggccactgtgttttccactatatcctcttaaacatttctatagccagagtcctcccccttctcctccctaagccgctggttcatcaggaagttctactcattgtcacacttagatctctcttatttcatttcctttagcgtagagttggttgatggtagctattttcattattagccacactcctctgactccagaggagtgctggaaataagcctggtgaactaagcaaatcccttcccctctctggcctcagtttccccacttgtacattgaggcaattagtctagcccccagtggttctcagccctgggtacacattggaatcactctgaggagtgtttaaaaaaacattgattcctggattcaccccagacaaattgaactggaacctctggggcaaggctcgcacgtgggtatttattaaaggctcctccaagcaattctaatgtgcaggcagggtcaagaactactagcctgagttttatgtgctttgtaaaccatttcagctgtgggagtgttatttcagatgaatcttgtgagtatataatacatcaaagtggggctccgcttgctgagtggcctgggcaaaaattgcaggacgaatgcttgatttcaccctgcctgggggatgaactagatgggcactggatgaccagccacagctagctgggcatcacgagggtggggaggtggtctctaagcctttcagaaggagcattccttgggctccccatctcccttccatcctcccctaggtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtaggccccagggccagcgagctcagggaaaggggatgaggctgggaggccagccaccagggtgacctggagtaagtcacttcacctctttgagtctcagtttccacataatgcccatggggatttccttccttgatcctcataagaggattgcccatgagaaacagtgtagaccacatgtggcatgggtcggcccagaaggacacagaacccacaggttgccagcaggtattgctctgccatgggggcagtcctcgagctgtccagccagccaccatgagctcttccctctggtcccccaagggacaggtgtaggggctgccctgccttagaaacctcttgccctgcaggagccaggatctcctgtaacaaatccacaaacatggattccagggtccctacaaaggacacacccaatagcaagggcattgcactcaggagaacccgaagtgtggtgtccctgtcagtatttatagttctcccagtgcagatgcagtttaccagccagtttaccccagcaagctggcctaggaacacagctgagagtctacttttatcagattcccaggggaacagagctagaaagttaaggtcacattctccagcagaagggaagggggctgacagcacccacttcacaaggatcaagggaggcgatgcctatcagtacacctagtggggtgctcagcacacagtaggtcttcattctcctttagctgaatctgcacctgaagggggaagaccaagaactcagtgctggagctgccggggtcaggggaggatgggatgtgtgtggtctgtggtgcttcccaggctgaagaaaggctgtggggaacagaggaagctgtcctgaatctccaaaacggtgcatggcaggcggagtgagtcagctcacactgtgaggccccaggggagcaccatgggcatgaggcagcgtgcaggaggggctggcttccacttcctcccaggactcactcagctgctaggtccagaccggatgccctggccaggccctggctgggtccagattggccttggctgtaagatttggtgctgatgctttgagggcccacctcctccactccttaatggacctaccctgacactgttctctgggggtctctggccatttgctactcctctctgagcctcagtttccctctctttaaggtaaaagggatagacaagatgacctccaagttcctggccctgatgttataagattctgcattccaaagaaaaatgaaactaggaggtcacaggcatttcacattttaggcagcagggagagggttcaaagtgtgagctcagacatcagacagatctgtgatcctgagtgccggcacagctggctgtgtgacgttgaaccagttacataacctctctgagcctcatctgcatactggggatgataatagtatcacacacaccccctctgggatatcatgaaggctcagatcatgcatctacgagcaacaagcagagtatctggtacaagataggcggcctacatacgtgggtccccttccttcatgccctcttcagtagatttcattaccctagatccagggacacgtaacagccctagacatacagcctagcctgccaaaggtgttcaatgagtgtttgcggaatgaatgaataagaatgaatgggactggaaccccaatcttccacaccatgcctagtgctcctctctctctctctctctctctctctctctctcatacacacacaccctccttgggggtgtcattgtggcttcctcactcctatcaagatcctaaaacagcaaagacaattaatgcccctggagcttggcagtggagcccacacgtgctttcctgcaaacctctctctccatggacagacaggccgtttatcagcctccctgtgggacacctgctcattaccagccactaatgggttcaggcctcactgtgatgtgttatctcgttactgaaaactcttcatccttgcacagcacttgaggctggcctgcctacaccctgtggctcccctgtccttcccaaccccacagcctcccccttcccgggccctcccagagctcctggctcaccaccctgccttggaaacatcccttaggtgaatggaagacacaggcaggcccaaactgttatttgaccatgacgcacaataagaaatgtattttatgtcatgactcagtaaacacacacatttcaccaaagcaagaatttcacaaaataatgggatgcacttacctattttctgttcttctatttctttgtttcttttttaaaatgttggtcaccacccactaaacaaatttcacgtcactaacagggcatgacttgaggtttgagtgactgatctagtccaaacaccttcccgcacaaaccccaatttccagaagaaaacaccgaagcccaaagggggacagtgatgtgcccaaagtggctgagtgaacccagattagaacaggttttctgcctccctgcctcagggcctttgcctggttgccacacacacacacacacacacacacacacacacacgcacacacgaaaggacaagtagttctaagtcaagaggatgagcagacgaggacaaggatgagagctccccatgcccagggcctgagggggcagagctgggttcctggcattttctgttgacagcatggtcatccagagaagttagctgcaggcacagactctgggaaaggggggcctggagccaacccccaaccccgactttgccgctaacgagccacttccctctctgagcctcagtgttctcagctatgaaatgggaggtcagcccaggtgccccttgggtccctcccaagctctgacgtccccagagagagcgatagttgactggaagacttaccctcccatcttccctcacttccttcagtcagggcatccacatgggccacgctctctcctgttggctcacccctgggatgtctatataggagtcataaactgtctcacagcagcaacttactcaagtgacacagcagactcaagggacatgggttctaattctgcccctgccactccctcacagatggcctcagtttccccacttgaaaactgagagaatcagactgtccagcattcacagtgagggacacagcagggttacaggtgacaccacgtgcaagcataagagctcagacgtgttgattcagcacctccgagtggggcgggatggatgcaggacccaaggagacgggtgggtatggctttgtttatttgtttgttttttaggtaggtcattcctgccccctctagccccctggttcccacctcagaggtaaccactatccccagattttaggggcgaccttcagggaacgtgtgtgcttatggtggccgtgtttttgtcaagcaccccagagctctgtcctcctggactcgtccctttatgcagaattatttgtcaccctctgtaaatctcacaggtgaactcccttcctggtgcctccagcctaggaggctcagccagagggaaaacctcagcccgggccatctctagggtcctgcagacacattaagattcattttgcaactgcaagaaaacaatctttacctccctcggtttccctggctgtcaaggggttgaatctccacattgccttcctcccacgagaagcccaaagggtagaacagatcaagacacccttgccagagcaccccactgccagcccttacagtgggtacattttccaaggctgattgaagtcagtgctgataaagccatcaggagagcagcggtctgggatttgccgggttatccgggggtgtttgaagccctcggagtcacagacaacggctgtcaccagaaacaacagatgtttaaaagcctttatttaatgaaaacaggaagcacccatttcctggctgctttccctcagtgagaaatatctaggataattttagcgagagaagtcattttttcccaaacttatttatttatttttaatttcacagtaattttatcgatgtgggaagcatatttcaactggatcgatgcctctggggtttgagtcgtaatcatctccggatcctcagtgtccagagcagttagatgcgccagagctgtttgtccaataagtaaatgagtgagcaacaaaattaagtcctgagagcagcttaagaaaacatcctgttggggtgcaggaatcaggaatggcttcaggaatagagagcatttcatttataagatgggaaagacttgacacacagaggctaagggaggaagggcattccaggcagaggggacagaatgagcagggcaagaaggcaggaagggatgcagagtggctggggcctcgtgaatgccctgttgcatttatgagagaaaagggaattggaaaaggtgtgcacgtgcccatcctgtgcgtgggctctgtgtgccctgtcatagagttcctcccagccttgctgaagggtggatactattgtacccattttacagatgaggaaaccagggctcatgtgagaccctagagcagagcccagcccagcccgttggtccccaagccctctctccactgcacagaagaaagtatagggtccgtaaaaattagcttcatttttctcatgaagccagcttgcttggagaggcccagaagatggctgattttggctctgggagacagtcttgaaagtgagagtatttctaaaacgcagcaccaatcacctcattcctggctcagaacttcccacagttcccagtgcctgaaggagcatatccctggtccagaaccttctgcccctctccaaattcatggtctccagtccctaccccacatcttccctcagcccctccagatcacctgcagcgtggccctcaggcccgttcatacctcaggccttctctgccagtgcagagtggacagttccctgcggccaggactaatctgtgttcatctgtgtagcctcagccctggcacaatgccaggaaccagagcctcagttggcagctcaaacatcccctcccccaggaagtcctccttgatttctcctccccacccactttcttctaaagcaacagtgccctctgtgctccttcagtagcacaaagggcactgaagcagcacaaaacccccttatactcagcagcacaaaacccccttctgtgttcccagagtcttttgtatagacctgtgccaaagaccctgcctccaaacagagtacaggtctgacacagggtgatgctctgctatctgaaaaaagaaaggttgtgttaaaaaatcagctagacttgttccacagtggagcagtgggcattagagggagggagcaccctgtcatcgggtgtgcaagcagaggctgaccagcccatctgttgaggacacctgggaacggatctagggaatgggcagagggtcaaagtcaatgacccaaaaccctttccaactccaagtcctccagcgtctttgaaaccaagaacctaaattcctccttttggaggcaggagccagataaggtgtgcgttcccaggaaacagcagctctttgctgttctcaggggcaggagacagcagggggccacagcccagtttacagccatcatgaggatgttagtaagttatataaacaagatcttggacattccacattcccactccctccagccctgtaagaatgaggtcacgtttgcttatgtgattagccgctgtggcacgaggcaggggccttgctcacgtggcccccaaaccccgagtgggcactggaaggcttctccccaggccctggaagtaagccccagaggaggctggtggtcagctggccctgctctaacccttcaacaacggggagatcactacctgccaccacagagccggtctcttagacaactccagtagctagagaggcctccttactgggaccctgcccctctagagcatccgttcctcacgccacaagacagccacgctcagaactgcgggtttcctcttgaaggcatcagggtggaacccctgaaagagagcagccccacaggctgacactcaggcaggtcactggtggccagggtaaggaaagaggggccaggcagtgccctctgcacagggtacacagggagggtagtgccctccccatggcccctgccctcctgcccagaggcaggctgggcaatgacccagcttgagacgatggtggtgggggctgaaggagtggcaggtgctgtgaatggggtggatacaggcgagatagtcaaggccgattccttgtttttaccattgctgaaggcagaaaggagaccccaggcaggagctgtcccagtcaggcttggccccaccttctaactctttgtactagttttctagggctgccgtatcaaagtcacacaaactgagtggctcaagagcagtttgctgtctcacagtcctgaaggctgtacatctgtttgagaccaaggtgtcagcagggctggctctttccagtgacgatagggaggagctgtctctgcctctctctcagcttccagtggcttgctggccacctttggcctccttggagtgtagaagcagcaccccgatttctgcatggcatctcctttgcatatctttgtgtcgaaatttcctctttataaggacaccattcctgttggattagggcttaccgtgatgcgctcattttagctggatttaccactataatgaccctatctctaagcaaggtcacatacacaggtactggggcttagggctccagtctgtcttttggggggaatacaactcaatccatagtcttccaactccctcagcagtggcttggcaggtggatgctggagtgcgctcctggtcactgtggggtgtgcagggagggaacgtcagactgagcccttccaggctggagattctaacaggctgtggtcctcccaaacaactggatttcctgcccttgacatgttctctcccactgaaagacgttctgcagcaaatattattttattatttgtcactgccctcgggtaagaatcactcgttccattgatttctgttgtgtataaaggggtgccccagctccaggctggtttcctcggggaaaccctcagctctgctcagggccagctgctggggtagggtggggcggggctgggaagccttgtgccttctgattggctggctctgatccggcctgattgtcccagatatccgtctgtcattacagtcagagaggacagaacctatccttattattgcagagaaatggcgtattttacctgaagcataatcctttatacatattctaaatccgtgtcacattctgtaagtaaaatgcccccaaatgcaaatgtccccccaagaaactgaaaatacacaaatagatctgtcaagtttgcaggaactatgtatgtggatgaggcaaagagaagttcacctggccaagcttacctggggccagatctgaggaggcgttcatggaagtctttccaaagtcttcgcccaggtcgagacagccaatggttctgtctcaggatggaccgtcatggtcaataggtggtagcgacctgggactctgtgatgagaaccacatcagggtttaatcaaaggatgtgtgattgattaacaatgcctgccgttggcacaggaagggaggctgtggcccatatgccatgtgcgtcatcagcatctcatagtcatctagtcccctttcagtagagctgcctgtgagaagggctcctctggaatccatgaaggcagggggagtctgcctgaggtggtgccctcccccatggcccctgccctcctgcccaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggaggtgcgtgtcccaacgtaaagcatcctcaggggaacgcgctcagatgggagctgggaggtagggtgctgcatgattgtacagaagccagccagtgtgctgctaagagcccagtgactctgggcatgtcccctcccttctccaggcctcagtttctctccccgaccccaccgacccgcccccttccccatccctctccagattgagcaggagcgaattgacaagatctggccaaagctgcgggtgctggctcgctcctccccaacggacaagcataccctggttaaaggtaagacttgggcgggcacgggcaatcctgaagcccagcaccaggccagaagctgggccctcctctcctggcacttgcagcttcttcccagaagggaagggcccctcgcccctgactctccacacctgggcacagccttatgtcacccccttttcagccccaggagcctgcaaggggccagaaggagatggggctaagtcttctctgtgggcctccaactcccctaggaagcaatggacctgggcctgtgtggggtcccaaactcctggctcagcgctgaatggggcccacagacgtgttctatgtggccggtacagcgcctttttaaatgatggatttgaaagactacgcagaccctgctctctcacctttgacatagtccttactgctgcttgttgtctgatactcagcctacttcactcgttctcagtctggtctcagagctttaagtctcttggtctgtctggtccctgaggcccccaaccaacgtttgtgaccaggacctcagggatgcgctctcctgggaatagccacctgagggatgagaccaaaagccaaagtcttgctcctccctccagagggagggcacaccacttgctgagcctaggtggccaggtcctgggcactttttatttttatttttattttattttatttgagacagggtctccctctgtcacccaagctagagtgcagtggtgtgatcatagctcactgcaacctcaaacacctaggctcaagccatcctcctgcctcagcctcccaagtagctaggactacaggcatgtgtcaacgtgcctggataattttttttaattctttatagagacagggtctcactatattgcccaggctggttgcaaactcctggcctcaagcagtcctcctgccttggcatcccaaagtgctgggattacaggtaggagccactgtgcccagccaactgggtatttttagagtcacgtggtcctggctttgccactgacctgctctgtggccttgggcaaatcccactctgggactcagtttcctcatttgtaaaatggctatgggagcagggctccactggagatcagccctagaacatcttggattcctctttcaaaggtgctgcccaaggacattaatggaagcagatctggcctggggagagaaacccagaaccccagaaccacaagggagcagaaggcgcccagcccatccttattcttattcattcactcattctctccataactgtttactgaggtcctgccaggtgccagccctgctcaggacaggcctggtcctgcccacgtggaattcatgggccaggctgcacgcagcaggcattgaataagtggtccctgcatagagcaaaaggctgcactgctggcatggggtgctctggacccaacactgcctctaacttggactagggaggctttaggtcacaggccatggaaggtgggatgggctccagggttggtagggcctgtgcttgaggcaaggcagggaactgctctgcaaagggctagaggcagaagatccccagatgccttcaaggatctgggccaggacctcggggtgggagagggaagctacaggagactggagcaggtgggagggcagcagatcctgcagggccgccaatgcccaccacgagcaccccgtcatggcctgcaccgtgtcaccaggcacaggaacatgggagggtttagagggtagaagcatcattttagaaaacttaccctgcagtgcagagcacggcctggcagtggagggacctgtaggattgtcctgcttaagagttgtcacctgcccacagtggtgacacctcaagtggagctgccaggtgcgggtctgagaaagtttgggtagtggaggggtctgggctgggtggtggtttgcatgtcatggagggatgaggagcaggagggtctgggatcccatcagtctatacctgttggagaagagcattggacatcgagcgaggagggagagcaggcctgagacagagtcctgggtggcacatgtgggtggggagagaggagctgcagaagccaagagctgcccgagtgatggtgcaggctgagaacctacagaggaggccaaggggaggaggctagaggggcaggaggatggtcagtggggagtggtgccgggaagacaaggaaggaggcctgtggaggaggaaggtgtggtccatggtggaaatagttgctgagaggtctgcggggacagaacagaaatgtgaccataggaagcagccacagggaggcccctggtgactgcacacagtcaggccaccccaggactggaggcagggaggcgtctagggagaggtttcctcccagctttccgcacagcttgagctacgcaacggtccgcaccacctgggagccacagggcagaaatttgacccgtccctgccttggaggagcccccaggctgactgagggaactatggaaactcaggcctaatgtcccaaggggacaagcttggggaggctgagtccaggacggtggaactgaggggtcaccgacagctgggtgggagcagcccagaacgattcccagaacacacggcactgcagctgggcctgaaagagggtagagctgcaagggagcaggttgggggcacagtgccccaggttatggaactcagcgcctcattccacaggctgctgccgtctgctaggcacagagcagagagatgcgcaaggatggagcagcacatagagttacatggatctgattaagggcaggcagggatcctcagagggtcagaaaggcttcctgggaaaagcagcctctgagccaaaaatacagtacaggtgggtgacaggagtacctccagccaagggaacagcctgcccagacacagggccagtgagagctagctctgtgggaccgtaagcacagattgggggtggccaggggatgagagaagagaagaggtcaggatgtgagtgaggcctggtcacagaggacttcataagtggagctaagaacatggatgttatcctgagaccaaggggggaagcaggaaaacgacattccggggatggctgggggacggaactggttcagacatgggtgttagagagatcctgaggttgctgtggggaagcaagttggagggggagtccagagtcagtgagaggaaacaaagtgatgctggtggcagagggtggagacagagaaaaggaagggtttcagtgggattttggagccagaattggcaggccttggtgatacattcaatgtgcagaatgagagacccatggatgctgatacccaaattcctgtcgtgcccatggacatccctgctcgcaagccccatgaatgaggagtcccacaaactccacaggtccccaccgatgacatccttcacccacccttttccactggccccagctcagtgactggggccacatgtcatttgttcattctgttattcgttgaatgttttattgaagatgaatgtctggagggaggtcagggccagaatggtggggcagaggtcactggcaaatgacaaagccaaggcctcctcagcaagcctggactccccagggagaaagtgctggctagtggtgtcgggaggaacagatggtgaggtcctgctgaaaccctgggagccctgctgaggcagagggggccctgagcacagttagaggatacagtgtttctggttaggatggatgccaatgtggccacaggttgcagacagcaaagagggggctggagaggtgagcagggcccgggccacagggggccccaagtcggcaccagcccagtaaggagcccactgtaacctgctggcagctataggccagcctggagctgggaagagcctggatggagggggcggctggacagggaccagagaggaagccatgcccagccaggcccctcccgaggaccagggctggcccaggctgcctcccacctgagtggcccagggcctgagcacactcctgccccaacaggcatcatcgacagcacacacactgagcagcggcaggtggtggccgtgacgggggacgggaccaacgacgggcctgcactcaagaaggccgacgtgggcttcgccatggtaggaacggcccacagagggcctggggtggtgggggctggggagattggactacacaaccttgggctggctactcaggagccccagttcacacttggcccacccgccatctgccgtgggtgcccacccttctcgagactcagcctgaccccgaggtcttcctggaaaggcataggatgcttcttgctctgggggagctgtgtgaaggggggcacttgcaggctgaggaggaagataacagagggggagagggggccagggtgaggcttcctgagggtgaagggagctgggtctgtgaggagcgtgaagagtggggtgtccctgtgtggtctggctgtgctgggcccactgggagttgtgtaggactgaggaagtggagggagtgaggatggtgatgctagaagtggtcacctcccccggccaccccacccagcctcctgtccctgtccccacagggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggtgggtccgcaggagaccacaccaaagcctgggggagggcggagaccccccacagaggctcgggggccttagggtactccaggttgtccctgtcagaacagccggggatgaggcacccatcgatggagcacctgctgggggccaggaactgcatcacagagctcaggtgcaggcactggccccaggggagtcgaggacatgaggctcagagaggtggcgtgacttgttcaaggtcacccagcaaatgggagctgtcaggctcacagcctggccctcactgcaggaggcaggagagggaatcctcaagagaaggcagggcccttggccaccacgagggcagagggaggcagggaggggcaggccagggcccaagggggatcaggcatccaggtgaggacaaagagccagtgggggccctggggccctggctctggactggagtgtggagtgccttaggaggtgctaggtggggataactggagggagtcggggatcttgctcactgggaaggtcacagaggagtctggccagataccacgactgggtctggagcagccctatgcactgagcctggcaggcaggccccagatgtctgcagactgactgcttcttcatgcagctccatgaggtgggaactgtgatgatcctcattttacagaggcagaaactgaggctcagaggatggactggccagggacctgccattgttcttgcagtctcctgatactccccacaggggctgaccagcctggccagggaggcaagaatgggtctcccttagccccaggggatccccaaggcccaacactcccagtagccacctgggcagacaagcccatgcccacaggagcccccagaggcccagagtgcagcactgccccaagagctgtgtggcgctggaacactgctcccctctgttgcttcctgcgctgggggaatataggtggcagctccggctaccccagccctgagaatcggagccttgggagggtggctgggggcttccttttgctcagaagggccctctttcctggcctgtggatgagacactccctctagtggcagcttgaggaacactcctgcggccccagcaacttggaaaccagaaggtcttgatgccagatagggaaactgagattctgagaccactatcagtttgcctgaggtctttgattgagttggtggcgaggccatgcagcattgataagaagacgggcacacttgaccctgaggtatatggaattagagaaagcccggggtggggaggacgggggcaaggggagcgaggctgaggcaaggaggaggtgagagagaaagccaggagcaggggctgtgatgaaacctgggaggtgatgagtggaagggatgcaggtatatggggctttgggagagaacagaggtgggaagagcatcgggtttgggctgttgagcttacagggtctgggggcttcctggaggaggtgttccacaggccactagacggatgtaactaaagccacaggacgaggaggagaatggggctgaggcaggaacacagatttaaaaggaagggaggacgacgaccaggagagtggggtcaggattacaagtgggagtgcaggggcgaggtcagtgacatctggccgagaagaggtcctgcaactcgtggcacagaaggtgctggtgacgtgggcggagggcattctgggaacgtggaggggccaaagtctggctgctgtggacaagatacgtgggggtgtgaggaaggatggggacagaagaaccagctcctctcagccaaagagacaggtctgaaagggtccctcccagaacctggacagtggtgacctaaaagtggtgaggtccttgacaagttttagttgcttttgctattcctcatttgccaatatttcctaccttgaaatgtattaatttttgagtcatagatacgcacaataattttttaaggtaaggcgggataagaggggaggagacattgggggggtgggggacgggcactgtttgtaggatagaaagcccgagggggaggaggcagtggggggaggaggtaggagcccatgccggaggcggtgggaatggtcttggcctcagccaggagagaccccctcctcgggggctggaggggagaggggaagatggtgagatgcagctgaatttaccagaaggcagggagctggtggccattgggcctggggggactcacttatctcctggcagggaagatgtggctgaggtgggcaggtctgcactgttctccagagaaggcatcagagaacaactccatgcctgctggggagccaaggggcaggtcggactccagcctccagcaggagcctgcggacactacaccatgagcccgcccagcacttcacagcagcaggtgggcgcacaggtgacagccctctcctgcccgtccccaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggtgagcgcctcgcccacccacgcctctcccaggcggggtcatcaccttctgggtgcaccatggctctcacccagcattctcgagtcacaaccccctcctgttttgctaatggggaaattgaggcccagggaggtcaagtaagttgcccaaggtcacaccagcaagtcttgaacagggcctggccctgtcccagctctggctaaccctaaagccatcagtggctttctccactggtgacagctcctggcaacaagtacagaccgtgcaaggccctgaccgggtgctgaagcactgcatggcagccccagaggcacctgaggctgggaggggagtgactcaccccttctctgacccattccagcaccttatcctggccccgtggaagggaccctcagcaaggcttcctggggcagggcatacacgctcacaccaccaccgactctcacaatgcttccacttgggctgcctggttgggtcttccactcagtgaggcaagcacatttgcctccaccccacattacaaacgagggcaccaaggctcagagaggtgaggtgacttgcccaagggcacacagccagtctgaggaagagtctgggcacagaaccaggtctggctggggccaagactggcctggtttccacagatgcttcggaggcaatcccaacaaagcctatccccaggtcacagatggggaaacagaggcccagagaggggaagggtctggcccgcagtcccacatggaatcagggccagttctctccttacaggagcctcccggagctggcctttcacttgtcctcaaagcccagagtgtgatggaggtgggcatggatccattcctcaaaggcagttagttgccttttataaattttgaaagtagtgtgttgtcaggacacattttactgttgtaaaacttatcatgaaaaagcttagaggaagccacttatatgcagaactagaagagactcagaggaggtggaggggttggagaggagaggagagcgggggtcctggtcggcttgctggcttgaccacttgagcagcacctaccctgggtagtcttgggacatctcacacccagaaaactccacaagcctcctggcaccactttactcagctgtgcaaaaggacacaggacttggccaggtgcagtggctcatgcctgtaatcccagcactttgggaggccgaggcgggtggatcacttgaggtcaggaattcgagaccagcatggccaacatggagaaaccccatctctactaaaaatacaaaaattagccgggcgtgatggtgcgcacctgtaatcccagctacttgagaggctaaagcaggagaatcacttgaacccaggaggcgggtgttgcagtgagctgagatcacgccactgtcctccagcctgggcaacaacgagactccatctcaaaaacaaaacaaaacaaaacaaaaaggatacaggactgcatcagacaccctatcagcagcgtctacacagcagtgccctgccatgtgacagctcaggtgttagaatgaagccacatgggagggtccagagccagcctagcccagaagtcctgggctccatataggaattggcatctctagtaacagccccatgagcttgtagaggtctcagcaagggacatgctcaggaacaagaagcagcactctcggggcagcgcaaaacctcccgcaggtatcctgtcctcgcagtccagaatgagttttccagtctgaggtcactttttagaagccatgtcgcccacctttaacacagccggccgtccacctttatcgggtttccacagaaaaagtggaagacagttgcccaaggcctttcttccccagaggagaaagggctttgctgacccttcagtcctagtctctgaccagctgacagcacagccctggccccccactgtccaagcatgccttgatgtcttggggattcacgtcactgctcagaagaggcccccacgaaaggccaggcatctcccctctgattcccccaccactgccttcagcccagccccactctctcacttggcaggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccaggtagtgaggcccccaccctaaccaggcctggggtgggcagcaagcggctggagcccctgggcagggccctgagagcccagccctctgtgctggtccctgatggcctctctctctctctttctctgctcccctgtgacctccagatagtgatcgtgcagtttggagggaagccattcagctgctctccactgcagctggaccagtggatgtggtgcatattcattgggttaggagagctcgtttggggccaggtaagttcctggtaggtcgcaggaggtgcctgttagcagggcaagggagacagcactggatggagaatccaggacccccaggaatgggctgccagaccccaggcaagctcctccctatctctggacatctgagcaagggggcttgtcccaggtcctatactggtcgtctgggtactactgctctgatttttgccttatatctatctaccactgctcctgttgtttatgtaatattttctctcaatcacgtcagcttttttaacttaaatttgtttttaaaggcaacgtcctgttactaagacaactgaaaaatcagtatcacttgtcataaatggaagctaacaaaaacattaatgtaatgagaatgacattattaaactccagctagaagccatggcctgccagggattcaaggctggagcagcttgttaggaagggagatgaatcagtggtctgcgggcgctggtggccggctggcgtcaatcaggatcctttagagcactcagagggaacgcaagcaggacacactctgccacattgcggtgttactcagtgctgtgcctgtggccatctgtggcctcagtgctgtgcctgccccagctctggggctccttgggctggatgctctttaggggcccttccagctttgtcccagaatattctcccaccaattcgtttttctacgtttgcccaagttccagaccctgtcacagctctgagagcatgcagcccaaaggctcctgacccaggacacagggcttgggaggagggcccagaaccaactcagggcctaaggggcctgattcccaaggtgctcacacatccaggcagtgggaccccatgggtgggaggcatttttcttgccttcaagctgtctgcaggctagagtgagaagctacgggggcaaaaattaactaaaagataaataagaaagtttagtttcatccaaaaggacttcctgtaacctttggggctgctttggagagtgataaacccctgggcaccctgggggccaggccatctttatcccactggggcccaccccctacaggaggctcttgggggctgggcccagtaactgagggaaggattcagaggacaaaggttaatgccagcgggcagtgctgactttacactcccagggagccccctgaggctgcattcatgccagcgcctgactgctcctacaggaaatggaaggggcctctgatatctgccaccgcagctttcctgtagggcctgcgtctgggtcctcagccccatggacaagccttttggggaagattaggaatgaaggcatagctctttcccattctgccttcccagtccaggattggctgccttcagggtccagtgacctcaggaggaataagggacagaggaataagtaaccccaggagaaccgagggccagccacgggccaggctcatgcaggacgagttagaccctccaccgtgcccagttctcaccatgcccagagcggcccccactttacagctaggaaaaccaaagctcggtgaggttaaatgacttgcccgaggccacaggaccagggttgtctggggtattcaaagccacatctgtccaactcctagaggccaagattgtccactatgtaccctgactctgaatgaatgaattaaaaagcaaattgcactccagcctgggcaacaagagtgaaactccatctcaaaaaaaaaaaaaaaaaaaaaaaaggcattgtcaaagactgggctgaggaacaggtgaggtgggtgaaggagtagattgatcacatgcctgggtgagcgggtaggaggagggaggtagaggagcgggtgtcagggagagaaggccactgggaaggacagccccaccgtcctgacagacagggtcccttgcaggtcatcgccaccatcccgaccagcagactcaagttcctcaaggaggcaggcaggctcacacagaaggaggagatcccggaggaggagctcaacgaggacgtggaggagatcgaccacgcggagcgggagctgcggcggggccagatcctgtggttccgaggcctgaatcggatccagacacaggtacaggaggctcttgggggctgggcccaggcctggccggggcgggccaggggatggaggtgagtgtgcttgtgctgccccccagggcccagctctggtgctgagggagggtggctacagaggggtcccggccagctctcaccagccacttgcacacccactcctgtggctgctaaggaacagcacggcctcctcagagaggtcccattgtgccctctcagggcagcacggggaagtggtaggggtcacacccaccatggtctccagggggatttccctgagagggtggggaagggtggctctgagggcagaggtgagtgaggggactgtcgctcagggctgggggcacccacccacaggggccgtgtgaggctggacagaagctgcaggccaggtcgcccagggtcccccagggcgtggtggtcagggggtccgccgcctccacgggggcttcagttgctctccccagcttcccctagggggtggagaggctgtggggagcaaaggtcagtcatcctcaagcacacacagacacacatgcacacaccaagcacaccaggggagcacaggtgcagggcgtagccagccagaagcaggtttcttccccagagcagagagagcatggctgccacgtggcacacgacacacctgcgcgcctccccccgaccccccacacacataccacatgctctcacatggtccccttatgcctggagcaggtgttgtagctcacaagtgctgtcacagccctgcgaggggagggtcagaagggactctgtgggtctcttgcccagaccatctggggagctggagtgggagctcctccatgccccagcatgcttgggcgaagtgcagtgtagaagcagccacctggccaccatcctgccagctgtggcccagcacctcatttccatccgatgtagcagagagctcacctgggtcacctcccacccctctgtaccctgtcccaaacctcacctcatgtgaccttcacagccctgggaggtagatgtgactcccccagttttagaggttaccaaggtccaggagatggccccttctactgagctggcacagctggggtggggactggaagccggtttcagacccggaggtgcctgacacgggcctgggctcaccctccctggttagggccccgcagccacccctcccagcctgcccccacctcctgggaggtccaggacaactcagtgaatatgtccctggtgctgtcactgccctggcggcaaagccacgcaggggtctccagattacgggaggaagcaaggactgcgatttcttgagtgggcaggggcgcctgtcttgcctgcctcttgcggaatgctaacacgggtcaggtgctttgccacttacagataaccctgccaggcaggtggcattgacccttcttaagaacaagaaactcgactcagagaggtggcttgcccaaggtcagctagctagtaagtgacagagctggaatttaggccaagctctgtccacctcaggacccccaccacaccctctacctccacgcctgtacctgagggaggctgaacactgctctcttccctccagataccatgtttaatcactgcctcccccactggccagcccactggcccctgagccactagcacaggacaaaggccggaccccctgtgtcctcccggggaccctggggcctgcaggtgggcccagagctgagcagacgtttttcagagccttggagtgtgtctggtatttttgttttgatttaagtgacattgtcgttgttgccgtggctgcggctgttcttgtgacgttgccctgtcagtcatgtagccgttgtgctcgttcttctcgcaacttgtctcgttctctcctccgttgcagattgaagtagtcaatactttcaagagcggggcctcctttcagggggccctgcggagacagtcctcggtcaccagccagagccaggatgtagccaatctctctagccctagtcgcgtgtcgttgtccaatgctctttcctctccgaccagccttcctcctgctgcagccgggcgtgagtgtgactccttactgcctccggctggcactgcccacgccagctcccaggcgggcaggggctggggcaccagaggacatggggggcagccggtcacaatcaggcccagggggatgaagggtcccagccaccgaagagggtcccgttggtcaggagagcgtagccagtcatgcggtggcagtcactcagtggaccagggtcagtcagagggtcattagggtcccaagtggccaaaaagtctggttcagtcaaggggtcacccttggtcaagaggacatcagtgaccaaatggtcccaatccaccacagggtcccggcagccagagggggacagacatggaggggacacagagtgtcccactggcctagggtcatatgtggtcaggaaaagcccggaccaccaaggcaagggttggagttggacaagaggtcccagtcttgcagtcaaagtcagcagaagggtcactgtgggtcaaggggagcaagccccttagggtcacagtcagtcacattgggatccacccaggagagggtcacgtcaaccagactttcccagttggtcagggggcacccacagtaatgagggtcatggtcaagggggacagttgagccaagaggtcactgcaggtcagaggtcatagtcagccagggatcccaggccacctaggagctcacagcctagacgctgcaccccagcagttcagagtctctgcccgcttcctgtcactcctccccttgcacttttgactgcatcagctgccctgcagacacctttccctgtggctgagcttggaacttgctgaagttctaagcccttcctggaaaggacaaggtccctggcccattcagcttgacccctggtagaaaatggtgggtcgagcctcacatcttgcctgggtgccagcaggcccagagggacctgatatgcccttcagcatcctgccctcctttatctgagagatagcctgggactgtggcccctccttcatctccctcctgccaagctcatctcctcatgccaccacttctgatctagatcactcattgctggctttgtctagctctttcccggacccatggcttcgggccccatggggaacaagtctgtctttcctcccatcgccctgctatgtttccagtcaggcgcttctgatctgcaggggagcccctggttctggtcttctccaattggcatagtgtcagtcttagcctccagcttctttgatgagaagtagactccagctcaccccttgaaactttataaagggcctctacccccatccaaaaccagaacacccacaacacaaccccctgcagccaagcaggtaacccggtgtgctggtgggagcgcctccctcagtgcctccagtaggaggcgcgggccacagggagcctgttgatggcaaatgtccacgacccatagcggcaggacagaagcagaaagcagggaaggagcctctcagtgctcattcgtcagcacagaaacgcagtgctggggaggaccggggagccaagatgaaatggagatgcatttcagcagatggtggctgagtcacatttccatgagataccgtcactaggcagtcactgccaggatttctcggggaaggcaacaccggtcccatcctcctcccctttagaccagagagctctcaccttagcagcagcctagccagctgacctcccagctcctttctgcaccaactcagctctggccttgctcagcacccccacctatcctgaggtgcggtaaccaagtgtcccggcagggagagctacatggggaagaatccacttctgttctgccacccctcccgatgactcctgcggccctccggctggggctgcctgctagcagtctggcttctgggtgaaggcccagttctttgtccatcccagttgagcctctttcttgaagggcagcacttcaccctggccacgacggagcacacctgacatcgctgggcagccccactgcctttggaagtcgtcctcgagtcagcccctcatcttagctttcacagcctggaagctagagctgtccgctcaaacctcagccacttctttctcagcttttcttctgcctcatttgcaaagccattcaatagggcccgtccgggaacaacacttctttgcagaaatgcccttttcttcatttctgcagaaatgcttagacaggaatgtgtctacactgacctccttcgaggccagatcagtcccctgtagcccgtggttaccccaactttggaacagtcttggaaaagaagcccaggcagaggctcagccaaagccaacttgacagtccttgccctgacccctcattctctcaggggacccggcagggttggccagggcctccccaccctgctcaccatcttgcctctccctcttcatgcctcctggagaatctcgcattccccctctgtgacagaatccagcctgtaattctgggtccctcctgagacccttcctgagcctatagtcttaaaaagagcctgaccaaacccctgcctgagggcactggttcccagacaggatcacagcctctgtggtttcagtacacacatttggacaacacagcctcgtgcctcctttgcttgagtagtgtctacaacagtgctgcctcctctggtctccaaggactctgaggaccctctaaacaccagccaaggtccctgcagaagccagtgtgctttcctcccacagggaggtttaaacaggtggccaggaagtgacagaagggccccaatttgatgggatgaggaagtgggccgccccactaccccacaactccttcacccccaccgcaccccaccagccttctgagggggatctgcttcctggggactccccagcagaggaggctgcccatgtgcctgctgaggcaaaaacacctgcagccagtgtgccctggaaggagtcaatccactgtcccctgggttatgaagagttgaccacaaaggcctgggacagggcctgacttctgacctgggacactggagtgaggaaaacccctgaacacatcgcaggccctcccctccccacggcaccaccgcaagatgaaggcctcagcagacagacgcacatggtaagcctgaccgcagtcacaaggcacatggcacgaggatgctcgggagggaatgaattggtgcactcttctgactaactcaaaaacgaggttgtttttgccccggaaacttaatggcacgtccctattgccttatacctgagccccactcaacatttccagagcagttccccactccctttacttcacagatgcctcaccactgaattgtgggaggggaggacctgccaacacatccatttcgcagagaaagacactgatgaggccagggtgaccacagcaagggcgtggcaagaggtcagactccggagtccctcattcttcccactagtcacaccgcttcccaggaggcccacagacctggagccacagaggctgaacttccattccggaaccagtgcccacgcccacagcctcatatcgtgaaaaggagtcagtcctccagggaaggccagggaagctgtttctcagcttgaacttctaccagcgtggccaagactggggagaagggcaccttcccactggtgatcaaggacaagattagcatcccacacttcgatccaaggcaaagccgcacagcctctctttctcattgcctcaaattcctaactcatctcaaaccatctttgtgcttagcaagtctgtagcaggctccgtgtttatcagtggaagtcctgctctttcaaaccacccaagccaagagccagccccataagccaggtccaagccacattctggacgccgtaccttgctagacagataaggcacctcctgctcccacttcccctgcagattcctggttctgacgactcctagggcaaggagtttgcactgttagggggagaaatgaagacaacaaaaagggaagaaagctggacttctcattagcgttttggtaactaatttagtgcaaccttgggttggcgagaaaatggcttgctttgtggggggaaccctagacctctccactgtctgaatattccatgtgtttgtttccctagagggctagagaaccctggacacagagttcagcaagagagagtgaaattaaaagaggttgtgagtctttaaccttgagcctgaaatgaatgtgaatcaatcccagactcttggcttccttgaagccgggtaaacattcgagtatgtagaacccatctcagaccagggcctgtgcgttttctcagagccctctgacaacgggcatgggtctccctgttccctttgtgctgacgaaaccaaaacatctgaaaccccgctcaccaggtcccttcctctccttcccctcacccccacgcccaaatgcagcttatgccaaaaaaaaaaaaaattcctacctttagggtaggcagggaggggagatggaagagcctttttttttttcccatagttttttccatttcagcctcggagagaaccgaagtggagacttgagatggccgtggcggggtgtcccaaaaagtctcgtccccacagtcttgtccagagcagttcattttttctgttgtctccatgccacggggagggcggaggggcctcatctcattgtgtgtcatcccctctgcgttgtcagtcacatgacagggtcctgccaccatccccctgccccacacatacactaggtgttccagtcagcatctgaattgcacttcaacctcagaacacactgagcaccaggctaggcagctacagccttgatgctattcccattctacaaacaagaaagctgaggcctgcagcgccttctttgttttcagttaatcaaggtgtaacggctcacttttcaggagatcagaatatgaaccatctctgcagagccacaaagagggactccagggggaaagagctcagagcagccacagtggccatgatggagcaccagcataaaggccgtgtctggctggctcttatttggcacttgttgcctcttatttaaagcacaattccagcaagtggggtaccctggagtcccagctcacagtatgcaaggtgaaaggacagaggtgcttttcagaaaacagaaaagtcagcactaactagtaagcgatgactgacagcaagggagaaaaaacaagacaatccatggggtcttacctaagaccaagaaggataattgacaaagcttatgttaaattcttctctgtgcactctaaattagaagtcagaggagcgtatgacatgctttagaaagaattccctctgcaacagtaaaacaaaccttcagcgatgacacttaaaatcatcaaccacagtcacctagaaactccacttccataaaagagggctttccccaccagggtttcacaaaggagctacccctgggttccgctgagagctcaagtcctgggacttcaggggcctccccacgaccgtctcgtccagtcccctgcctccccgcaggcctgtggtgcagggcagccactgctctgcaggtgggtgccacttggcctgcacacagcagccgactaaggctctgtcctggaggcgccaacgccaccttgttttctccacctctgactccactccgagttggggctgggacgagaggaggaggcacctttgtcccaagtcccatcagactcttgagatgacaggcactgctgcccctcccaggagtccagagaagggacacctctcttccaagtgagggtcccgtccctctgcaccctgtgaggcaggacagaggacaaccagagagctagtgtggcttgtccacagtcaaggcaccagatgtggcagagccaggatgcaagttgggtctttctgcctccaagtccagtgctctttccactagccttgaagactcaatgaccagcctcctcccattcttcagcggaggaaactgaggccccaggacgtgtggttcacaactgagacagaaaatgaaagaacttgctgttttgtgactcagttccacacaccccagaatcccactggggctgggtttggccatctgattccagcctcgttttttggttttgtgttttcaaagcacaaataaagaaataaacaaaatcccccaggaaataagagaccccaaagcaagctccaataactggccggccagggctttgagtctatactcgagtgtttacctcccaaatgcatgaaggaaagaaacgctgggtacaaacgacctccgttcacattgtccaggcttccaagtgtagccgtgtgtctgtctgtgtgtgccatgtggctcccggcctccccgtggcatgcagcccgcccccgaatgtcatctgtccgccagctcccatgtgctttctggctgcctctgctctgcacctcagaaagccctgggttggctttggtttgctttgctgcctttggtttgatgttcccgttctgtttggccctcatgtgtctctctcatcccaactcatccaaccgtctctcctttctgtgccttttctgtttgtgacacgtaacatgttccatgttgtatggtttcttaactgtgtgtggttttcctaagatgaatttttttaatagcctctcctctttcctacttgattcccacctggtcctcctccctgtctgcatggttgaacctctgctttaaagtgaacaaggctcagtctctcactaggtgtgggtgcccgcaggagtcgactgtgcttcctttaaccactgttccccatcatctctttgatggtgcttggtgattcctcctgtcctaacactagtttctaccaaaaccaaagagatttttaaaaaccagctcaaggatgcctataacctgagccccctttttcactctcccccatcctgtcaatgctaataacacccagcgactatggattccagccacctgctttgccctaacccttctcccacccgcccctcctgtgagccccccgagcctggctgtggtccctgggcagtgctcctgacccctgtgcttcccttgcagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctctcgcctgcccgcccgccctcatggaccccgctgccacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctccatgttcattcggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataattgtaaataaagaactcaccatctctgttcatttaatactatgcaatggttatgctttcaatcgctggctcttctgactcgtgcagtgtggttctgaaatgtttgtggtttaaaaaaaaaagcaaaaaacaacatcaaacagaacatagtaaatatatctgtaatgtatacttttttctactttgggactgcatcatccacatagcttcttttctgtcctctagacaagggctccaggagtaagtggcagatttggttctgagagctaagctcaccaacttgtctccccctcaacagatgagggaagggcagggagcccgttcagtgactcctggcgctgcagaatcactcatctttggaggtgagcagagagagctctgaggagtttccttcttgcaactcaggcggagctttctttaactcaggagcagcctccattgctcccgccaacccctcaccatggccccttgtccccttgtcccaaccatagcatagagatgacaagagagaggcagtcctatttctgagactggaccaattaaaatgactgcactggctcaaggactctgaacctgtcttgtcctgggtcctccagttgttggaagccactcttttccccaaccatgctgaaatgccacctttaccacacactgatgtcttacatagacttagatctatttctggaacttctcttctcttcgcttacttgggtgtctcatctggcaccagccatacaattttaactattgtcaatttctaatgtcttattatgtggtgggatgagtcccttcactcttcttttacaaaatttcctagttattctctcacatctattcttccacataaactttaaattgtgcccagtcctccaccccctgtcccattcccacccccaaattctgggctctgtcattccctgtgccatcatcttccccccattgtaattactgtccactcagggctgtgaaatagactatgttctataaagagggacaaaaagggcatcctgatcttgagagaagcctgctgttcctcccatcatttcacctgccccctaagcccaggagttgtcatgagaggtcaccaggcccccactcaatctcagcttgggaaccaaagtcacccaccttggttgtgttggggtggacccgccatctgtccctggtccagacgagaaag

SEQ ID NO: 14675 - DNA, 24139 bp, Human
ttatgcctgatgcattatatttacatctaatatgcccttgtcctcattttccactcaaagaaagtgaggctcagagaaaagtgacttggccttatcacctagaaagtcagtggtgcagctatagagccaaggccagagcctgttccttgaagaacaggagatctggcaggacgcagcggctcacacctgtaatcccagcactttgagaggccgaggagagtagatcaccagaggtcaggagtttgagaccagcctggccaacatggtgaaaccccatctctactaaaactacaaaaattagccaggcatggtggcacatgcctgtaatcccagctactcaggaggctgaggcaggagaattgcttgaacccgggaggtagaggttgcagtgagccaagatcataccactggactccagcctgggcaacagagctagagtccatctccaaaaaaaaaaaaacaaaaaaaacaacaggagatccaagagatcccctgaaacctgcctttgttccctgctctaacctaaccaccaccccctcacacccctgcaacaatttctccactagagggcaataaaaaatcttgaaagctgcagtggggtagaagagttgcccagaggcctggcccttaattctaacaccctactcccctggcctcccctccaaagctccttgacagtttgggtctatcacattctctgagccttaacatcttccttcaagcagtgaccatctccagctagggtccttactcccagtttcagcagaggaaactgaaggactgtgacttgcccaaggggagccaaggcctcccccagctcatctgcctccttaatgtcacaaggggcccagggctagaccatatgtggctgaggcggggagcccaggctctgtcctccagtgtggcattctcactgcgcttgtggggagccttcagctgccctaccttgtgaagccagagacctggggttggggaccctgaggattaggtctggggctctagctgcaggagcctggctgagatccttcattgcctaggggggtctccttgatgggacttactcaggaccccaggggatcggtttggaaggggcagtcctatataggggttagggatggcagggccagaggtcccagcctctggcgaggggcattccctggcctcctctgccctggtcccagtccttgggtactgagagggagactacaacaaggaagcactaggacagtctacttactcctaagatgtcactcatcctacaacattcatcataagaccagtcgcacccagagccgtagtgaggcgggtgaagctgcagatagatagatgatagatagatagatagatagatagatagatagatagatagatagatagatttttttcttttttacaagagtgtctctctgttgcccaggctggagtgcaatggtgcagtcacggctcactgtaacctccacctcccgggttccagcgattctcctgcctcagcctgtagctgggactacaggcgcgcgccactatgcccggctaatttttgtatttttggtagagacggggtttcaccatgttggccaggctggtctcgaactcctgacctcaggtgatccaccccccagctcagcctcccaaagttctgggattacaggcatgagccaccgcgcccggccgatagttatattaatcctttctttcatttatggatctcaggaaaagggcagacttggtcgggagagtagacccaccagagcttcagattccaaagccctccgggtcagggtaactgcggcaaccagagccccagccctctggtctcgcacgtcactggaggataggggctgggccacgggagggcggggcgcgccctctggaaggcgcggaactgctgtgcgagccgagcgcgttgctgcccggaggctcctacgccacggcccgtcgggcccggcgccggaagtgagctgttccgaggcgccgccgggagctgccacgtccgagacctggagcagccaccgccgcaatcatggtgagtgttggtactgaggaggcctagcagggtgaaggccacggtcgcggccttcacgggttcctcggccgtcctgagtcccaaatcccaagctggagccgttcagctcccctccaccgcttagagatttggggggctctggccccgtccttgcggaccattccgaggggagtccagaggtgaggccgaggaacctccctgactttgcggggcgcgccgctcctgcgtctcctgccagtctcccttccttcttttcggtcaacaattgaaaacaaaacgaggaacagcagaggagctactgtataccgagccctcagcattgttcgtaatctccgcctgctaacagccttgtgaagaaggtgctattcttctcaacactttacagatgaggacacttgaggttcggagacgtggagcctcttgcacagctgcttaagtggtagtagagccgagatttgaaccctcctaaccattcctttctgccgcctactgcagctcccagcagagatgattgaactgttgctcggggtagggcccccaggtaggatgggcacctcgggaaacgtaaagatggcctgaacgaccctccgaaggcaggggctcagggttttttaagtctctgtggcatctgcagtgtacattcactccacacttactccttgagtgaatgaatgactgaaggagaactaaagaatggaagtatctgggctgagcctggaatatctagtacatgcattcttttagaaacatgggtgtgtctcagcagcaggtttgagggaacctgcaggaacctagaaatcagaacactgtgttcttgttctgcagagggttaggtgtaaatcactcacctctggctcttccactgcaggttagagttgaggcttttatgctctgacattcagctcatcctaaatgaatttttaactcattatctgatctcaaagaggtgaattattttgagtgcaggtgttaacagggaccagataataccaggtccctgggaagaagtactctaagaagttctctctctctctctctctctcccaccctccctctctccccactccctctccctccccccttcctctccctctccctttctctctctccccctccctctcttctctctctctctccccgctccctcttcctccccccttcctctccctctccctttctctcccgcccttcctccttccttccgtccttttctctccccctccctctttcctcccccccccccccccccgccttccttctctctctctctctctctctctctctctctcattcagaagtgtggttcatcaaccctgactggtgggtgagagtggttagaattaaatgctgattatttctaaggtcctttggtaacctggttgaaactacctctcagtaaactttcttcgtgaacctacttaaccgcagctttacagaactcagtgtaacaactgctttacattctagacaggcagcctggtggagtgaagttttgtggactcagcattagaaggttaggggatggggctcttttcccaggtctgccttgaactagctctgtgactttggcaagtgctttctcttctctgggcttcttcatttccttagtctgtcgcaggtctctgattgactgtgcccttggtaccctgccctccccgccttcctgtgcactttgtaacctatacagctcggcacatggaggaaactccttattgtccttacttgcctttgcagacttcggggacctggtttttagagagtctagaatctgatgagagaacctgtgcttacttggtgtgtacctcttgaactgctttgcagccatcctcttccactgtctgcctttctgaaatcacaagtcaaactttatacctacagggcttgtgctggaaaagatgaaatggggaaaatggtaagaaatgtctgttccacactgaaacttcttttaagtcctcttttctatcccaagaatttaagagaagagtggttgagcaaagaaaaaaaataacagcttttgttcatttacttattcattcagcaaatagtcgctgagttccttctatttgcaaagcactgtgctggatgatttgaggggatttgaaactgcagatggctcagaccatggctccaaggagctcaccttctagtggggagaagaaacagcataaagtgttgtatgtgttccttgctgaagatatgcaagagagtccagccatttgagggtctgagaatcttcaagaaaggtgatggatggccctttttgagctggacctcaaagaatagataggagggagatgaccatgacaccatgttccagccctacaaactgttcaactctggatcccactacgtgacggaccagggagcagcctcaggaaacactcgaatcaagtctcccagtctgaagtaataaccccgttatgcataaactgcctggaacatcagaggctctgtcatccaggaaaggaacaccagctgtagctcccttggggtctctcctcaaccttaagggtagccaggactgcttgccgtttccccacacacatcaggctctctcagacctctttgtctctactcgtgtattccctctgcttggctgcttggactggtattttcccctgtgccacctgcaaattcctacccatcatctagggctcaattcgtgtctaccaccccagcccctcaggctcctacaggacacacaaaccaccattaaataatttatcttgcgacactagcattattcgcgagcttctcaagggcaaaaagttcctcttatttgtgtctgtatatccagttcctagcacagtgcttggcagaaagaaggtacttagaatgaatgcttactgaatgaatgaatgaatgagtgagtgaacaaacaaatgcagtcaagaacttgagatggttgtattctaactgccatgagttaatttaccagtgatatctttggttctaggtgtcagtaattaacactgtggatacctcccatgaggacatgattgtaagtattaatatcaccctccctggaggggtgtggacatgggcatttttgtgggagggaagcaatttggggttttcattacccctttctgttgatcattcatggatccagggtggctttgcagtggttgcctatcagcctgtaatctcggggtatggcaggctccctagcagtgccctctgagttgtcaggactgtggcagtctaatcactctctgctgggaggaacctgggaataatttgtagttctaggctgtcagtcttccagccaacacaataacctgctctcggatgaaggctgagtgggtacggaggcttgacaatagtcttcccacctgtcttcctcctgctgtcacttcttagccccactggaaaggggggtgaaaagaagagagtgtagaaagatgactcaatacaaaggcagagggcagccacagtgaaagccccaggcagagcccagtcaaaccaccaagacaataggccagacaaggccctttgaaccagaagtccacactcagggcatttcctgagaggtaaacacaaggctcagtataagaggacagggctgcaggagaaggtccagaggttaaagtctaccgcaggaaaaacacagactctgcttcattcagggccaagcagcctttgagcaagacccaggacagctggctgacagtgtttcatgtcagggttcttgccctcacaacctgtccaccaacagttgcttttgggtttctgagaggttgtctggtcccagagttgtatatgttctctggattcagtcatgagtggtctagctgtaagaccacacctccttggagatagcatggaatcatgggcaggaagacccagtctgagactccctagccaatatcttaacttttctgagccagcctcaatttacttacgggaaaaataatggatatgctacctactcgtatgagtttggtttgagaactagatgaggccaagtagtaatgacaaacatttgcatgctcactgagtgtcaggccccatgctaagtacttttctttttttttttttttttttttgagatggagtttcgctcttgtagcccaggctggcatgcagtggcgtgatctcagctcaccgcaacctacgcctcccgggttcaagtaattctcctgccccagactcccgagtagctgggattacaggcgtgcgccaccactcccagctaattttgtatttttagtagaggcaagttttctccatgttggtcaggctagtctcgaactcccgacctcaggtgatccgcccgcctcagcttcccaaagtgctgggattacaggcgtgagttttcattcaatatcttgtttaaccttcataacaactgttgagacagatgctatctttagccttatttaaagataagggaactaaggcccataggatgttggtaaataataaagataaggaaactgaagctcaaggagatgaagtgttttcaaagtttgcacagcaggtaaactaaggagataggatttagatctgaaaggtactatgtcctgcctccttccactgagaagcatgagaagtgcttcagaaacactcctctactgcctgccctccaagaaaccaaggcctgatacagtggagggagttcccaaagaaaaatcaggatgtgttccttgcgtagggaggtgagaattcccatctgagccagacagaatgagtgcctttgaatgggcataattgcccctggtggccatgggagtgcagctgatagtcctgaaactcccagggtgggacagctggggaaagggacatccattggaataggcagggccagcaagcagaagggaccagggtgttcagtggtgcaggaggcatggtgcctcagagaccatcaccctgcggacaaggatctgcaggtaggggccaggcctagttctgcatgctcagtcagcatcaaggaattcggttcacaagtggtgagagcagcgacacttaaggcattgtgttccttgggtggaaagtctgggaagctctgggcacactactagggaaaaggtcgagcagaagccccaaaacaaaggtccacaaaggatccagggccagggctggaaagagcccaaatatctgaatggaaccctgtgtgcaggccagagctgcatcacagaagacctgactggggactccaggcagtcagaggcccactcctttggcctgctcccatgcattagcatcaggtgctagggctgagctgaacccaggggtattcccctttagcccacagagcctaagaactgaatagggcctgagaggatggaggaagaagagggcagctaggccaactttttttctcccatacccaccctgcggaacaggaatggaagagcccttccctgaggtatgtaaagggtctgtgacaccagctgggcatggcttgctttgtccatttcagagagacactgcccataggtgaagtgagaatgtccacatgctagcttcctgcctgagggtgatgatactttgagatcagattgatttcagggagattctggtccaaactagactctgtgtagtgacagccctcaccccacccacccacccacccagcctgcaggcttcccgagctgtcctccctttgcagcacgacgcccagatggactactatggcacccgcctggcaacctgctcatcagacaggtccgtcaaaatctttgatgtgcgcaatggagggcagatccttatcgccgacctcagggggtaagtgctggcgagcccagggaagggctccaggaatggtgtgggttctcaggccctgcttcaagcgtgggagcaaagcatgggagcccagattcagagcaaccccaaagcacatttagcggagaggacgctgggatcccagccagcctggctgtcctcagcggacgtccccagggatgatgctgttaagggcacaggtggatacaggtgtgaatctcagctctgccactttatgtgtacccaccagaagaccttgggcaagtgactcagtttctctctcagagccttcatctgctcatcctcaaaattgggccaatgctacctcctatccagctagtgtatgcaaggccctgacacagggcccaggacacagtaagtctttagtgcaggcagctactgctacttttaaaagtggtaaacagtaccatttcgttcaagtttagccagtatgacctaaagtgtcacaaaagcatcaccgtaagaataatgtaagaatgctatcattttataaatcccattgttctgcctatatgcccgtggcacgtgttcagtgattatttacaaatgtttgacctgccctgctccctactgagattcttgaggaagtcctggctcatttttatggccacatctctactgctttccctcagctcactgcctttcacgtatttgtgggtttgcctgggtgccgtggatctccaagggttctgtgaatagagttcaggggttgatgaattgggacagggggaaaaaaatgcattttcagtgactctgatatttagcatttccttcaattatggatgtaggccagaaacttcagtagtatttgtagtgcctgtcactttgtcaccagtagaagtcacagatattgtcatcacacatcacggttacttagctacctcaaaataccacttatgctcatcacaactttgaaattacagtggttattagacctgccgctagggtttgttgcttgaagtgttaacaaagaagtacatgcatcactatctcataaattgctttataatattttgataacaggctgggcaaggtggctcacgcctgtaatccttaacactttgggaggctgaggtgggaggatggcctgagcctaggagtttgaggctgcagtgagccacgatggtgccactgcactgcagcctggatgacagggtgaaacccttctcaaaaaaaaaaagttgattactgtataatttataattgaattttctttataagcctagttctgtgtgttttgtacattagtctgatgagggtccataaccttccccagaatgcacagaaaagattaagagccatgacaggtgggtgctcagcatgtgtttgttcactgaattaaaaagcataaactaagtcagtgtccatttggggaaatgggcctagaagctcccctctgtctgagtgtcaaatgatcaagtgactgaggagccaaatcaagcttctctatgcaggagccccccaggcaggcagagagctgctgcagtgcagcgtgttggccaaggcagttatgtttgctgtgactctgtcctttctgctgtttttcttacattcaaaggatgtgaaatattggagggataaaaaaaattcccaccccattcttttttccccttagtaaaaactgtgctagttgttggaagattgagtctactcagtttcattagcagcagctttgtagggactgggaatgtcctgttgtcccagccagagggaggaggagacttgagtgtgtgcagcccacggtgaaggagtaaaccaggagcagcactaatagctaatgggtattgagtggcttttttctttccttctaccaagcattgttccaaactttatgaaagaattcttattgatgtctccattttcaggtaaagagacaaagatatccttgcctaaagtcaagagctagtgaatgggagaatgggtctggtctcctaaccactaactctaccatgctactctacctcttgagtgctaaggtgcaaaaccttccctgggccagagaaatggtcaccgtacaaagcctggcacagagcatgtgctcagatagcacctgttatcaggtgaatggataaagatcagaagagaagggaaagacatgcctttcgaacaaattaaaagagtagtggaaaacatcaaaatgaaaccaataatgcctcctcaggaagctgaccgtcgggaaggatgaatagcaattcagtctacaaatatttcctgaacacttctggctggaaaccttggaccaattaatgactatgctgtagacagcacatacagacagtgctggctgcagtctgggcaagtgaggctcctgcctggccaggacaggaaggctgacccagaggctcaactctctctcaaaggctctgtgaccttaggttgcttaacctcttaggacctcaggctcctcactgtccactgagcaccccttttgcaatggcattgtatagttctccctttgaagttcttaagcaattctgccctgatatatcgtctcagggagccatttagttctgtccaaagtagtgcctgcagaggcactgtgggttcctctggcctatctctccctttgtagtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcaggtatgctgagcttggcagcagagcgggcaaggggaccactgggtaaaaaaggactctgtcccggctggagccctggctccctgcccctcgtggtgcctcttgtctgtctcttgagctttggttggcttttctgctactctgtcctcagctgagtaaggccctaagacctaaagccagtccaaagcaaataagaaaagacaggtgagtttctcttcaggattattcattgcaaggactacccttcattctcagattgttttcctacccacttttttgttagatagactgtaggttatgaaatcgtggtattagtaggtgatggggtttttttgtgtcctcagttgaccaagttacagcttcccccggtgactcctacagttgtttgttgtagacatttagtaaaacagtaaatctgtggaaggcgggacctggggccgcggtctccctgctttgctcactgcactctccctcttcccgcagtgaactcggtgtgctgggccccccatgactacggcctgatcctggcctgtgggagctcggatggggccatctccctgctgacttacaccggggaaggccaatgggaagtaaagaagatcaacaacgctcacaccgtgagtccatcccctgcctttcgtgcagtgagagcgcctgccttgccccgtgtctgctgcagcctccctagagggtggcacgggagggtccccgctggacagtgggccggggagtggtcagctgaccagacatgattgctctagagcagctttgagcctctctgccctgaagccagaccaggcagggcttggcactgcttccttgttgtgtgctcccaagcaggggagggctggtgcagcagcagcctgctcactgccaccttagctatggttgcctccaggtgacatgccctgcagtagtcattgggaccctgtagaatggagtggtgttattaaaacttttaaaaagtatgtgagctatgcatacatttaagaaagattaatataaacaaggtcattctttacccaacttttggtgaatcagcgagtgacagtggtcgtgatgttggtggttcaatcaaggaataaatgtttgcaaagcgaacatcaatgtcctacctcctaccaccacacagttcaaaaaccaacaataaccaatgtggggggctcatatgactaatgccacatcgtttgctgtcatgcatctgtatgattattggatattttatgagtttaattctacaataatttgtatctattctttttctaatctactcattccagttcagggtcacaggtggttggagcctgtcctggcagcttagggcatgaggcagaagccagccctggacaggataccattccaccagaggagcactcacacacacccccacactcacactgggacaatgcagacgtaccattgaagtgaacatgcacatctttattgtgtgaaaggaaaccagagtaccaggagagagcccacgcagacacagggagaacacacagactccacacaggcaggggcccccgctgggagttgtttttttttttttaatcttgtcagcattataatgaaatgaaattgaggatcagttgtacatagaatgagacaatctgtggtcttttgtgactggcttctcctacttactataatgagttcaagtttcatccatatcatagcgtgtatcagcactccattcctttttatggctggataatactccattgtgaatatagacattttgtttatccattcatcagatgatggatgttctcggccttatgaataatgctgctatgaacatttgcagataagtttttgcatgaacatatgtttttaattctcttgggtctatacctaggtgtgaaattgctgagtcatatggtaattctgtgtttaactttttgaggaattgctaaactgttttgcaaagtaactgtacccttttacattcccatcagcagtgtatgagggttctaatttctccacatcctcactaacatatgtctgtcattttggttacagctgtcctagtgaatgtgaggtggtatcttattgtgattttttgggtttgttttgttctgtttttttgagacggaggcttgctctgtcacccaggctggagtgcagtgacatgatctcggctcactgcaacccccgcctcccaggttcaagcaattctcatgcctcagcctcttgagcagctggaattacaggcacacgccacaacacccggctaatttttgtatttgtagtagagacagggtttcaccattttgcccaggttggtctcaaactcctggcctcaagtgatccgcccacctcagcctcccaaagtgctgggattacaggtgtaagccaccacacccggcccttattgtgatttttatttgcattttgctaatcaaagatgatggtgagcatcttctgggggcctttggagaaatgaccaggaggggtttgcactctgtaacaccgagtgagtggaagcggcccacaataagaaaggctgaaggggcgggaagaaatctgagctctgtgatcctccagagcaagcctctgggacagggcccctcaggaggaagaactgcaggaaatgaaatcacagttgagctggatagggacacaggaaaggaaggatgagatgtagaccaatgtggggaagaggaacaaagacaggaactcctgaaagccatctcccacgttttttaacaccacacagaaacaagggagagttctgagcttagactttcctgagcctttcttatcaggaaaactcatctcacctaaaaataacagaaaagtatttgaagtgaaattgcatacagttgttatataagaaacaagaatatgcaaaataacctccctgcggacaatgagagcacattagaaagacatgcccacataaccgagccaagctgtaacctgctatttcaaatcaagccaggtgacattctaacaatacaaaacaagagagaatagtgtaaatcaactttttaaaaatcagaaataaggtgacagaactcaggaaagaattagaattaaaaatcatttcagaagtaaagaaagactaagacgaaatgcaagtgtcgatgaacacagcagatcctgcctgaaaaggataaacagtgtgaaaaaggaaacatttcaagagcaaaaaaatgaagaggtaaaaaggttttgaccaaaagtaaagacaggcagaaaggtcagacatacgaataccaggagtccctggaaaggaaaacagaataccaaaaagtaatccagaaaactttcttaaaattaaaaaacaaagatttgaaacttgagattgagagatcataccccacacttaacaatatcagccgggcgcagtggctcagcctgtaatcccagcactttgggatgctgaggtgggcggatcacctgaagtcaggagtttaagaccagcctgaccaacatggcgaaaccccgtctctactaaaaatacaaaaattagccagacgtggtggcgcacacctgtaatctcagctactcggaaggctgaggcaagagaattgcttgaacccgggagtcagaggttgcagagagccaagatcacgccattataatccagcctgggcgacaaagcaagacttgtctcaaaaaaaaaaaaaaaaaaaaatcaaggccaggcgtgatggctcagcctgtaatcctagcactttgggagatcgaggtgaactcctgtttgaggccaggagttcaagaccaacctggccaacatagtgagaccccgtctctaaaaaaaaaaaaaaaaaaaaaattcaactcagcatcaccaacaaaaagatataattctagtaaaattattagactttaaagaaaattttggggggttctagagaaaaggaaccttgtgacttaaaggggaaagacaattagattattgtcagactcttcaatagtaaggattggtgcagaagaaaaaagaataacatgtttaaaatactccaggaaagaaagtgtgagccaaggatttataaccaggaaaattgactttgaagttcacacaaagacttatacacaaaaggttatagcagctttaatagccaaaaactggaaatagtccacatgtccatcaacaggtaaatgataagttgtgatatatccatactttggaaatactgcgagcaataaaaagaaatgactgcaataaaaagaaatgacttaacaaaataagatgaagaataaatttcaaaataattatgctgagtgaaaaaaagaagaaaaaggacacactgtgattccactgctgtaatatctaggaaatgcagctgagcaggcccatggtcaccacgattgggggctgcaggatggggagatggattaccaggggatccgaggaaacttttgggaatgatgggcatgttccttatcttgattgaggtgatgtgatgatcctacaggatatatttttgtcaaaattcaccaaatcatgcacttgatatgcagtttatgtcaattatactatatcaaagctgtttttaaaattagcttttgagtgtaaaggatatgaactattatcaatatgcaagaattcagggactattgtttctaggagcccttcctgagaaatctactagaggatacaagtcacacaactaaaatgactacaaagacttcagcataaatatatagttacttgtagagaactaagacgaaatgagggttaaaaggctgggcccagggcaggcacagtggctcacacctgtaatcccagcactttgggaggctgaggcaggcggatcacctgagctcaggagttcaagaccagcctggccaacatggcaaagccccatgatgtggtttggctgtgtccccacccaaatctcattttgaatgcccatgtgttgtagggggtaaccagtgggagttgagtcatgggaggaggtcttttccatgctgttctcttgatagtgaataagtctcacaagatctgatggttttatgaaggggagttcacctgcacaggctctctctccctttttgctgccatccatgtgagatgtcacttgctcctcccttgccttctgccatgattgtgaggcctccccagctacatggagctgtaagtccattaaacctctcttttttttgtaaactgcccagtctcaggtatgtctttatcagcagcgtgaaaatggactaacacaccccgacgctactaaaaatacaaaaattagccaggcgtggtggcacacacctgcagtcccagctacacgggaggctgaggcaggagaatcacttgaacctgggaggtggaggttgcagtgagtcaaaatcgcgcctctgcactccatcctgggcaacagagccagactctgtctcaaaaaaaaaaaaaggcagtggctcacacctataatcccagtactttgggagtctgaggtgggaggatcacttgagcctacgaagtttgaggctgcagtgaaccatgatcttaccagcctgcactctagcctgggtgacagtgagaccctgtctcaatttttaaaaaaaaaaattgttaataataaataaagaggagaatcagtcatctttggaaagtgatagaaccagttcagaaagaatcaagcgtttatccagcctttcctttttgaccttgtattagtctgttttctcgctgctggcaaagacatacccaagactgagcaatttacaaaggaaagaggatggagaactcacagttccacgtagctggggaaacctcacagtcatggcagaaggcaaggaggaacaagtcacagcttacgtggatggcagcaggcaaaagagagagcttgtgcagaaaaactcccatttttaaaatcgtcagatctagcgagacttattcactatcatgagaacagcatgggaaagacttgcccctgtgatacaattacctcctaccaggtccctcccacaacacgtgggaattcaagatgagatttgagtagggacacagccaaaccatatcagacctctatccctgggtaactgaatagttaatgagaagaagtgtccctatctggagcattccatggaataaatgacaaagaaaggatggaattagagtatcaccattttacaagccccagtgaattaagagaggcctgagttattgacagctgttaatataagagacaatctaacgtgcctcctgatgagagaacgcaccagctctagtcttgccaaagggatcacacctgagtctgtccagtcttggctccagctgacagttttcaggaattcagaggaacatattgaactgcatatgaagcagcaaaacccagaccgagagactaggctctcttcagcagaaaaattgtaaggaaaaaaatcagaggaggaatctgcaaagtaggagatgtaaaaaacatccaaaaaaatgtttaatggacaagactaaactatagtatctaggggtgcacatttgggtgataaaatggggggaaaatgggttagaagttagggcagtggttacttatagtggaagagggagctgtgattaggaagggcataatgacagggcttttcaggcaggtggcagaatttttgtttcttgatctattactttataataaaagatttttcttaaaaaaaagctccaatgtaccattctttcatgtgtttagaaaatgtcctgtttcttaaacttgtgggagttcttaatttctacttttagcgcacactgcagaaaaatgcacacactgttgggatccttgagggagaattctgagcagtggaccccatgatgagtgcttcatgtcagccttcacacacactccagtcctgagaagcggaggggagagggacagcaggcttgggtctgcagaagcagtgttctcttgcaaggcagagtcaccatgtgtcccatctttacagattggctgcaatgccgtcagctgggcccctgctgttgtacctggaagcctcatagaccacccatcggggcagaaacccaattacatcaagaggtttgcatcaggtggctgtgacaacctcatcaagctgtggaagtaagtagggatgtgtggccttctctttgaggggacacttctaccctttaccctactcaccatgactcagccacactcacaagaaacaaggtcacctttctttctccctcctgccagtaaaatactgttttcaatctgttggaggacatccttgaaaaacaacacaacacctgttcacctaattcccaactgttggagctgactctttggctgtggaagcagagcattttctggagggttttttttacagctggggtgaagggaataaaatgccacaaactccatgaatgaaagaagaaagatggaatcgcttctccaccccaggcagagcctgttgggttggggaggagttgaggtgtgggaacggccccctgctgattctctttctgtccccactgttagggaggaggaggacggccagtggaaggaggagcagaagctagaagcgcacagtgactgggttcgagatgtggcctgggccccctccatcggcctgcccaccagcaccatcgccagctgctcccaggtcagcccagggccatgagtatcccttgtcatttagtctcgagtcaggcccatcagctcttagtctccttagcagaaagtcctctgggaaggtaaagggagagcaacaggcacctttggcccagagcacagggagtcaggtcattgtgtggggaagtcttggtcagaagccacaagtggcctgcctccactgagatgagacagctacaacagaaccggcaccaagaaggaggcggattcgggatgaattttcccttctgacccatgtgagactagggcgccgaggtgcccaggtgcagttccaagtgttcccaagcaacgatggggttggatgggaattatacgcttagctaccaagccacccttcccagacagcaaggacggccaagggtgagccttcagttatacaccaccaccctagagggagccagctaggcctttcacatcatgggaacctgtttggtttggttctaaacttgggatttttgtgcttttttacttgtgccttctcattcttggagcttggtttttggagagctctgcccattcagttgagaaggtatagacggccagtggaagtgacttggcaggcatgaggaaaaccccagagaaaatctgagttagcaatgcagacagagtccacctccgaaacccggatgagaaaaggaatccgggagactcttaaccagtgtgaagagacagaaacaaagctgtggacgccccagaggtcctcggctcccctttgaatcccccaccctgttcctgcagagaggtgccgggtggctctagactgggaggacatcacatcacaaacgcaggagtcttgactccacctcctgactctatcctgtttcttcctaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtacatacccattccccgtggcatggtggacacagcctgttggtcttcaccccgcccactagagagggcacttgacattcccatctgactgcaggctgggcaggagccttagccaggactgcgttttgagtgtgcctcttagttacatcattaatgtcacagcccctgaggtagtattaacacgtccccctttcacagatgaggaaagaagctgacagaggcgatttgacttgcatgggggtcccaaaactatgaggtggcagagccagtcaggcccatcaccctactaagcatttggtcacctcatggtgatgttcagttagctgtgccaaaaaggcaagtgtataagaacccataaacagaagaagattggggatattttttgtccataacactgaaaaggctttttaaaaacctttagagtttatgaatacttgttatgctggtaagaggcaggtacacagtgggtgcactggaagagtttgcattttgcagctgaaagagttctggagaccagctgctcagggacacaaatgtacttcacacaactggactgtgcagttaaaagtggccaaggtcattttatgtgacgtgtattttacaattagaaggaaaaaagctacccgcagaaaggaagcagtaacaagccatagccatctgcccagctgaattcccctataagacagaggatctctaacgccgcagggtcagttccacgtggagtggctgtgctgcgttttcaggcacatctgctctgcgcctgaagtgcgagttggtctggatcctgccagcccttgctgcttctctcccttgcctatgttggtcttttactgtttcccagtggccactttggctccatgtcttacctttcatttgtgtggctcacggcacaaccaacacaggcaaggcagagaagcagctggtctccagaactcttttcagctgcaaaattgaaactctgtacccattaaataactcccttccccattgcccctccccagccctggcagccacccttctcctttctgtctatgtgaatgtgactgctctagcgacctatctaagtggaatcatacagtatttgtccttttgcgactatgtcactagcagtatgcccttaaggttcctccatgctgtacgtagcatgtgtcagaattccttcctttgtaaagctaagtagtgttgcattgtatagacagcccacaccctgtttctacacttattcctccaccaaagggcacctgggctgctgccacctcttagctattgcgaatagtgtggctgtgaacatgggtgtgcagatcttgagagcctctgcaggcggcttttctggccgagggtccctttcatctacagtggtcccagaaagatctagcaggccccctctcaaagccatatttctagtgagtgccagagtcaggaccagaacccaggttgatggcactcagggcagaccaagggacccagattgcctcaagcaggcccccagtgacttttttacaaggctgtaagcaagtgcctggctgtgcacgcagtgttgtggggcccgtcactgtgcatttaggcttcttgctcttctttacaagcctgtttcctttcgctgtctccatagcacccttacctaaaggacttagtatgttttcaatcccagagcattctgcagtgtgttgagtgaatagtttgtccctaaagcaagagttcttaaaatcaaaatcgttattttcatttttaatcaaactaatatatgtacataggtttagattgtttttgttttttgttttgttttttgagatcgagtctcgctctgtcgtccaggctggagtgcagtggcgcagtctcggctcactgcaacctccgcctcctgggttcaagcgattctcctgcctcagcctccccagtagctgggagattacaggtggctgctagtttttttgtgtgtatttttagtagagatgagatggggtttcaccagttcaggctggtcgcgaactcctggcctcaggtgatccacccatctcagcctcccaaagtgctgagattacaggcgtgagccaccatgcccgacctagactgattttttttaatgcagcctcctaattttctctccaggggcaaaccttttcagctcttagctatttcttatacagtttacttcagtgtagaaacaacatattgaactgttaccttcctctaccacagtagttttcaaactgcagtgttgttaaacctgttaaaacagattgccagccccacccccagagcttcctaatcagttgttccaggccccaagaatctgcagttgtagcaagctcccaggtgaccgatgctctgctctggtctggggaccacactttgcgaaccctgctccccgccaccccatatcctctcgctgtagctctgtcacagtttgctgaaaacagtatcctgtgttgacatcatcatccacagctgctgttattgttactcctttttttctgtgagtttttattcctggactctcattttggtgagatttcagtggaggagggacatgctctgttcacccacaagcctctgggcagtggttcttgatgaggatgaggctcatatttaggggacagcagagggaagggcacagacccgtgataatctgcttgtgcactgactcgcaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccagacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataattcctgctgcgttatcctaaccaccccaccccaccagctcagtttgactcttgtcggtccacgcactagaacaaactattcacaaaggccacggctgtgatggcctggcttaaccccacgcacaaaggtggcttgtcactgcatgagcatctctgattcagtttatactgaaagcaccatacagagcactggactcagcctttggtgacaaggactgtagccctgggtctgctacttaccctctcggtacacatcctgttctgcagaatgggactaatacagtctgccctacaggatggctgcaagattcaaacacgctagtgcatctggtgacctacaaaatgccacgcaggtgcaacgtggtattaaccaaacaccaatagttaagatgctggcccagaaagtgggcacgattcatttagtttattgaccctgtcaggaaaaggagggccccatgatgggagacctaactgaccctgaaccaggtatcacctttcagcggaggccctgtgaccctgacaatcgccatagccatcagtgagcctgcggtgagccagaccctacactggatctttcacacattcgctaatttaagcaacacgagaaccccgtgtgggtgtacccagttcactgatgaggaagcgctcagaaggtagaagccctgcccaggactgtgcaaacgtaaagccagcgtcagggcctggcccatctcaacagttactccccactgtagaatcagggtgggagctggggggctctcctcagctgtaatacaaggatgtttctcacaccaaacctttgtatgaatagattcagataaaaggtcagcccacttgcctcaggccccctagtctgcctacttcttgtccttccctcctttttcagcagcaaaatcccctttaaaaaaaaaaaaaaatctttgatcatactatgtaacatagaagaaagtgaaactgctttggttaaaggtgaggacagagaggccatggcctggcccagtcagcctccagtcagtccacaaagcccaagccttctgagaccaacatgaaaacagctgcttccttccttcccttactcagaaaagcaaagcccaggaaggcaccttcacgtgcactactgagtgtcgagttctacagtgaatccttgaaccatatccacgtctgcctccctgatacgctctgtgctcctcaagcctgggcctgggcttcctatggtgccagctgctgtcgccaagaaaataccgagaaggaactagtcccgtgtcactctgggttggtggtaggttaatgggtccctgactgtgtgctctattttaactcccaccaccaaggattggttaagataattatgaagttggcaccataatagttgtttatacttagagtggcaacacattaaccattcctgggtaagaggagaccccaaaatttattaccacaaaatagcctagtcaaatagaaatactatctgtaaaacttgccgggcagttgtcaagcccaaatgagataaaagtaagggaaatttaaaaggcatagagctctggttagggccagatggcgctagcagccatatgtttttaatccttttgcaaaaacaaagcaactgggacagcaaaagaaacccacagaccctagaacatggagcaggccaaagccttcatagacacaatacctctgagagatcagcagggtgaagaaaagggagtttttatggtgctataagccagagaccccaaaaattgccatcaaatactcatccattctgagtgcaaaactcagcaagccactgtgaaaacaactcccaaaactagaagattcacaggcttccatttacaagtgagcccagaaacactaaggggagaccttccacttctgcatataaaggattaacgattgtaagaatttcccagccaacatggtggctcacaactgtaatcccacacttcgaaaggccaagacgggcggaatgtttgagcccagaaattcaagaccagcctgcca

SEQ ID NO: 14676 - DNA, 13335 bp, Human
ggttcaaagtaaaagctcattggttgatgttttacactgatgtgataatgtttacacagatgtgtttgaaaccttgattatggtggatttggggtcctaccacaagacagactgctgttatttgaaaggtgaaataatacaacatttacctggtgcaacctttaaaacagacttagcaatatacgtttctaaagtgatttatctgtttattgtttttagccagcgtttttgttttatttcatatctatcaacagtaaatcacttgctttaagaactcttttataacttggttacacaagggtcagtagttaggcctgtagtgatgaaaatgtgtaactatacccactttagagcacctgccaattaattagaaaaaatccttcagagcaaataaaataaaccagtcaaatccaactgagctgccaggcttatgctttttttaaacagatcatgaaacaagactgagaaagtaatcttcatcagttccctaagactttttgctcagaggaagcataaatctgcccaatgattctcaattcttctaccactgaaaaattttaacagaaagatcttgaatttaactagtggtgcaaaaccagtttcaacgtttaaatgaacatgtatctaattccttggcttccatggtttttgattttacaaatatgctcaagcactcttcaattttaccagtaacttttgaagtctcaaaacacatcaagcctcaagactatttccatttagttatttttagattttataattaaaatgtaaacaaaaacatctagcttttagaaaaacgcaactaagaaaaacaggaaagtgctcttagattgtataagggcccaagaagccactcatcatttatgacaatattccagatattcattttctattcacggcaaaatatagagatgtaaatcatttctttccagcctatttggatttactgtaaatcctttgattcgtgattatattttgctttattttacactaattagaagttcatgaccttagcacacaattaaaaatacatatgtgtattatgtatatatatatatggcaattttggttatattatgtgctgagtaaaggtaaacattaaagagaaattgtaaagagggggagggagggtgttccttacctaaccttgattatgtaaagaaaatcccccatctaaatgataaaagaaaggagcaatgcttgtacattttattagtgttttaaaattagtgagttaaactgtcaaagctttgatttttctttcatgtgtgtctgggcaggtctgtaagccccaggtaacgccctttttccttctcccttgcttacctttctttgcacctgtccactgcaggctcccaaggagtccaattctccttttctctttcctcctcctaccaatgccctccttctctttctctccctccccgccttccctccctcctcccttcctcttcttctatatccctgccaagttgggctccttttagaggcgatttatcactgcaaagctcacatcaaagacggttgcacggccgcagctgaacagcatcaccgctgtcccaaggacaaccccaaagaggggcctcgactgcacctcctcgaagttgctggctggctttggccaagtgcaggaatggtttttgtgagggcatggatggagaagtgccaagggccccttttggtcacttccgaagagcaaaaacgtgttgagaggagaccggtttaagatttcaaacagaacctccccagcgcgcatgaaaggacttgattagcatatgtcaagaggacccgcttatatactcggtgtgtatgtacacaggactctgatctgatcagtttgcggaattggagccccagccaacagccctagtcctagtattggcagcggcagctatagatatttctgcagagccagcagccggctcccacctacccaaggagagaagatcgctccaagacagtgagagcttccctgccatttcagtgcaaagtccctccggagcgacctcagaggagtaaccgggccttaactttttgcgctcgttttgctataatttttctctatccacctccatcccacccccacaacactctttactgggggggtcttttgtgttccggatctccccctccatggctcccttagccgaagtcgggggctttctgggcggcctggagggcttgggccagcaggtgggttcgcatttcctgttgcctcctgccggggagcggccgccgctgctgggcgagcgcaggagcgcggcggagcggagcgcccgcggcgggccgggggctgcgcagctggcgcacctgcacggcatcctgcgccgccggcagctctattgccgcaccggcttccacctgcagatcctgcccgacggcagcgtgcagggcacccggcaggaccacagcctcttcggtacgtactagcatcccgaccccacccccatctgcgccccagctcggctcctcgttccctccccttgcacctccctctttgcctgccaagggcgtcatcgccgcgcggagcccggagctcccctggacccatccggtgcaagacgcaggctggggctgaagggctggccagagcagccgcggggagaaattttcctgctggtttgtcgccgcagcctctagcagggcagcagctccagatgctgggggcgggaggagaaagggtgggcgcttcgcaagctccttcctgccttccccttgcccttcccactgccggggacaccaagacctggtgcactcggcatcacggttctcgcactgcttacctcgcaggcagttttaaaaaaaatccttgtatgtttctctccgatttcctttctcattttcccccatgccgtccactttacaaaaattaataacaggaagcgccgggcttctttaaacatgccccacagttatgcagctgattatgcacccggggctgctctgggcatggattgcgagcatttacgtgtctacctagagacctgcaaatgttcacctgaagaggtagcagattaactttccgtgggcacattcgctacctgtagggctcacctgtctgaggttccctcagctcctaagttctatgtgggtgagaaaagaaaaggaaagggggggaggggtgggggaggaggaagaccacccggctactgagcatgcctagttcttcagccaagctcctctttggaaattgtgcaacctgaaagcaagtatcttggtatcgactttaggaaagaggaaatgggaaagcgaaagaagatatgggtgggaacacagacggacgtgtttcagaatacctccggcagtgcctgggaagagaaggggttaaaagaaacaagagaatgattgttaaggcagtgtctgttaagatactagatcgggagggtctctcctgttaatgacttcctcactagctgtgtaactagaaagtgccttcatcagtctgaggcttagttttctgtacaaagatggggtgctctccggttctaatatcccaggatctttccccatagctgaagtttccattctattagttaacctgctagcaatgtcaaaggattttgattatcaaacttttgacatcattggaaaaattcattttatttttaaaaaagataccattaatttgtcacccacaatccgtagcgctacggagttctttgagaatgcaccccatctctgaatggcctctcttatcgtgtccttacccccttgttcttataattattccctttttgacttgtaggactcattaaaactttggagaagtgtaaatctcagtttaagggggcatttgtaactctagatgtagaaataagcatgtggtggtcatttggtagcacttaaaggcttagaaaattaactttttaaaacccacatgtttgcagcttccactgatctcttccaaattcccattgactatcagtcaagactgtcatgacctagtggccaacctggggtcacttttagaaagtggtttttaaattgaggaggcttgagattttctaacttctggcctccggcaatctttccgccttggcctcccaaagtactgggattacaggcatgagccactgtgcatggccctgagacttcgattctgaagaactttgctgacaccaggtggctcagttctcttgcctttaaggatgacttcactgcgctcattacagaaaaatattccaactaccagaaagatttagaaataaacacaaatgtgataatacttatagggagagcaggcagaagttaagcttaggtaatagtcagaatttcaccctgccatacacagtgtagccttggaaattctacttttaagaaacttggggctgggcgcagtggctcacgcctgtaatcccagcgctttgggaggccgaggcgggtggatcatgaggtcaggagttcaagaccagcctggccaagatagtgaaacccctctctactaaaaatacaaaaaatacaaaaaaaaaaaaaaaattagctgggcgtgttggtgggcacctgtaatcccagctacttgggaggctgaggcagagaattgcttgaacccgggaggcgcaggttgcagtgagccaagatcacaccactgcactccagccttggcgacagaccaagagtctgtctcaaaaaaaaaaaaaaaaaaaaaaggaaacttgtaattaaactgtaatctctccagtgacagaaaaaaaaaggcctcttttactttgtgtatgtttataagactgaccctatggggagagattagtaaatatttgtagacttgataacattcattaatggcatttaacggcatttctttaggaatggaagttgaatatcagaattatcatcttgctcgcacattttgtttttgcgaaatttgtgttaattatttagtagctgcaaaaaaattgacagattgaatttgtgccaatgtaagtcactctatggtgggagactatgtataggaacaaaatactgttaaacaaaaggaagataacccagattagtctgggagtgaatggccgccttgtgatgtattgtagtacatcctagcggccttcaatatcatagacatcataacttactttaagagagtgcgggtaagaagaaagtttatgttcaagctatataacattatgtgcttctgtatgtttggcttcttttgctagtacttcagttactaattattaaattattatgttttttaaactcctatctttgctatcagagtgacagttttgaaaacttaaggatggctatttgagatgttaaaggaaataacttttttttttttgccagttttatactaatttggccatgagttatctctgtatttatgatggagttttcctacacagtagtacacagcaggaacagcttacctaatatgtaaacatggaatcatttctgaaaaaaaaaaagtttagcctgagatcaaacatatttctttaaaggcttttcctttattctcccctattctccatagatttgtctgatgtggttgcattgtgggttgactcacctgtttattatgattattaaaaagactggctttgaaggtgataccagaaaggcaaagtacctccaagtctttttatgggacactgggcattagaaaatctatctaaaatctgtgattacctcttaaggaaagtttttcatgtctactctttgtaaaggaattagcttagttgctacctcatattataaataagaaagacttgtcaaatctcatttaagaatcaaatgattacaaattactacgtggtatactatttcctcaaggagaaaaaggatcagaatttaaaagtgtgactaaaatctttaagaggaacacacacacaaaacacatatcagtcccatgagccattgcaaaattatttatacctggttatgtataaggttttgggtgttgtttactaaagttaaaactattgcatataattattctaagaacataaataaccttttgtctttctacagctacatattttttcggcaagctgacagcattaagataagaattaaagtgtaggtggtttacctctgagttttccaagaaaaatgaacactttatgagatttgttatataattagcttatatggacattaaagccatattttattgtaattgaaaacttgctctattctacattctaatcacttaatcagttcctgttctttgaaagagaatcttaatgtaaatcagatacttaaagggaattaagttgcatttcaaccacagaacactttttaatttgaatgtaacattcaatacaaagtaattatacatttgtaattatatcctgaatgaagttacattaatatatatattttctaccaattatgttttgggcctatgtttttgtttccggcaggactcttttgctaatgaacttggcagtgagtttgattttccttcactccccacctctgtatttgtcattatgatggctgtcctaagccttcttgctgtatcttatcttctctctgccttaggctttcaatgagggatcctggctctttcaagccacttatagactatttagcagtgtattgttgctgtaagatccttgatagctctagtgttctacatgatctcctaatagtttgaaagagctcatttgtcttgctaagaatctctgtttctgacaaagagtgaattaggctttggatagaatagagcccagcatatcagcaaatagtcagattctgtactttcccttggccttgggagtatcacgtgtccaaacaggaacttgtacaataaatcaagaaatgacttaagagcaagagtcaggctaaatggtacacatttatactgtttgtagagctcaggatggggtgaaggggtgaaggtagaatgctattgaggaaggcagtgccaagcatagaaaatacagctatgctttttcagcagagttgaagagggaagaatgagacaaaggcattagtccaaagtttagtgtgtgcagaaaaaaaagggtgatccagagggaggtgttaagtttttcttttttaaactgtggtttatcagtgtatttagggaagagtttttgatcccagtttactgataaatggaaataattctagaaagttattgatagtaaatctacttgcatgctaattcattatatttggctatcatatttaatgaattataaagtcctttttcttctctgaactatacaatttaattttaaaaattacacagcaggaaacatagcatgttatataatccaaaaagtcttgaaactactgtattgtcctcaagaaacagtgtcctgaagtagaaacagtggattagggctaagaatgtaagtttaaatgtcagttctaccatttataaatatcatgtcccttaggcaagtcaataagcctttctgagcctccatttctttatatgtaaaatggggataataatatcttccctatttattttaagggcttgttttttagggccagataagaaaatacaaacaaatgccctttattgactataaaacactgttatacccaataagggatgctgctgctcctagaaacagattgacttgatttatcgtagataaaaacaaaacaatgaatagaaaatggttataattaactgatgagatcatggaaaactgagaatacctctgttatatactaatttatgataataatagcttccgtttgttgaatgcctaaatgtgttagtcctcacccatctcctttagggaggcatttcatccattttgcatatgaggaggttaaagttcaaagaagacaaatgacttgcctgctctacctggttagtaagttcctgaactggaattcagacccagctcagtctggtgtaaggtttcacacccttcacattataccattgtcgtagtactttctccttagttcagttaaaagcagaggtccttgtcacatgaccaggaaagactaggctcatggacacatagaagggtgagaaaaatggaatttattggccaaaaaggaaaaaaaaacaactaagcaaagcaagagaggttcgaggttcctgttaacaggcccccatctcacagattgaatcccaggctaccaccccattacaggagaggccaggctcctccccgctgcaaagggtgtcaacttcccaaggctccatcctgttgtcccagcacgcaggccggtcagaggttctctgggaacccctttatacttgattgtctcaccatggtgaacaattttttccttttttgtccttttttcatctgtcataaaacaattgcatagctgtttccagtgtacaaaggacttttacacgtacatcattatatttggcaataatggccgactaccgctactatttggaagatttttgttagtcatatgctcatgcataaatacaaaacatggtgtttttatgaattgtttacatatgcaggtatcttggaattcatcagtgtggcagtgggactggtcagtattagaggtgtggacagtggtctctatcttggaatgaatgacaaaggagaactctatggatcagtacgtattatttttattttttattattattgtaattcttaaaatattgactatctattatgtaattaaaatgtctaccaagaatgtctggtagaagtatataaaacatacttacgtagaaattgaaatctatcctgctaaatttccatgtgtctgggcaatagtatagtaactcaattatatttttaaaacccccaaccattattaccttcagctcattagttcttcctatacattaccttgagtctttctagttttctctgtattttaatcattccatccagagacagagataaaagggagaatatttttttcttgccatgttagactctctcacctttatgtttatttaaggtaaactttctctacctgttatcatcttccacagctaaatatacgtcacttacttgctgacctttgtatttaagaaataagtgagtaaagttgtgggatactgcaagtaacaggagaagatggcaaacacactgttcttctatgcctgtagtcttgaaaatttcagtagccatgggctcattcaaagttgtatcgggcaatttttaagttgctcctggggataagtgcacgtctgtgggtctactataaatgtttaaatatgccacttaagttatacttttcaggtcaatatttcatcagtttaagtttttttttgtttttagaacaaatctgcaatagcaacacaagaattacaatagcaggacaatatcacactctaccttacagcacaacatggatttttctctttcattgttaacattttttcatttgttcacagttgcttaaatgcttttataagaattggtaagataaaaatgtgtgccagtatcccactcctcttcttatgtgaactcttttcttgaggttgaagtctctgtaattatttccatcaagaattgactttgtatgattaagcagatggcactctctggtaacttttttttcttaaactctcaactggaaccacaatattcagctagagtcttaatatacactgagaagaattggtgatgatattgaagtagatgaatatttgtcctttgtaagggtaaaacttgttatttctaggcttcgtgtcagctcagaacaaagaaagacaatgcaatgtataataatcataagtatggaattacaataaaattaatagaattacaatagaaaaaaacatgcacacaatcttcatgtgtattttggatttaaaaaaagcaactgtggtttatcacttaggacaatatacagtccattttgaaaagacaataaatcttaatcgtaaaagatccagataaaaaatcgtgaagaatgtatcatcaaacaattagtaaattcataaagagaagatatatgatttggagtgatgatcatgaatttggaatttggttcttagcaagatcttgaaatgctccaaggtgagagtagagacttgataggtagaactctggcatctaatgatggaaaaagataaactacaggtctgcttggtagtgatggcgggagtagggtgatgatatgggacatgagaaaattcaggatattttttaggtatttgaaaataaaattgggaactgacatttgactgaaagttctttaaagcaggggtccccaacccctgggccatgggctggtattggtctgtggcccgttaaaaactgggctgcacagcaggaggtgagcagcaggcaagtgagcgaaacttcatctgaatttacatgctgctctccattgctcacattcccacctaagctccgcctcctgtcagatcagcggcagcattaaattctcataggagcatgaaccctattgtgaactgtgcatgcgagggatctgggttgcatgcttcttatgagaatctaatgcctgatgatgtgtcactgcatccgttcacccccagatgggacagtctagttgcaagaaaacaagctcagggctcccactgattctatattatgatgagttgtataattatttcattatatattacaatgtaataataatgggaatgaagtacacaataaatgtaatgcacttgaatcaccctgaaaccatcccgtctccccatcctggtccgtggaaaattgtcttccatgaaactggtcactggtgccaaagaagtggggactgcaactttaaagtacactgccagatgaagtcacctgcactaagaatcagagatgacatatgaactaaaacaaaataaagcaaaaccaatttaacctttttctttctttgacaaggcaaagaaatgaaaatatagagttgaaacttgtaaggaaattatctcaaaggtatttttttaaaaaataatagttatcttctctctttcaggagaaacttacttccgaatgcatctttagggagcagtttgaagagaactggtataacacctattcatctaacatatataaacatggagacactggccgcaggtattttgtggcacttaacaaagacggaactccaagagatggcgccaggtccaagaggcatcagaaatttacacatttcttacctagaccagtggatccagaaagagttccagaattgtacaaggacctactgatgtacacttgaagtgcgatagtgacattatggaagagtcaaaccacaaccattctttcttgtcatagttcccatcataaaataatgacccaagcagacgttcaaaatattaaagtctattttctactgagagactggatttggaaagaatattgagaaaaaaaaccaaaaaaaatcttgactagaaatagatcatgatcactctttatatgtggattaagttcccttagatacattggattagtccttaccagtagactgaagccaaaaatctgttaaactgtggataatgggaaccctcacatggttgctgctggtgcctcacctctctggattatgtttactttaaaatttatgttaaaaatagagacttcatgttgaagaaatggattgacttagccaagagcattgctacataaattctgaggaccttgtagaattcacaggttatggcattataagttttaagaaaaaaaaaaactaaacaacacctgggtgaaacatgaactatgaaacatgccacaccaagacagaacactttttaaaagaatggacctatttatacactttcaatttgaaaatatttattatatatatttatttattaaagagtttattttttactgggatatgaagataatacaaagagtaaaaaacaacaaaacttccgttattgtgccattactttattgtggtgtcttgctctgtaaagaggacattattataccaccttaaccatagaatcagattttgaatttctttttaaaatatagtatagattatattttttatgcagtcaattgccttctaaatgtaacgttggtttcttttggcctagaaaaatgcctcattgatttgtattaaattcaacacacattcaaaagggaattaaacattttcatgtagtgttttggcttcattgcttttcgggtgacagttcttttatttatataacatttaaaaatgacaaaattctaaatgccctagagaaagactttagtatttaaagaacttctaatgttgaaaagtattgaacattacagccaacttatgtttacttattttcttaattcagtgtggcaaagaccatttctttcacccaatatgattgtaggaagaataagtctttgtaccacctccattaacaatggtaagtccccatctacctgagtcgggtattcttttcattatatctcttatttagccatttattcagcaaacatttttttttaattttcttttttaattaaatttttattgtggagatggagtcttgctatgttgcccaggcttgtctcaaactcctggcctcaaatgatgttcccacctcagcctcccaaagtattgggattacaggcataagccaccatgcctggcacagcacaggttcattaaaggctactatacagtagtatagtatagtgtcaggcactaggggaaaatggggtggtccagatagaggtgggccctacatcatggagcttaatggctggtgggaaagacagatagtaaacaagtaaattaacaaataccataattatgagtggtgagttattctatgaggaaaacaaggttcagacagaaaaaaaaagaaagaataaatgtaggatggctcagagaaagcttttctagggagattagatttctgatgggccctaaaggttaagaaggggctacccaggtaaagagaaggatgagaaccttctagggggaggaaacaatgagtctggggttcctaaggcaggaaatagctttgtggctggagcttagtgagctatggggagagtggcacagatgagtttagaaagctaagcagatacaaattctgatagatttgtaaaagttcttctaaggttttatttcctagtgcccaacagttgtcaatgctgctgccctcatggttgggcatgtagtaatgatagtggaccagatgccactctttaccaacctggagagctgggtaagacaaggattgctggcctctacccccagagtttctgatgtgtagttctggggtggggtctaaaaatgtgcatctagtttcacctagtttcctaggtaatgttgaccacactttgagagccactagtctggaacagtgtttctaacatttaatgtacatatgaatcacatggggattcttattagaggatgatctgggattttgcctttctacaacatcccagtgatgctcgatgttcctagatcttgaagcacactttgaatgacaagactattgctttaatgctatcttatttc

SEQ ID NO: 14677 - DNA, 5826 bp, Human
cagcctcaaattcctggcctcaagtgatccttccatctcagccttccaagcagaatgcatcctgagcctttttgtctcttttagtctttaaagtaatacccctcttatttctgtacttactgaaatctgctttccagaggtccaggattgaagtctgactctgcctggtgttcttttccttagtgatttatgcactttaagatggtatagattctttctcctaaaattctcatgactttcgttttcctgatactgtgtttctttctttttaaaaaatttttattagggacggggtctaactgtgttgcttaggctggtcttgaactcctgggttcaagcgatcttcccacctcggcttcccaaagtgttaggattacatgcatgagctactgtacctagcctcttttggatgacttaagtgcacagtagagagtcccttcattacttcctcaaccttatttttctttatttaagaaaaaaagtacagtagaatatatttatcatgggaaaatgaaaaagtacagaaaaccaaggtgcaaaataagtttaagtcaaacaaaactcaaccgctaggagataatggcttaagactttttcctatttgattatattcatatatagaaatatatacacatttaaacaaaaatagaatttactctgttttcattctccttgttatatccagttagtcattagctctactgagtcttggttgatgcctgtggggccgtgcctattgtactatgtaaaagcgtaaattcaagtaaagaattgacccatgaggccagggatggtggctcacgcctgtaatcccaacactttgggagactgaggcaggtggatcacctgaggtcaggagtttgagaacagcctgaccaacatggtgaaaccctgtctctactaaaaatacaaaaattagctgggcatggtggtacatgcctgtaatcctagctactcaggaggctgagacaggagaatcacttgaacctgggaggtggaggttgcaatgagccaggatcgtgccattgcactccagcctgggcaacaagagtgaaactccttctcaaaaaaaaaaaaaaagaattgacccatgtgctgtatatgctgcctggggacaacggcctttgtggtgaaggctgagcataaaacacccaagacttggcagtggagcaggtgtgtcctccttgtcagaaatcttggctgagcgatacttccctcccagttttggcatctgtctacagcaggagtgaacaggaggcttgagtttgagctagaggattagctggggagctcccccctgcccaccatagaggagttccagtttagctatggagagccagcagtgcccagcagagagggcatagctgagttacagaagagagtcctggtataatcttggttatttttgtgttatctcagactctgtggtggctggagggggcagtccaacgacagcaggaccagctgtcctcacagcctcagatggctgagtctgaggagaggagaggagaaagtaatctactgaaatagatgtaaggctatcaacccagggtgggtaagtctggggaaaagtcattaacttcccttggagaagcagcaacaaatagaggcaaaaagaaaatctggctgggtgcaatggcttatgtctgtaatcccagcactttgggaagccaaggcgggtggatcacctgaagacaggaattcgagatcagtctggacaacattgtgaaacctctgtctctactaaaaatacaaaaattagctgggcatggtggcagcgcctgtaatcccagctactcagaaggctgaggcaggagaattgcttgaacttggaagggggaggttgccgtgagcctagatcatgccactacactccagcctgggcaacaagagcaaaaattccgtctcaaaaaaaaaaaaatagaaaaaaagaaaatctgaggcaagtgggcttgcgttctttttgggcattttatacattactccatctcttttcttccaacagatccacagaccagcatggctgccactgctgctgtgagtcccagtgactacctgcagcctgccgcctccaccacccaggcgagtaggcagtgggctccgagggcttggggctgcagcatcctggacagactcaccgaaaacactctctcttcactgtctcactataaataccctaggttatgagactggggaaggttcagttagccacattttctttactgagaaactatggccatttacctaaggtgccgcagttgggccagggggaaaaacaaggattaaactctgtgttccttccaccagacctcactaaaaaaggaaaaggaaaacagaggctttctcattgtctcgaaagtgtagccctccccagtctataaagttacatgttccgagtactaaaaagcactttactgaagtatttattcctcctgttgcccctccattttttcctccctcctttcctcagttgagcaatcagggacccctcagtccctggggtgggctaacaaactccatctgagagccaaacatgcttcactgtccttagaaacaaggccagcggagagtaggaagtcagctcgtgctgttagtttaccctgtctgtggggtgctgccaggggttccttcctgagaaagacattgcccaccttttctccctcacttaatggagaaaccagtagagaaggggagacagcagccaagcaggggagggtactggcaacatgcctgccccggaggtggggaagactggcgtggaatgccgccaggaggagaggatcatggacagaggcggccgggcagcgggccttcctgtctcactccttttctctgctgtttttttgcaggactcccagccatctcccttagccctgcttgctgcaacatgtagcaaaattggccctccagcagttgaagctgctgtgacacctcctgctcccccacagcccacaccgcggaaacttgtccctatcaaacctgcccctctccctctcagccccggcaagaatagctttggaatcttgtcctccaaaggaaatatacttcagattcaggggtcacaactgagcgcctcctatcctggagggcagctggtgttcgctatccagaatcccaccatgatcaacaaagggacccgatcaaatgccaatatccagtaccaggcggtccctcagattcaggcaagcaattcccaaaccatccaagtacagcccaatctcaccaaccagatccagatcatccctggcaccaaccaagccatcatcaccccctcaccgtccagtcacaagcctgtccccatcaagccagcccccatccagaagtcgagtacgaccaccacccccgtgcagagcggggccaatgtggtgaagctgacaggtgggggcggcaatgtgacgctcactctgcccgtcaacaaccttgtgaacgccagtgacaccggggcccctactcagctcctcactgaaagccccccaaccccgctgtctaagactaacaagaaagcaaggaagaagagccttcctgcctcccagccccctgtggctgtggctgagcaggtggagacggtgctgatcgagaccaccgcggacaacatcatccaggcaggaaataacctgctcattgttcagagccctggtgggggccagccagctgtggtccagcaggtccaggtggtgccccccaaggccgagcagcagcaggtggtacagatcccccagcaggctctgcgggtggtgcaggcggcatctgccaccctccccactgtaccccagaagccctcccagaactttcagatccaggcagctgagccgacacctactcaggtaccacactccctgtactgtcctccttctcctcctctggttatctctttttggcttgctttgaagatgatgctggtcatctcccagcttgatctgaccttgagagtcagtatcttttggggtgggcagtaagtggccgtttctacctgacaaatgggctctctttagttcatagggccaagtacttcttatctttagaaattgatgaaacatagggatattttggcaccttttccttataggttgttttttttcaggggatggtgaggggatagatacatacttgttaataacttatttttgattatagaattactcaaaacattagcaagaatgaaaacattccagttcatagaattttatgtaaagtaagaaaattaatgagaaaaatgctgatcattattaatgacaagaaaaaaacaggaagagcagcctagctttatagcaggaatatttaggctagattcatctggaatgtttgtttgttttagggtgtttttttttttttgagatagggtcatactctgttgtccgggctggagtgcagtgatgcggtcactacagtcttaatctcctgggctcaagcaatcctcccacctcagcctgagtagccaggactacaggtgtatgtcaccatgccaggctgagccactgcttcctgccaaactgggatgctgaattcaacaagaatgttcttatttttggcatttattaatgtgctctaatactctggaatctctttggctctgtgaggcaagttttattctttgttcatgcctgctaagtgccagtaattgtgcccatgttgcagatggataacccagaactcagataatttatgaagtatccaagatcaaatagggcataaatgacaggaaccaggagtcaattgagatttgtaacttcagaccccacactcttccatcttccaccttgactcttgtgtcttatgtgtagcaggtgctaccattaaaattgaggagtttttttttttttaatataaaaaacagttcctgccatcgaggaatgtatgacctagttgtctatagaggaagaaccgaatgactgagagtgggaagttgtgtaatttcctgggtggagaagagagcctttgaatttgaactgtggacatagaaatcacacaggaattcacccttctggcatatttaatgttgccaggtattttttataagtcatttatcacaatatctgtgaattcccatgatcagacctaccctacaggtgatattttatgttgccaggtgattttttataagtcatctatcacaaatatctgtgaattcccatgatcagacctaccttacaggtgaagaattgtggcacctgctcaggagcacatcctcggcattgcctcccctcccttccatgaggtcccatttcttgaggttgatggagacaggactaaaacccaggtcttccctaaggaaataatgatacatatgcagaaagatttagctacagtattattttttcatgactacacagctttataacatcccaacatgctgattattatacaactgataccttgttaactgtatatatctaggctgtttccaatcttacagctaaataaatccctgaaagtgggtcaaggacacgtacatttttaaaaaatttgtattctatattagaggtttgcagtctgtgaccaactttgaagccaaatctagcccacctgcctgtttttgtaaataaagtttaattggagtgcagacacgtccatttgtgttgcccttgcactacagtagtagcacagttaagtagcagagacaatatgccccgcaaagctaaaatatttactctccggccctttataaaaaaagcttgctgaaccttcagatgcaaatacacacacacacatgcatgcacgcatacacacacacacacaaaatcagacataaaatatcagtgatttgaaaaaggggcacatatcagaaaactgggaatgagatttgcatatttactaagaaatgggcca

SEQ ID NO: 14678 - DNA, 16738 bp, Human; identical to SEQ ID NO: 12168

SEQ ID NO: 14679 - DNA, 58273 bp, Human
  misc_feature (1)...(58273): n = A,T,C or G
ctgtccctgctttccctcccgagtcccgggccaggctgcgtccggtgggcaccgaggacgcccagaattgttgggaatctgggcggaggcccgtcgtgggcttggaggccaccgggtccagcagaggcagaggcctctgtgccacgcacgcacacacacctgctctcctccgtgtgtccacatacacacgtctatgcacacacctgctctccatacatgcacagccccacacacagtcggccctttatgtgcacacacactcgtgcacacaagcggccccctctcctccgtgcatacaggcgcacacacagctggctctcctctttgagcacacacactcaagcacacacccggccccgctcttccaagtgcacacacactcctgcacacactagtccctgctccccccccccacactcgcgcacacagccggcactctctgctccctgcacacaaacacacatcctgacatacccggccccctacctgctgccccatgtgcacacacactagtgcacacaccagtccccgctccctcacatgcacacacactagtgcacacaccagtccccgctccctcacatgcacacacactagtgcacacaccagtccccgctccctcacatgcacacacacgagtgcacacaccagtccccgctccctcacatgcacacactagtgcacacaccagtccccgctccctcacatgcacacactagtgcacacaccagtccccgctccctcacatgcacacacacgagtgcacacaccagtccccgctccctcacatgcacacacacgagtgcacacaccagtccccgctccctcacatgcacacacacgagtgcacacaccagtccccgctccctcacatgcacacacacgagtgcacacaccagtccccgctccctcacatgcacacacacgagtgcacacaccagtccccgctccctcacatgcacacacactagtgcacacaccagtccccgctccctcacgtgcacatgcactagtgcacacactagtccctgctcccccacgtgcacacacactcttgcacacagccggccccgctcccccacgtgcacacaccagctcccgctcccccacatgcacacacactcgtgcacatagccggccccgctcccccatgtgcacacacactcttgcacacagccggccacctctctctccggacacacacagtcagaggcgcgcacaaacacagtcccttggccgccgagcgcacgccgcgcgcgcgcactgcccgtcccggcgcaggccccagctacatctccgcacgcgcacgcgcacacacgggcacgcgcgcgcagtccctgcccgctctctcagggcgcccacgactggcgggaggagcgggggacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctgggcgggccgtcggggacctgggggtagtggtgagaagacaagcgggcccgcgggccacttttccgcagggggcatttccgtctggcgaggcgactgaaaatcctgagtgtgggagtcggtttggccagctccgctctcaggatggagggtgcctttgggaaggaaggtccgcgtttcctttgagatgtgttattttttaaacttcgtttttcattcttacttatttcttgtttttccttacttttttttttttttttaccagaaaaatcatttttcttctctgggaaggtgaacatttgtagcattgatttcccggatctggtaacatggcaaaagatgtaagtatgtttgcttcatgctgcacacgaatgtttgcctcgcactaaattctttgtagttctctgcctttatttcagaatgacaacacataagctacagtagtgtttattttcagacttttaaagcgtctgaagcgggatgaaggtgaaagatggaaggatctgatctctgaagctgcggtcaccacccacaagttgtggccttggataccacactgcagttgggtggtgatggggtggtgccttctgactttttccttatctttaccgactgtgttaattgataattttaaataaacgccttaattaaattgaggtggagggtgttgcagcaccgcagcgaatcctgcatttcttggggggcttccacatgagacgctggacgggggccaggctcagggctcaggctgtagccacctgctggcacctgtcttcctacagaggaagttaattccacttgggtggaccaagagctaaggacttgttttggccactttttttctcagaaggatgagatttcctgatttatgaaatctggtaaaaaatgctacttagcctgctttgcagttgtcatgaaactatagaatattttgaaaattttttaaagccagaaatttagtctattttattggtgtgcggttctttaccgtgcttggttatgtcagtcactgaaacaccagctggattctttagtgtttcccaccgtgcatcgttttgtaactgagtgaaaggtgctgttgatgtgtttacctacttaccgcacagagttggaaagagtccgcacatgctgcctctgcctgagatacatctgtagcgaaaatgcgtccagagtgtggagccctctccgttggcgcagaggtttcagtggtccctgcgaggccttttggggtgtctgccctccctgacctgcgaccaggcatgtcacacggcatccctgccttcaagcactggggtcccctttagagagggtgtgtgagcacccaggtggacccagtgtgagtttttgaagtcatatctggctgtgctgcgagactacttttatcctctccactgtgcttgtccataccatgccctgacctcgtgcgggcatgcactcagaatgccagatgtgggcatgtgctcagcgcgcaagccatgttcattacatctcctcatggtgaggagctggacccagggcctcggttagagcacgcttctggtgttgtgtggtttcctgtgtggtttcctcagatggttctcaaacacgctttgatacataatggatggtgttttcggggccctctttcattcccccgtgatttcactggcactgtctgtgagcagcatgtagtgtgaggctgggggtggggggcgtgtggaaagatggtccggctctgcaggaccctgaatgctccatccagtgtgggcacctgagacgcagcatttgtcaggaactgcataggcacaggggctgggggctcaccttgcactcaggggttgtgatctgagttgggggttggcgctgggaggagagtaggattctgcagctggtgaggccttccctgctcaaagcctgggagtggtcaggagtgctgggtctggatggaaagtgaggttgtgaacaagtcaaggaatttgatgttttcgctagctcttttttttttttttttttttgagacagagtctcactctgtctcccaagctggagtgcagtgacgcgatcttggctcactgcaacctctgtctcctgggtttaagcaatcctctcgcctcagcctcccgagaagctaggattacaggcatgtgccaccatgcctggcaaatttttttgtatttttagtagagatggggtttcaccatgttgcccaggctgggctcgagctcctgacctcaacaatccacccgccttacaggcgtgagccaccgcgcccggcctagctaactcttttaagtagaggtgtgacatttgagttttgaaaagatgatgttggcagcttttgcagaagggaacatcgataaccagttaggtgttttgtttttgttttttgagacggagttttgcttgttgcccaggctagagtgcaatggcgcgacctcagctcactgtgaccttggcctcctgggttcaagcagttcttctcctcagcctcccaaatagctgggattacaggcgcgccaccacacccagctaattttttgttagtagacacggggtttcaccatgttggccaggcttgtcttgaactcctgacctcaggggatccacccacctcggcctcccaaagtgctgggattacaggcgtgagccgctgtgcccagcccaccagttaggtttttaaaagcactggtactgcagtaaaaccacaggtgtatgtcaaaagcctttatgctgggggaaagctgtgccacttgggttgaaggaggcaggcctccagcttctaagtgccctggggcctctgtagagggccatgaggggccacaggatgcagggagctggagctaggccctggtagtcaccatggaggaggagaaacaaggacatccaagacctgaggctggaaggttctggagagaacacaagagaaaaacaactccggagcttccaacctcaagtagggcacagggagacaagcgggtgggaaaaggccacaaatggctccatgtgagtgaggggcagaaagaagaggatgaggtcagtcctctgggggtgtcatctttgaacagcagttgacaggcagtgggtgtgaaggtctatatggcaaggagctacacacgagggaggagagaggtactctgaaaagtttgcagagtgggtaggaaatgactgtggagcagtgaggagagtgatcagtgatggtgtagtagttagagagtgagtggtggtggacttgatggagagtgagtggtggtgctggagtggtggagagtgagtggtgatggtagattggacggagagtgagtgtggtagactcggggacagtgagtggtgatggtagattggatggagagtgagtggtggtaggactgggggagagagagtggtgatggtggtgtaggtggagagtgagtggtgatggtggagttggtagagtgagtgtggtgatggtgttgtgggtggagagtgagtgatggtagtgttgtgggtggacagtgagtggtgatggtggtagactggaggagagtgagtgtggtgatggtgttgtgggtggagagtgagtggcggtgctggagtgggtgatgtagggtcacagaaggaggaaacagcctagaaggtggctgcctttgatggtccttgagtgggcccagctggagaaatggtgagaaggattaggtttctgttgtcttgctcagggactttttattttattgcacttatttgaattaaaatggtaaattcaaatggaatatttgtgtttatactctgttaagtgggagaatgtggagaacaggagtcagctgccatacggccacctggctggctccgggaacctgaggcctggtcttgcccagcaggagcgctggcatagcatggatcacttacagaaatttatgatcaagattatgggctgctcctggcaatatggggaggatttccttgctgtggggactgtctgtttccatgcctggcccacccggtctgtgatagcctcaggtgcagtcctgtcttaagtttggagacaccctgggaggtccgtacagactctttgagtttctgaactgtcctcgaaacatctcaggccctccgcctcagggcctagggaggctgtcctctggttcctgaacagggtggctctgacccgcagatctgtgggctcccgttgcaggtaccggtggtgctcggaaccgtcctcagattcagtcttggaaggtgctttggcacctccttagagtcggacagacccttgtcacgagtcagtccagctgcaggggctcaagttgttctagagctgggctggcagggcccttgggtgagggagtgtggcttggcactggcatctcagcctgcggccaagtttcctgcctgcccaggcagcatgacccttggtgggatcaggcagagctctgcctctcccctccctacctcggaacatcctgtcgtcacacacgattgtccagtgtcatgaaagtttgtaagtgggaaggcaggcagatgatgaattcatcaaacattacagggatgcttttgctgtaagacttcgggatgtagcccgtgtggggctgtttctggggtcccgttcgcctctccaagctcctcctgccattggtaaagatgcagggcatctgaactcgctcttgggctgtgcgggcacttggacctggtcagctccctgtgcagagaacgtggctgtggacgtcactgcccggtattcacgtgccttggttgtgaaagccgttctgtggtgcctgtttgtgtcctgtgagtttatggggaaatcctgaaattgagagctggggaccaagagaactgtgtgcgtcccaccatggaggcgtttgagtgatgctgtcacgaggctctgctaatgccaagaggggaccaatgagctcctctaagggtctaccaccaggtgtccttttacagacctggatggtgaagttcaggcctgaagaggtgaacctgatgcagcaacaaactgctgtttccttcagtgcttgaaggagtgagttctgggaacaggattcagcgactcaggccttcttttgtcctcataaagaaacaactttacatttgaggttaagaaggttgtcagtttagccccctcaggtttaagtgttgaagaaatctatgatgacgtgcttgtttttacaagagtcttttcatatttcaggattttttttttctacataggatgaggttagagaaactctgaagggatattaaaaattagaaaattataggttgggccgggcgcagtggctcacgcctgtaatcccagcactttgggaggccgaggcaggtggatcacaaggtcaggagattgagaccatcctggctaagagggtgaaaccccttctccactaaaaatacaaaaaattagccaggcatggtggtgggcgcctgtagtcccagctactggggaggctgagttaggagaatggcgtgaactcgggaggcggagcttgcagtgagcagagatcacgccactgcactccagcctgggcgacagagcgagactctgtctcaaaaaaaaaaaaaaaaaaaaagaaaaagaaaattataggttaattaaaagttttgcccctgctgggcacggtggctcatgcctgtaatcccggaggccaaggcgggtggatcacctgaggtcaggagttcgagaccagtctggccaacatggcaaaaccctgtctctactaaacatacagaaattagctgggcgtggtggcgggcgcctgtaatcccagctactctcgaggctgagaaggagaatcgcttgaacccgggaggcggaggttgcagtgagccgagatcacgccattgcactccagcctgggtgacaagagcaagacttcatctcaaaaaaaaaaaaaaagaaaaaagttttgcccctaaaacatgctttaaaagaggtattataggaacatctggtataaaattcaaagaataaaaaaggacatcttttttcttacataatcagctctttgttagctctttacttttggtatttggaagaaatctctggagttcgttgtgtaagaattggaaacctcacctttggtgcacagctcgatttgcagtagaagtatcaggtgctctttaggggatgttaaaaacttttcactcttggtatttacattaaaaaatactttgttgtagaacaattagaaaatccagatttgcagttgatatttagcttgacttacagtgtggctttctgctgtttgtcataagagactagatttgtcaagttttgcttagagaggaggactggtagcagcaggtggcttagactacgtgtggggatggatctgcgaggggaagggcagatgtcagcgttggctgaattagaggctgaattaggtgacccctcatcccccaggtgtcttactcagatgattctggttgttcgggtactggccatgcactgctctctgtatctttgtgtgtagcccaagcctggaaaagcatccgccctttgtacctttttcccgactggctgagattcccgcagcatcccgactccgcttcagggctcctgtgaggacagggactatggcttttaagttgtcgcacaggtcatgggcactattcacatgtgctgcaggtaattttgagactcaaggatgaagagttatatctgcctcttcccgttagtcttttatgtgaatcctgtttgtttgtttgtttcgagacggagtttcgttcttgttgcccaggctggagtgcaatggcacgatcttggctcaccacaacctctgtctcccgggttcaagcgattctctgacctcagcctcccaagtagctgggattacaggcatgcgccaccataccctgctaattttttgtatttttagtagagacggggtttcttcatgttgctcaggctggtcttgaactcccgacctcaggtgatccgcccgccttggcctcccagagtgctgggattccaggcgtgagccaccgcgcctggccatgaatcttgtttttctatggtccagtttctaagggattctggtctgatgaatgaaaaccttgtgtgtcccctgtggctttgggatacagtatcttttaacacaggtgcttgccctgtgcaccctggtcttctgttcattaacatcgcgtcactggggtctgaggaaaagagacagtgtgatccgctccagtgaatggggaagcaggagagggtcagaaacctgaatgggtcagcccagaatccagcattgccaacacatccctggccctcccctcctgcccaggtgacaggtgtggcatatgctggtcctcagccctgcccaggagacagttgtggtgtctgtgggtcttcagccctgcccaggtgacaggtgtggtgtgtgctggtcttcagctgtgcccaagagacagttgtggtgtgcacgggtcctcagccctgcccaggtgacaggtgtgctgtgtgctggtcctcagccctgcccaggtgacaggcgtgctgtgtgctggttctcagccctgcccaggtgacaggtgtgctgtgcacgcgtcctcagctatacacaggtgtcaggcgtgatgcgtgtgggtcctcagccctgcccaggtgacaggtgtggtgtgcgcgggtcctcagccctgcccaggtgacaggtgtgctgtgtgtgggtcctcagccctgcccaggtgacaggtgtgctgtgtgtgggtcctcaccctgcccaggtgacaggtgtgctgtgtgctgatcctcagccctgtccaggtgacaggtgtgctgtgcacgcgtcctcagctatacacaggtgtcaggcgtgatgcgtgtgggtcctcagccctgtccaggtgacaggtgtggtgtgcgcaggtcctcagccctgcccaggtgacaggtgtgctgtgtgtgggtcctcaccctgcccaggtgacaggtgtgtgtgcgggtcctcagccctgcccaggtgacaggtgtgctgtgtgctgatcctcagccctgtccaggtgacaggtgtggtgtgcgcgggtcctcagccgtgcccaggtgacaggtgtgctgtgtgtgggtcctcaccctgcccaggtgacaggtgtggtgtgtgcgggtcctcagccgtgcccaggtgacaggtgtgctgtgtgtgggtcctcaccctgcccaggtgacagttgtgctgtgtgcaggtcctcacccacccaggtgacaggtgtggtgtacacgggtcctcagctgtgcccaggtgacaggtgtggtgtacgtgggtcctcagccctgcccaggtgataggtgtggtgtgcgcgggtcctcagccgtgcccaggtgacaggtgtgctgtgcacgcgtcctcagctatacacaggtgtcaggcgtgatgcgtgtgggtcctcagccctgcccaggtgacaggtgtgctgtgtgctgatcctcagccctgtccaggtgacaggtgtggtgtgtgcgggtcctcagccgtgcccaggtgacaggtgtgctgtgtgtgggtcctcaccctgcccaggtgacagttgtgctgtgtgtgggtcctcaccctgcccaggtgacagttgtgctgtgtgcaggtcctcacccacccaggtgacaggtgtggtgtacacgggtcctcagccgtgcccaggtgacaggtgtggtgtacgtgggtcctcagccctgcccaggtgataggtgtggtgtgcgcgggtcctcagccgtgcccaggtgacaggtgtgctgtgtgcaggtcctcacccagccaggtgacaggtgtggtgtacacgggtcctcagccgtgcccaggtgacaggtgtggtgtacgtgggtcctcagccctgtccaggtggcaggtgtcctgtgtgtgggtcctcaccctgcccaggtgacaggtgtgctgtgcacgcgtcctcagctatacacaggtgtcaggcgtgatgcgtgtgggtcctcagccctgcccaggtgacaggtgtgctgtgtgctgatcctcagccctgcccaggtgacaggtgtgctgtgtgctgatcctcagccctgtccaggtgacaggtatggtgtgcgcgggtcctcagccctgcccaggtgacaggtgtgctgtgtgtgggtcctctgccctgcccaggtgataggtgtggtgtgcatgagtcctcagccctgcccaggtgacaggtgtcccgtgtgctggtcctcagctgtgcccaggcttgggctgtgggtgccgcccgttcccagtggacatggaatccttgtgttactgagtgacctgcgtgtgctggttgctgcaccagcgggcttttctgtcgcagttgctttttaattgtatccattaagtagactttccacaagaaaataatatgacttactaaaaaaagttcaagtaatatttcttctgattataagagtaatcttagttgcagaaaatttggaaaaattctaggaaagcaaaaagaagaaaatgaagtcacgttcatatgtgagctgaattgttagggtttcatagcatatgcctgttggatttctatttagccgtgtgtaataaaggcagcttttccaagatgggaatgtgctgtaccttctgtttctaatcttttcacctcagtatattgtcagtgttttctctggtcagttatttttttctaccatgttttcagcagctgtatgtttttggtacgttggggagtcgtagatggtcagttactgaaaaagtgggttaacgtgggagataattaaaaaaaagacgctgtacctaaacacttcattttacattcaaacaaatgtgcatctggtccccaaatctcttggctctggactgaacgccccttcttggagagtgggccaccccttcaagccacgcccaccatactgggttttgatttctgtagactgaatggagaacataaaagacatctcaggacacggagtgcagcctcctgggttgtttgcagttttcccaggatgctgctaacagtgccactggtatagaggggtgtctggaatgagcaaggctgagtctgagacatgtggatctgtccgagagagtcctgtcagcctggtgctttacaggaaaggcggtggagttaggagcgctcttcctgctgcatggatgtgtctcagtaattacccactcccctgtggttggggattctagtggtttccagttaaatcttcccaaatttgcacaaatccaggatgagtcttaggatgaattcctggaggtgaaattgcctgtgcgcgtgcatgtctgtgagtgcagatgctggtcttttcaggtcgctttcagcacagtgtgaggtatagccgtcaggctttttagctgctgtgtagtcatttacttcctctccttgaaagtattaatggcggccgggtgcggtggctcacgcctgtaatcccagcactttgggaggctgaggcgggcggatcacaaggtcaggatatcgagaccatcctggctaacatggtgaaaccccgtctctactaaaaatacaaaaagttagctgggcgtggtggcgggcacctgtagtcccagctacttgggaggctgaggcaggagaatggtgtgaacccaggaggcggagcttgcagtgagccaagatggcgccgctgcactcccgcctgggcgacagagtgagactccgtctcaaaaaaaaaaagtattaatggctcggagtaacttgtatgggacttattttaggctccactatttcttttgcctttaagaaaaatcaaggcttgaatgaaaatatttcgtgtcaccactattgatagaacccaaattatattttgcagggaagcaggatgaagagggagatgaccgtggtgggagttcagcctctgactttgttttcatgcctgagtttgaggtcatatgtcttacccagttattgactcttggaggccattcctgctttagggcatcctttgactccgggagtcgtttttaagctgaggggccttatctggaacgatgcagcatggaggacagatgtctgcctcggtgtcatcccggtagcccgagttgagctggctgtggatgaggggttcctcttgcttcaggagaccctgggtgtcccctccccagcacggccaggttggggaggaggagtcacacatttgacagctcacggggtgtgcagccacagaactggaagcctggtctgtaggctccgtgtctgggagctcttcaggccagcggtggagtcggctagccacgatgacttttgcccggacttaacctcttttttctctaacaaatggaaaagcagttcccattggagtggccagaccaaatcctattctggggtggaaggggatgaaggtggtcagcatcgaggttgatcttgatgccagtccccatcccaggctgtggttccagtggcatttatcacatgtggatgctgatcctggaagccctgcttcgtgtttttgggcatttgttccctggagccctgtttttgctcactgttgagacagaaaggctgcgcgtcccctcgccccagcctgtcctgagcttgcctcactgtgcatccttgtgggtgggcgtcaaaccccgcacctgagtctgctgcggctctggtgcctgcccggcgccattgtcagggtgggtgtcctgggccctctggataccccctgtctggccggggttgccgctccgttctgaccccaggccaccctggaggagggtttctgagagtgccggtggctcactctgtccttggatgacttgatttttgttaaaatggaaatggaaattctttctaaaagggaaaagagtataatgtaaaaacttttccagaagagaaattagattaacatattgttatttttaaagttagctgctatgataaataaatagatgaatggagatggtctccacctcccacaggctggcggtatactcgggcgagggctatggggcggctcttccctgaggccccaggcctggaccccgtcgcgctgtctggcagcgtgtgctgcatttccctctggaggattttcccaccggaacctgtgtgatgtgttgtggaggaagctgtgtgaggcaggggtcccggggcctgaacggctggaccttgctagccctgcgacctcaggtggggactcctggcctctgtgtgctcgcctgtcccacgtgggcggccagctgccctccctacagggcagtgagggagaaaggagggcgtcagctgcttgccacgtcctggctgaacttggatggattcaaaagagtgaacataaggctttgacgaaattaggagcacctcacaggcctgggcgctgtgtaagacctcctcccagccacgaggggctgatctgatcagagctggagggacggccattgccgtgtgtccaatgtgagggctctgagctcaggagccagcatccagacacgctggggactctgcggcccctgtctttgccccagtgttgcacagaggggccctggctttccctgggcactgtttagaatgattgagggggtggcaggtggccagaaacgggagaggtggagtctccgaggcagcaggcctcccctgcaggctgctgcttccaggagggctgcaggcacgaggtgttcaaatgcagcagtgacttcataagaaaagggagtggagccgccgacatttcaggtgagttgtcatcaagagtgcagaatccaactgtgttgggagccacttgctggtgcctggccaagttcccgtctggtccctctactccccaccaccccagccctggaaaaccgtgcctgccaggttcataccacacaacccggtgcagcccaccccaaagacagcgggaggcaggatgcaagcacctttttaacggctgtggaactgatgtatgggttttccaggcagttttgcatttgtgcctgttgtagactagagcatcatttggtgtttttctgctggaaaagcaggctttagagtggtggctgaaagtctcattatagattatatagattagagcagcctctcctgggagagggatgctgggtgcctgccttccaagtgtctgctcatgagtggatgggccccaccctctgtgcctgctggggcttcagaatccactggtttcctgaaggttctggtgcccccgaagcacagccccacctccctaacctgccctcctgtgactcccattgtgtatgaacttacctcctcgctcttcagcttcccctgcctgatggctccaggctgtcccctgaggacctggggttcgtgttgccctcctgggtggagtctgcgtccccctttcctggtcatttaagttgcgtggggccgggaggaggcgttctctgcccctacgtggctcacactgtggttctgtggccgccgtccctctgtccgctcggggtagccagcttcctctgactctttcttagggtgatgttgggcaccaccctcgcctgcagctcatcacctctggatggatcttgttaggtgtgtggcttttcccttagtttagaaaatgaaatcgccttattgctttgttcggttatgaaaatggaaagtttatttaaaaacgtagggtgcagaaaggtgtcagaaagtaagcagtcatctgaaatgacagtcaacggggctctgctgttaaggctttttggtgattgtttctggggatgccctagatgtgtgtgtttaaatacacatgtacagtacggaattctaaataaatgaactcacatgttttgttcactgctatgttttactcaacagtttgtcctaggtttttttttttcacatcaataaatataagcagagataattctaaaaaatttgtggaacgtttcagacacacacaaaggagagagattgtgctggtgcctcgtccctgtcacggacctgggtgactccctgccgggccagggtgatcattaagtagttattaaatattctgacatgtgtctctcagagatagtcattcactcttattgtcacataggcagcatttacatttctcaagttgtctcaaatttggaaagtttgtttgcattggagcctcgccccctccaggctgctggagtctggtctcgctgatgcgccctcacgtactccaccctgttgatgggctgccctggctgaatgttcatccttcgaaaccctcaaaggtgttgggtgttggggcctttgggagtgactagaattgagtgagggcacgcgggtgtagtcccccctgccctgttggatcagtgtcctgatagccagtccccacggcgagcctgcccttttcccaccttgcgaggcccaaggaggaggtagtaggtgcagcctggaagctggctctgccctgacctcccgcttccacatccaggaccgtgagagagaatccttgcacttagggctccaggactacgagagagaacccaggaccgtgagagagaacccaggaccatgagaaagaacccaggaccgtgaaagagaacccttgtgcttagggcttcaggactgccagagagaatccttgtatgtagggctccagaaccgtgagagagaacccaggactgtgataaagaatccttgcacgtagggctccaggaccatgagagagagcccaggaccgtgagagagaatccttgtatgtagggctccagaaccgtgagagagaacccaggactgtgagagagaatccttgcacgtagggctccaggaccatgagagagaacccaggaccgtgagagagaatccttgtatgtagggctccagagccgtgagagagaacccaggaccgtgagagagaatccttgcacgtagggctccaggaccgtgagagagaaccctcgtgcttagggctccaggaccatgagagagaaccctcacacatagggctccaggaccgcgatagagaactcaggaccgtgagagagaacccttgcacgtagggctccaggaccatgagagagaaccctcacacatagggctccaggaccgcgatagagaacccaggaccgtaagcgagaatccttgcacttagggctccaggactgtgagagagaacccttgcacgtagggctccaggactgcgagagagaacccttgcacatagggctccaggactgcaagagagaacccagaaccatgagagagaatccttgtacgtagggctccaggaccatgagacagaaccctcacgtggggatccaggaccgcgatagagaactcaggactgcaagagagaacccaggacccaggaccgtgagagagaatcctcgcacgtggggctccaggaccataagagagaacccttacacgtagagctccaggaccgtgatagagaactcaggatggtgagagagaatccttgcatgtagggctccaggaccatgagagagaaccctcacgtagggctccaggaccgcgatagagaacccaggaccgtgagagagaatccttgcacgtagggctacaggaccgtgagagacaaccctcacacgtagaactccaggaccgtgatagagaactcaggactgcaagagagaacccaggacccagaaccgtgagagagaatcctcgcacgtggggctccaggaccatgagacagaagccttgcacgtagggctccaggaccacgagagagaaccctcctgctcttcccacttgatgcttttgctcactcggagcgtgtttgtgagatgagccttcacgctgtcctggatcttctccagatgcgaggttcttttctgctgcatccctcctctgtggtggcaccatctcctcttgcctgaggtggggaggtgttggcctccgtagctgagaagggctgggcctggcggtcacccagcgtctcctgcctggacttagcaacttgaaccagcagcgtctgtcacctcctagtgcctgttaggagcccaggtccccgttcagcctgtcccgggcggccctggcctgtggtgccctgagttggtctgggcaggaccactttcaaattaactcacccggctgctggtgggatcccgctccttgtgggctgttggtgggggtgtgttcttgcactttgccttgtgggcccctgcgtagggcagctcgctggtggcttcctcagggtgagccagcaaggtcagagtcggtctcttgaggccaccctcaccctcaccaggctctggtgcttggtgggagcagggcagggcagcccacttgggggcccctgcagggccagggcactggaagggatggctagggccaccggaggtcgtccctgagctctggggttgtgtttgttcccaggtgtgctctccagggtccaggaggactcgtgggagctcgaggctggggtcccaggcccggccccagaggaagggcctgtggccaggtgcgcggaaggtgctggctatttgtggtgggcaacccaacagccaaaagggaggagcagagagagttctccgcaggagttgatgggggagcagacagagttacccgcaggagttgagggaggagcggatggagttacctgcaggagtcgagggaggagcggagagagctactccctctgtagctctgagaggaggacagagctactccctctgtagctctgagaggaggacagagctactccctctgtagccctgtagcggacagaggagggacggagctacccgcaggagtcgagggaggagcggacagagttacctgaaggagttcagggaggagtggatggagttacccacagcagtcgagggagaagcggatggagttacccgcaggagtcgagggaggagtggacagagttacccgcaggagttgagggaggagtggacggagttacccacaggagtcgagggaggagtggacggagttacccgcaggagctgagggaggagcggacggagttacctgcaggagtcgagggaggagtggactgagttacctgcaggagtcgagggaggagtggacagagttacccgcaggagttgagggaggagtggatggagttacctgcaggagtcgagaggggagcggatggagttctccgcacgagtcaaaggaggagcggagagagttctgtgcaggagtcccgtgctggggccaggagggtcctggtagcaggcggggcccatcccagctgctgtttatagagtggcctcttccccaggtctcttcattcattatgcagtttaatgtgcagtgcaagtgttttctgccctggggtctggcgcaggccactccagtcctcagggggatccctcagtgcagctgggtcactttcttctcagctctgcttacttttgaaattaagattgttccttgacacttttatggctgttgcgtaggcagagttgagtggctgtgacagagactgggtgaccctcaagcctgaatcatttgcagggtcccccctgagaagtgtgcggccctggcgtccctctctccagccctgccctgggcctggcttgtgaacctgtgatgtcgggactgcagggcccctgctgggccgttttcttaccaggcaaaattcctgcttcacagagttgatgccaggggtgtcaaatcttttgttttccctgggccacattggaagaagaattgtcttgggccacataaaatagaataacactaacaatagttgagctaaaaaaaaaaaaaaaacgtataatttacaaatttgtgttgggctgcatgcagaggtgtcctggaccacatgcagcctgcaggacacaggtcggataagcctggtttatactctagtggggagctgttagcaatggaaatggtcagttgttcagtagattagaaagtgcagagaagagcagggcagagaagggtgagacagcgtggggtccaggtgtatgccccacctggctgctgtgtgttgcttgctgaccccctcatgggccttcgagtgtaagggagagtcctcttcatgccctcgcaccctcctgggtctctagggcttgtgtgtccccaggggaggagccccctggacacaccctggcgggtgctggctggcaaagagggaggcgttgagggcccgggcagcgcctccatcctggccaggcaagtgcagcttcaggttgtgagaaccgtggtcacctgtgtgttttaaagatgacggcagtgataggtccccttttgggcctggcatggaaattagtcacattcgtagaccctgtcacagagtgggcactggtgatgtcatcttttatagttcttattttcaattgattcagctttttctagcagcatggcgtgttttacgaacgtgtgttttgctgttactgctgctactcatagtatggttttgtctaatgtaagacagaagagaataatctactgttatctccatgaagtacaaacacaaatacagttgaatatagtttttctaatagaaattaaggttagttttagccaaggagcacctttgctgttggcttatatgttaatgtgtttagcaccttgaggtgtccttactggcaggtagggttgcatcttgagtgtaaagatttaacaggaaaataagtccagtgcacatgtcttaaaattaatagcaatttcagcaatatgttaaaaacacgaagctaggccaggcgtggtagcttacacctgcttgagcccaggagttcgagaccagcctgggcagcgtaatgagacctcgtctctactacaaataaaaaaaaattagccaggcatggggtgcatgcctgtcccagctactttggaggctgaggtgaaaggatggcttgaaccgggaaggtcaaggctgcagtgagctgagatcttaccactgcaccctagcatgggtgacagagtaacagcctgtctcaaaaaaaaaaaaaaaaaaaggcaaattaaactatttgtgttttggtggtgcttgttactgagttcctgtgggtcacagcccacaagaaatgcaaggaggacccacatgagggtctttcctacagctccttacatgctcaagctggtaattgtggtctagtagtagctactgaatatcaacccataagaatgacttcatattaaaaaaccacagaggctataattgggtctgtcttagtaagttctaaagtgtcagtagagacccagactcacacccacactcctaagggcaggacacaggggaggctgtggccttggatcctgtgtggctgaaatggggttgcctattcaggtgctgagtttgagatgggagctggcccctggcctggagagtggggacttgtgccgaggccactttgctgttgcccagcaggccagcgtgcaccccttgcgcatcctgttgacacgagcactgagcggacagacctcggctggtgttcctgttaacaggtcccacttagcagcctccgtttacagccagcccgggacctgcctggcaggacccctggtagttctgtgtcataggagcccctctttgttccaggccaaccaggacaggcggtcaccccacatacagggttctgaacgttctgacgttacagcgggggtctggtgctgttgtctcaggcaggaatggaggctgagggtctgcacgtttactgctgtgtgcaggccccgtcccaggagcgaggtggagcccatgtgaggaggttgtggtctttgtaaaggtgggcagcagcgagtcatgaactgcaagctcttggtaggttttggacgggacgtggctggctgagcttcctcttggctgtgtggagcctcagcagggcgttgtgtttgacggcaaatgggaattaaatcatggcatcgtcactgtcttttttagggacgatgctgcacttagttcttgcgactcttcctgttgtcagttggggcgggggggcgtcataacattctttcctgtccttgggggtcaccttccaggaaaggggtgggtgtcagagagtgagtgtggctttgaaaggctggtgttgagtgggatctcgtttttcaggtgatggtgccagtgatctttccgtgcggaactaagtttatgcagggttcaagatccattcaaagataaattcagtgacgacctggttgatgaaaagaaccactttttttttaatgttctagagaaaactctttaactgctgtattacttatctattgctgtgaaacagacaaatgtagtggcttaaaacaacaataagctgtcttctcccacacagcggctgtgggtcaggagtttgggagtggctcgattgggtgctgctgtcctggattctcatgcagttgcagttgagatgttgcccagctctgcaggcctcaaggccagggtctgggagtctgcttccaagatgtctcaccctcgcagcagtagcaggaggagccctcagcaccaggaccacctcagggccgcttgagtatcctcacaccgtggcaccagctttcgccagagggcagggagtgacctagcttcagaagttgccccttatttccatcctcctgggggtcacagaagtcagttcagggaggagaaggtggcacggtggtgagtgtctgcaggggatcctgtgggaaagcagcgcagtggtgagtgtccgcaggggatcctgtgggaaggcggtgcggtgatgagtgtccaaggcggcgcggtgataagtgtccataggggatcctgtgggaaggcggcgcggtggtgagtgtccgcaggggatcctgtgggaaggcggcgtggtggtgagtgtccgcaggggatcctgtgggaaggcggcgcggtgatgagtgtccgcaggggatcctgtgggaaggcggtgcggtgatgagtgtccataggggatcctgtgggaaggcggcgtggtggtgagtgtctgcaggggatcctgtgggaaggcggcgcggtgatgagtgtccgcaggggatcctgtgggaaggcggtgcggtggttgagtgtccgcaggggagcctgttggaaggccgcgtggtggtgagtgtccgcaggggagcctgttctggttgcttgggctgctgtcacaagaatgccatgaccatgaactgggcagcttgtaaacaacaggaatccaccgctcacagctcgggagcctgggagtccaccatcaaggccctggtaggtttggtgtccagtgagaaccacttcttggctggtaaatagcgtcttcttgccgtgccctctcctggtggaagggccagggagcccctttatcagggcacatactccatccaggaggctgtgccttcatggcccagtcacttccaaataccgtcccaagcaggattaggaggaccacatgtgaagacgccgcacagccttcctggaggctgtgtgccccagccctgccatcagctgcctgctcccgctcacgtctccccagttcacctgcctccagtgctggtttatagaacatttgtgtgacttcttcagatgatctgtaaacagaggcagtctaggtggtgttttgttttctaatttcctttatggaaaggagagtttgcatttcccttgtgattttgacacacattgtattatgaaatattttcagtgtttgtcaaactcggtgtggggtaagcgcatcccaccaagataggcgcttacaggcagccaaggaacccaccgtgtggtttccttttaggttggatttcctgtcttacagcctcatgttcctagttggaaattaaggttgagactgtagccaggtgtgcatttattcatccgccagctctggagaggtctgctttagaggccctgcggccccagaagtcatgcctctgagtccgtggttcttagctgagggtggctttgcagtgtccggagatgattctggttgtcccacccagggtgaatgaaggctgaagatgccgccaaacaccctgcagggaggctggcccctgacagagccgtgcaggcggcagcggcagcactgttgctgcggctgagacagcgcagggcgtcattcatccccctgcctcctgagcccagagcttctccaggagaaagctgaggaaaggggccagccgtgagctgcgggtgcttgccagggatctggtgacacctgggcatgtggctggtggaaccagcaggccaaggctgtggattttgaagtgctgtctgccatttccactttcagaagcatgagttgcataaggaaggggaatgaaagggtttttcctggagcaaaatgatgcttgtggcagacacagttggaaccacagacgatgccacgcttgtgtcagcagtgcgacactggcccacgtgtcgtccttgttctctcctcattgctgccgtcactgtgtgctgcgcatgccctgcagttaccccagagctttatgtcacaacattgaggctggcggagaaagaccggccccttcaccccaccttagacttcctggaagggccgcccgggtccacaacctggcccgttaactccctgggcagctgctggggaggaagaagcactgcccgcaaggaggggctgtgccagtgggtggcggtgacgggggccagtggtttcctggacctgggtttcctgggtgtgggctactcagggattgctgagttcccatcccagccggagctgaccaccaagtcgacggggcagagtgagaaacatccaggccacctgtgccgcagcccccatggctgccgaggtctcccctgggcaggggcagttggtgttctcgcagggcctgtgttggtgcatatgaggagtgttttctgtgagcagcggtggaacatttacagacacgagcgtcacagtggctgggcaaggcccgtggctgagtgcacggtggccctgggcggggctcctctgttggggcctgacttgctggcatttcatggaggccgcaggcagccgctcttcctgggggtcttccacatgccctgcaggcatggggaggagcagcccccactctgtctctgcccatcaggctgcccccgccaacagaaaaaaggcactgtgccacccggggcagtgcgttcccagtgccagtccctggccctgtactttttagcaggcgctcatgctcatcctggtgagggagggcgatagacagggacagcggtgcaaaatggcttcagagcctgaaccacggttgccacaggctggggctggagtgcagacaccatacaggggaactgggcagagccctggctgtgcaggcgggagggcagtcatcctccacagctgggacttgctccgtcagacccccagcagggcttcctccagctccacgcacacggggctggagcatgctgcactcccacacagatgctcgagctgggcccaagcctgaccagccctggccgaggcccttgactcctggcctcacccaccacgccttaacctcctggctgtaacttcctggccttacccttctggccttacgcacctggctgttctctcctggctgacccaccttgtgtttaacttctcggtcttacccagtgtgcttgctttcacctccttggtcatagtcacctgaccttaacctactttgctgtagtgtcttggccttcatctcctgtgggttctagcccaccatagccacttggccgtgtgtacctggctcagccacctgtccagacccactcgcctttttctaactggccgtaccctcctgccctttctctcccaggcttaacgtctcggccttaccaacctggcctggatggtagtgccctcatggtgaccaggacatctagcgtctcacacctgtaacacactaatgggtgccagcacagagccacgcatgccggccttcaggcaccatcgttgaccgcacgtcatgcttttcctggtgtcgtatgtttgtgccagcgtagccctctgcggggcctgtgccggtgctgtgtcaggtgtggtggcctcagagcgcctcctgggtgcagtcaggttcttgctccacggctcttttccttgatattgcgtcacacgccgtctgtgggcccctgggggtggtggagccttgatcccagccccttggtgtggccagtgggatgcagcccccctgcacatcctacctcacctggctctgtgtgcaggtggtcaatgggacatccacccacctcccagcaagtcccacagccagggctgggacggtgcctgctggacagctagactcagaaagtgcagttggacccggttggaacggcagtagtgactgtcttttttttttagcgtcctaggatgtgaacttgccgtggtcctcgggcttacgggcagccctggctttcctcatcttctgtggggaagtggagttgtgaagatgcccaggaaattgcccagtggtcttgcagtggtcgtcttgctgggctttgagtcttggctgcctcccctgtgtcccctgactgttacctgggtggcaccagggggtcttggcgtctccttgttcccatggtgtgtcccctgactgttacctgggtggcaccagggggttgtggcgtctccttgttcccatggtgttatctacggaagggtgcattcgggtgcctttaccctcagcgaaggcagcaaccctcatcgctgccccccagccccactgcctgaggtgcgtggcctcctgggaccctgggtactcaagcatgctgccgtgtgtgtgctcacactcaggctgccacgcctgtgctgccagcacgccactcccagaggccgcccctccaaggcctcctcttgggatggcttttccttcgcagagcccggcctctggggactgacattttgttgggactaggaagagaataaaagatttccatggctttctggagaagcaggatgaggttgacagttctgataggagtcccccttaatgtgtcttgccgtgtggctgtaccattacgcgtgtgctcttgccgtgtggctgtactgtcatgtgtgtgcccctgctgtgtggctatactgtcatgtgtgtgcccctgctgtgtggctgtaccgttatgcgtgtgtgtcctgtgtggctgtagcatcactcatgtgcctctgccatgtggctgtaccatcacgtttgtgtgtgcttgctgtgtggctgtactgtcacgtgtgtgccctgacgtgtgactgtactgtcatgcgtgtgcccccaccgtgtgctgtaccatcacacgtgtgaccccgctgtgtggttgtgccatcatacgtgcccccactttgtggctgtgccatcacacatgtgcccccgctgtgtggctgtgccatcacgtgtgcccccgctgtgtggttgtgccatcacgtgtgcccccgctgtgtggttgtgccatcatacgtgcccctgctttgtggctgtgccatcacacatgtgcccccgctgtgtggctgtgccgtcacgtgtgtacccctgctttgtggctgtgccgtcacacgtgtgtccttgctgtgtggctgtactcttacctgtgccacacttaaatagaatgtgtttaacattctattgtgaacattttcctcatcattacaatcttgatttttcaagactgtgtggattctgtaagtcatggctaattcctggtggacggtgctgttttggccctgtaggtgccatggtgatagtgacattccttctccggacctggcgttctcctggttgttcctggagttgcttgcttaactgtggtccttctgcctttttatgacgttatttgatagaacccttgagggtggttttaaacacccctagtttcgtagcccttttagctgtcatatttattattgttttgttgctttccgcaggccggtctaattgaagccaacggagaactcaaggtcttcatagaccagaaccttagtcccgggaaaggtaagggcacctgttctggacacactcttgtgttgatgaatgcatgaagcttcacatgtttatgaagctgttgacgctgaagcctcttgctaatgatggcatctcctgcatgggcacctttgtgctccgggaacccaggagggtgggcgtaggagccttctagcatttagaacacagcctgcacacacaccagtagctttgtggattttgaattctaaggtatgtatactatttgcaaaagtttagaaaaggtagaatattgtaaagaagaaataaagatagtttgttttctctccacccaaagataatgacgtttcagctgtggtgtgggctcttccagaggccggcctcacctgtgctgtttgaggaaagatgggcctaccatggtgcatgccttctgcgaagcaggcacttgccacctttaacgcttcgcgtgtgtattttactagctcttgaggaagagccgtttttcttgtcttggggaatccaggggaggaagtcagctggagaggttgaagccacctcttccagggtcccacggttggtagtttccattttacacctcggagtggtgctgtggtttacgttcgtgaaggtgtgtgtgctcacctggttacttcctgggtaaactccttacctgtgctgggtcagggcacgccatttagaagctttgatgtgcgatgcttggcccctcgtgagaggctgtgctgtgtggatctgggattgcgtgcagggtagttcgttgtggtttgttgcgatattcctgggagacaagcttgtggaagagcttgctttgtcccaagacctgtctgcctgcagagcctagtgggtccactgagtgccctggtcgcaacatccacgtggtcgcatcagcccagggaggagcccagaggcctggatgtgtttccgttttgggttcctaaaaggaaccttaagatttttctaattattcccatatataaaattagctttttttactcttaacattgtgacccttgtaagtgacctctcagtgcttgccatggctctggggcgtgggagtgtggtgaccaggcccccacctctctgctgaggcttggccttgccacccgtccctttctgtccagtgctggtgcgggcgcccatggtgccatctgcctccaacccctacatgctgtggatccaggtgtctccttggggcctgtccctaggtcctgctctggtctcttccttgagagaacttggctttgtgacctgagccagcctgcagcctccccagcctcctgctgtccccgggccctgtcagagggaggtggtgggactggccctgctcttctgctgaagcaggtccttccctgccgcttttctaggaatagggaccaaatctacgcagcccttttaggattatttatgagctttttgtcttgatcatttgaggattcacagattgcttgagagaaatatcgttttagtgtaactaattgaacacttaaaagtggacaagttgcaggcgtgacattttctgttcaagtggtgaagcagaaataacaataaaaaagttcaccattttatttgcttggaaatgatgaagtctgttactatggtgttgaatttgaatttctcttgttaggttacatgcagtaggctttcttaccacatgtgggctgtctccttttccattcttactcacaaatctgtgcttgaatctgtaacaagtttaattgagctgaagagttgaattgcagggattaggaaggaacatattctgcattcatgacatagctgaaaatgttctggttttgagccggcccagcagggccgtgcatttcccctcagctcgccccgcgtgccccggcccccagatccctcccacatgagccttgggacggtcagttctttccctggatcgccggcagcagctcctggacctcccctgccctcacctggtgttgattccaccgcacagacggtggtttttgttgttgttgttttggagatggagtctcactctgtcgcccaggctggagtgcagtggcgccgtctcggctcactgcaacctctgcctcccggattcaagcgattctcctgcctcagcctccagagtagctgggattagaggtgcccaccaccatatccagctaattttgtatttttagtagagatggggtttcaccatgttggtcagactggtttcgaactcctgacatcatgatccgcccaccttggcctcccaaagtgctgggattacaggcgggagccactgcacccggccacacgtggttattttaaatttgcttttgaatcagtgacacgttcatgtttttaaattttgaagtatgaaaaggtgcagagaggtttccttttttcctcttctgtccatgcaggtgagcaccaatgttcacttccggtgttcgttccagagaattctgtttaacaaatagaatggtttgttggtgtttgcatgtgtctgtgtcaatatgtgtgcatgagtgtgtgtgaggaatgtgtgtgtcactgagtgtgcatacgagtgtgtgtgtgcatgagtgtgtgtctgtgtgtatgcgtgaatgcgtgggtatgtgaggagtgtgtgtgtgcatgtgtgtctgcgtgaatgcgtgggtatgagtgtgtgtgtgcatgagtgtgtgtgtgtatgcgtgaatgcgtgggtatgtgaggagtgtgtgcatgagtgtgtctgtgtatgcgtgaatgcgtgggtgtgtgaggagtgcttatcagtgcattgtgcgtgtggagtgtctgtgcgtgtctgttcatgggttgcatatgtgttgagtgtgcatgtgtgttgagtgtgcatgagttgtgtgagtggatgcgagtgtacctgtgagtttgcgtgtgtgtgcatgcgtgtgagttgtgtgcgtgtgtgtgcatgtgaattgtgaggagtgcatatggagtgcatgtgttgtgagtgtgcatgagttcacgtgagttgtgtcagttgtgtgcgtgcgtttgtgagttgtgtgagatgtgtgttgtgtgcatgagttgtgtgcatgagatgtatgtgagttgtgtgcatatgcacgtgtgagttgagttgtgtgcatggagtgttatgtgcgtgtgcatgtgtgtgtgttgtgtgcatgagttgaatgagttgtatgtgtgtgttgtgtgcgagttgagtatgatgtgtgtgcgtgtgtgagttgagtgtgagttctgattgtgcgtgtgtgtgagttgtgtgtgtgtaagcgtgcagtcctcgcctccccaacagacacctgtcttcactagtgggccccccttgcctctagttgggagtggggtggtccaggcagggtcctcggcgcccttagatggagccgttgcagctgctttttgagttgccctcggcggtgccagtgagcaaggctctgccttcctccgtttgtgccctgggagcccagggcatggtcggtagcactttgagggctgtagaggcctcccttgagtcagaccttgaggaaggacaggagctgtccaggtgagagtggatcaggggaaggtagaggggaccagcccagccgaggctcctcatgggcccctggccctggtcctggtcctcccagctccactccacgtcacagcctcccggggccactgtgtctcttcctgctgctgctgtggggggcctgtgtccagttccccactgtgtcagcgttctctaaagtagcagccagtgagcgacgggaacctgggtggggactcactacaggacccacctagccatagtggggccgtcagggcggaacctgcagggtggttggtggtgaattccttttctgggaaaatgcaggtgttgctctgaaagccttcagtgggttagacgaggcccacctgcatcgagcacagtctcctttgcttaacggctcctctttgaggagctccgcggcaagttctcggctggcctttggctgaataatggatagagcaccgtcaggttgacacgtaaaactgactgtcacacccttcgaggcttagaaggctgctttccacccagagaaatgcaccaaactcgagacattttgcatccacaggctccccaaggatgggagtcccaatgtggaggtttggcaatacatcttacgtgggccattttagttgtggctgtttgggttgcctctgattgtttcctgagagcaaaatgctggtgtgaacatttgcacacacactttgtgtgtctggcagttccacttcctcaccagcatttggtagtggtgggtttttaggctttctgtgtcacaggtgggctcttactcatatcatgcctacggccccgcagtgctgataggagcttttcctctcgctttgcctggtccaccctgcccctgtctgagggtgacctggccccatggctgcctgcactctcctccctgatgtgtgcaatcctgcccggcctgtgcctcgtcctcagggaggccatccgggaggccacagctggcctggaagtgtgcttgtctgtctctacctcagggctgcttgtgcacctcctgtacctagaggtgatccaggctcactgagaatctgcccacactgttccacacgtttaggccaggtgcaggggctcacaccagaaatcccggtgctttgggagactgcagtgggaggattgcttgaggccaggagttcaagaccagtctgggcaacaacgggagaccccatctctataaaaaattttaaaaaaaagtagccaagcatggtggcgcatgtctatagatagtcccagctacttgggaggctggggcaggaggatcgcttgagcctgggaggtcgaggctgcagtgagttgtgattgtgccactgcactccagcctgagtgacagagccagaccctgtctcaaaatgagtaggctgggcatggtggctcaagcctgtatcccagcactttgggaggccgaggcaggtgtatcacctgaggtcaggagctcaagaccagcctagccaacatgatgaaaccacctctccactaaaaatataaaaattagtggggcgctgtggtacacgcctgtaatcccagctactcaggaggctgaggcaggagaatcacttgaaccctgtaggcggaggttgcagtgagctgagattgctccactgcactctagcctgggtgacagagtgagactctgtctccaaaaaaaaaaaaaaaaagagtaagtgtgtaagtgtacatttgagcgtgcactttcgcagctggtgcgtggagtgtctgtcctctccatgccgtgtggtggctcctgtctgtagtcactgggacccttccagtcacggtttcggtggctgcgttttgctaccttttgttatttgctgccgttttctcgtagagtgctcatgatttttaacatagtaaatccgtggagagcgctcaggtacagatcatggctgtgtgcagtgcaggctcaccgtctgcggcgccaggccgggtccctcgtttgctgctcatctgggagtgcccagcacatgtggccattgattatacatatcctcttagcccagaatgactgcttactaaagagcatctccctttgttgtgtctttactttcctcctgcttcaatctcatatctgtcggctttagggttctaagtggaggaggaaatttagcaatgatgtgtggtcagaagcttagtgttgcttacgtaattcctcactcgtgaccgtcgcctgtgaactaactgtgccccttgccccccgacacacgcactggtctttgtagagctgttaggaagggggttataggaagggagggtataagttttggttggcctcttcaaactgccagcctcctacaaaactgtcaggagaggccatcagctttttctctctttgtatttctctgtttttaacccgaaggatgttaaaagcccagcctctgtttttagcccagtcatgacatttctgtggccgtaacccttgttccaggtgtgagatggtgactcttggatgcagggtagcctcccagagctttgtgtgtttgtatagagaggtttgtgggagtgacttgagccgtgctgtgaacttggactagcacccgtgtgttctcaggagcgggtcctgctggaggcccagccacgtcaggcacagtaggtgtgtgatttgtgcaacggaggcctctgataactgccagagtagatagcttttgtgtgggagctgcctcagcctgcattccaggagctcaggtttcctgagtctgaatggagtctggagagagcaatgtctccatggagcgggtgcctggctgtggtcgcttaggcaggagcttcctcctcagtgctgacaacagagaagaacattctgttgtggccagtcaagtgtgcacaaatgctgcttgcgagccagtcacagaggcactcacatgcagagccgctcacctgcagagccgctcacctgcagaaccgttcacctgcagagcccttcacctgcagaaccgttcacctgcagagcccttcacctgcagaaccattcacctgcagagccgctcacctgcagaacccttcacctgcagagccgctcacctgcagagcccttcacctgcagaacccttcacctgcagagccgctcacctgcagagccgctcacctgcagagccgctcacctgcagagctgctcacctgcagagctgctcacctgcagaggggttgtgcttggccagataagcaaacaaaacatctccagcatggtgggcaaaatagtaactcttagacatctggctctgacaacgtaaagatgttaaaattgtttttcagaaaatacaaaactgtatggtttcataatttatcttaagccctatagatattaatagaataggattagtaatgataaaaacgtgaatactatatttagactcctttttctgttaatggattatagcaactgagaccatatatattcttaactagttttcttcccaagaaaggaattctccatttaaaatgctgtatataaaatgtttttaattagttcatttgaaaaacgctgtgtagtgccttttacagttgaaacaatattatttctattgagttggcttgtgggccatgtcttcatgtgactcagcttgtccctgaaatgttagccctcctccctcccatgcatagattgtgtggcagtcttatcaagaaaatgtgtggaacactctactctacttatattgccagattaaaactaaatgattggctgggcgtggtggctcacacctgtagtcccagcactttgagaggccaaggcgggtggatcgcttgaactcaggagttcaagaccagtctgggtgatgtggcgaaactctgtctctacaaaaaatacaaaaattagccgggtatggttgtgcgagcctgtagtaccagctacttgggaggctgaggtgggaggatcccttgaaccgggaggtggaggttgcagtgagctgagattctacaactgcactccagcctgggtgacagagtgagaccctgtctcaaaaacaacaactactactactaattgaaataacattctatcctgaggtggacaaaaaaagtggtggggagcggcagcctggctgccactggtgcgtctggcctggaatgaccacttggggagctgggtggactctgggacagcggccgctgggacccgggcttccctggtggcaggtgtgccgaggaaaacacacagcatgtggttcagtaataacaaacagcattttcatatgacatctgtgttcatatgaccactttattataatggcatagcataacagcatttaaggaaatcagcctgacggctctatgtatgggtaaatctgaaacacaatgttggcagaattgcagaatgcgagccatataatatttgtctgtgtttcagacgcacacaaaaacaatcatttatagccttaggttcagcacatcctggaaaagtatgaaaaataaagtgagtacgtccctgcaggccctgggagttgcacacagggcagactcggggggaggctgaggatcctggggactgtaattttatttctgctctttatgtctctatgaaacttgaagcaagtatgatgataacagtgaattttaagtgtactggaataaaattgtcatgttattgtttgtatttgaaaagtttctcagtgaatagaaacaagaagcccggctgggcgtagtggctaacacctgtaatcccagcactttgggaggccgaggcaggcggatcaccagaggtcaggcgttcaagaccagcctggccaacatggtgaaacccttctctactaaaaatacaaaagttagccagtgtggtggcaggtgcctgtagtcccagctactcaggaggctgaggcaggggaatcgctggaacgcgggaggcggagcttgcagtgagccgagatcatgtcactgccctccagcctgggcgacacagtgagactccatctcaaaaaaaaaaaaaaaaaaaaaaaaaaaaaagaagaagcccacccacccaggtctggccccagaagccactgccactgccctttccagcctgtacgtctgggtgtgggtctgagatgtattcagggaggggccttgctgctcgctgtggtcgggtggctgtgcaagctcagcccctatctccaggcccttctgaagtgctgctcggggccggacagggggtattcaccctcagcctcaggatttctttcttctccctgttactgatgtacgtaccctgccctctgtcccgtagagactcagctggtgacccaggggtgctgctgggttggtgtggtgtgccactcagaggtcctctgttggtttgtgtctaggctgggaggggccctctgtgcttggcaaggccttgggctccgaaaccctttacctgcagctggtgtgggggctcagactccaggtggacagcaggagtgagtggggaagctcaggggccctggatgtctgcctgcattcactcatcctgccctgggtaccagaggagggaccctcttccctctgtgtgtttgtctcccccttcctaattgtgaaaacccttagcgacccaccccagcctcacggtgctggcctctggcccagagggagagacctggttggaaggacagatggtgtaggcaggccagccggccggcctgtgggtggagcagatggagggcaggccggatgccccgagggtctcagctacactgctgtcccacagccccaccaccacctgaatccctgagtcctacccacactccctgatggggcaggaaaggggagccccagactgggatgcctgagtgtatgctacctgtggtgctggtggacgggcgccgtggcctggctgttcaggacggaaagagccgcctgggctgctgatggagagtgacagtgccactggcttttgtgaactcagaggtctgtttctttcttcacatttattgaaattagagactcgtttgcaaattttaaaagatgttatctttgtaatgaatcaactacatattcttgaaaactgagtgtttactcatctgtatgtgaatctgaaaagtgtttaattgcgtactttaaatcattccctgcatagtagaatattatttttgcttttaaaatgcctttccctggtaagtattacaccgtgtatatgtgcatccaatcatcactggtacatttcgaatatgtacaatctttacttttcaattgaatattctgaaaatacctttcacatatataaaacaataaaaaagtaaatatttgcttttcttaggatgcacacctttatttttggaagaaaatttcccaaagcagatcatcttattttagttccagaagagaattttaaatatgtgctgacattggttggtaaaaatactaatatttaacccagttgaatcaaaaggcaaatgtctttttaatcacttcctaatgatctgtcttggccaacttaggttattaagagaaattactaagtgtccttatgtagcacaaaattcattgtttaatatattttaaagaaatgcataaaaagcagtagatgttttaaaaatgcatgggttgtaaagggccccaaaatgaaacttcagatcgcaaaggcaatgtattcgaaagtctcaccgatgattcatgagtcattttggtgctaactggtgggaatgaagggagatgcctgtggggaggtccagggtcctgcagctctgcggatgggcggccgtccggggaggcccaaggtgtggcgagatcggggagttcttctttcctgatgttgttgtgacccgaaagtctgtgttttcttcacctgagagtatcatgtattttcaaatggggggctatccgctcagctcccccagccgtggggtggggtgtgggtggcaagccacccaggtgccgaggcaagagaccgaggacacgagctgttccagtataataaaatataaaacaagaatggttattccagatatagatcttagatatgattatatatgaatatcattaatcattagtttgtagcaattactctttattccaatattacaataatcctcactctacaatcataacccaggaaaaaccaggccatacagagataggagctgaggggacatagtgaggagtgaccagaagacgagtgcgagccttctgttatgcccggacagggccaccagagggctccttggtctagcggtaacgccagcgtctgggaagatgtccgttgccaggtggactgtggtctagcggtagcctcagtgtcacggaaaaacagcggctacttagcagaccgggaaagggagtttagagaagactctgttcctccacctcttgtggagggcctgacatgagtcaggctcgcctgcagttatctggaggcctaaccgtctccctgtgatgctgtgcttcagtggtcacgctcctagtccaccttcatgttccatcctgtacacctggctctgccttctagatagcagtagtaaattagtgaaagtactaaaagtctctgatatgcagaaataatggcgtaagctgtctttctctttgcctcctctctctctctgcctcggctgccaggcagggaagggccccctgtccagtggacgcgtgacccacatggccttacctgtgattggagatggcttactctccttatctttcccttttgtcttgtatccaataaatatcagtgcagcctggcattcggggccactaccggtctctgcgacttggtggtagtggtcccccgggcccagctgccttttcttttatctctttgtcttgtgtctttacttctacactctctcgtctccgcacacggggagaaacccaccgaccctgtggggccggtccctacagtggggcactgcgagccccttgctgcctctgtgtggccgcccacccttccagtgttgccctgacgcccctcccgggctgtgctgaccacccaggcctcccaacttgtttcccagggtgctcgctaccacctggtttacggtttctttgtttagttctctctgcccgctgatgccagtttttgaactttatcattactacttctgtttatgtgtaaatgttccaggacttttatccaccgccctgtccctaggaccttttgcataccgctgttggaagacagaggcttcacatctcctgcagaggggtctcccgcttgcttcaccagtgttctgagggcacctgcatgtttagagccgcagcctctgtggaaggcacactccttcctaggaacaaatgtggttctccttcctaaggaaaagtggattatcagatttccaaactagttttgcagccttatagagaaatgttgcgataaaaattctagttttaaaattctgttccataattgtcatagaatcacagacttttccaggccgtggtccccaccagcacgttccatagcagacatcgccgaggggctggagcagtggatgatctgcctgggtcacctgggtggcgtcagcgcggccctgcggccctccccttacgggtttacattgggaatcaagcttcatggaggtgttgctcttgagccctggatttgagacagtacacgtggggaaagctaagcatctctaattgcaagcaccgtcttgcatttagaatggtcgcttgtagccttaacttagaaaaggagtctcgcccttgacctggtgtccttgtgttgcaggcgtggtgtccctcgtggccgttcacccctccaccgtcaacccgctcgggaagcagctcttgccaaaaacctttggacagtccaatgtcaacattgcccagcaagtggtaagcctcccgcaggagcggacagccgggatctcggtgtgaggtcgggatcggatgagccgtgtggttggggatgttcccaggtgtgcctggatttgggctccagttgcagcatggggcctttccctcatcagggagcccgtggccagtgctagattttccatagccctctgcagctgcccacgtgttgttgtgggagaggtgatggcgcccacagcactcctgtgtgccccagcccatgccatccttccagtaactggagggtggtgggtggggccgcggccccaaccagaggcagcttccttttagtgtcagagctcgaagctcttcatctaacaggggcttcttacgtgatgtggccgagcgttggctgtggccctcctggagacatcaggctgggaagccagagagggatagggccctggccgtggctgtgcgtttgccccggggcagtgacagggcagatgctgctcccttggccacgcacaggagaggggaaggtgggcattgggaagtggcgcatcccccctccccaggctgatgctggccaactgatgctgcttctcataatgctgtttcctgtctcgtgtccgccctctgcgtccttgccggtggcagcctactggagacagggagcccacacagaatcctgacctcaccagaaatggggccccaggcacttggtgggcaggtttggctgtgactggagctggtggtgagggacatagccatcacaaggctaggccgggcttccagtccttcctcagggacttgtttatggtgcctgagggctccttcctggtcctgagatgatgctgtggccccgcctgggcagctgccccagccctgttcctgccaaccctgggctttggtgatgcagcacctcttgcaccccggcctcctggcccactccaccccctcaccctgctccgtctgtgctgtggcccagtcctcttacaaggattgaacacctccgggtgggatgagaacctgtccgttcactgtcaccaggtgtctctcaggcatacccaggtgtcctcacgtgtctctcgggtgtcctcaggtgtctcccaggcatcctcacgtgtccccaggtgtccccaagtatctctcaggcatccccaggtgtcctcacgtgtctctcaggtgtcctcaggtatctctcacatgtccccacgtgtctctcagggtgtctctcaggtgtcctcaggtgtctctcagggtgtctctcacgtgtcctcaggtgtctctcagggtatctctcacgtgtcctcaggtgtctctcacttgtcctcagctgtttctcaggtgtctctcacatgtccccaggtgtctctcagggtatctctcacatgtcctcaggtgtctctcacgtgtcctcaggtgtctctcacgtgtcctcacgtgtttctcaggcgtctctcacgtgtcctcaggcgtctctcacgtgtcctcaggcgtctctcacgtgtcctcaggcgtctcacgtgtcctcaggtgtctctcacgtgtcctcaggtgtctctcacatgtcctcaggtgtctctcacgtgtcctcaggtgtttctcaggtgtctctcacgtgttctcaggtgtctctcacgtgtcctcaggtgtttctcaggtgtctctcacgtgtcctcaggtgtctctcacgtgtcctcaggtgtttctcaggtgtctctcacgtgtcttcaggcgtctctcacgtgtcctcaggcgtctctcacgtgtcctcaggcgtctctcacgtgtcctcaggcgtctctcacgtgtcctcaggtgtctctcaggcgtctctcacatgtcttcaggcgtctctcacgtgtcctcaggcgtctctcacgtgtcctcaggcgtctctcacgtgtcctcaggtgtctcacgcgtcctcaggtgtctcacgcgtcctcaggtgtctctcacgcgtcctcaggtgtctctcacgcgtcctcaggtgtctctcacatgtcctcaggtgtctctcacgtgtcctcaggtgtttctcaggcgtctctcacgtgtcctcaggcgtctctcacgtgtcctcaggtgtctctcacgtgtcctcaggtgtctctcacgtgtcctcaggtgtctctcacgcgtcctcaggtgtctctcacatgtcctcaggtgtctctcacgtgtcctcaggtgtttctcaggtgtctctcacgtgtcctcaggtgtctctcacgtgtcctcaggtgtctctcaggtgtccccaggtgtctctcatggatccccaggcatcctcaggtgtccctggccctgtggagagctctctgtactgagctgttttttgttgtctagggcatctccctttggtctaatcatgttttcttcagagaacatgaccacataccagggatattttggtcatttttgcactttagtctttattttatatgcattcctgctatttccgtttatttaaatatgcttgaaattctctggattctttaacagatgttaggatatgagttttaagagagagtggcttgtgggtcacagccttgaggatctgagcaggattgccttccccgcgctcccttccccgcgtcccacttccctgcgccccgcttccccgcagcccccctccccgtgtgtgctcccacacagctgtcctgattgagcggttccagatcccaggcagcttttgtggccccgtttcctgcctgtggaaggtgacaaaaaacttgctctgcagaagttttgtggccattgaaagtagcggtttgtggaagccctaccacgtcatacggcttttcaaccacgttgcacagcagatcacggcttttcagtaaatgccattttgataaaagctaaaaattcagtttttgttttgcttgataattagattataggtttgcttataagttgactaggaattctaagtttgattttataggtgctgtgtgtcatagcagagtttgtctgggtgaataattgtagcaccactttcgtctttactgccggtgtgaatacactggggggaaacgaatgagaagattatcttattgatgtgctttaaacttcgtcactgaaagtcaagttcctgatttaaattcagctgttcgggtggagtttgtcattgctgttttgtgctttgcaaaatcccagtgatgggaattaaagctgacaaagggcaaatgtttcttaaacctttttatataccagaggtttacaaaaaactggactggctcattctgacacgaggggtggggctcagtccgggcatgtgagtgaaagcggtggggaggtccttaggtctctgacctgcaccagtcagcaggcgcagggcttgtcaaggtcagggtcttttgaggtgcggatgcttgtgaagcctgtggtgctgcagagctcagcacgcgcacaggaacgtgtgcgggacagaggacatatgtgctcagccggcaggagcagcggcctgtgtgagcccctggggagaagcagccccccacccaggcctgtgtcccagaagtcggcatctgtggtcgcagtggcctttcctttgcagctgcgccactggccctgtctctctggacaccgcggttaaccttggtccatctctaggattctgtgtctgagtggggtcacactacacggagacatcgtaatctcagtttttagagtgtgtgaaattaaggtgcaaaaagtgtgcacttagggcagaagggatgccttaaatcaggagtccccaacccctgggcctgttaggaagctggccgcacagccgcctgagccctgcctcctgtcagatcccagcattaggttctcaggagcgcaaaccccactgtgaacggcacatgcaggatctaggtggcactccgtatgagaatcgaatgcctgatgatctgaggtgggacagtttcttcccgaaactacccccgactccggtctgtggaaaaactgtcttccacaaaactggtccctgataccaaaaaggtgggggatcgctgctttaaacaccaaggctcactgtgcagccagtgaggaggggagctcctgggggaggagggttggtctcgggcaaggtggacctccggcaggtcctctactgtgggatgcttccacctggagctgttttctaacgactgctggcgtggaagctgcaaaagctttagagtcgaaagactgtgtctgaagccgtgtaaagactgtctggagccgtgtaaagactgtgtctgaagctgtgtaaagactatgtctggagccgtgtaaagactgtgtctgaagccgtgtaaagactgtgtctgaagccgtgtaaagactgtctggagccgtgtaaagactgtctggagccgtgtagagactgtgtctgaagccgtgtaaagactgtgtctggagccgtgtaaagactgtgtctggagccatgtagactgtgtctgaagccatgtcatttactttctctgaagcgcagcttggattccagccgtgagcacagtaggaagggagaccccttatgacctgtggggcctgggtcacctcccctgctccccagcgagaggcgggtgagggagtcgtgagggcggagcccatcctccagagaagccgctgttaaatctaaggggtgggtgtccctggcgcctttcagcccctgcctgcctcctgctcccagaggctcctggatctcctggaaagccctggttggagtgggacccacagcctcccagctttgggcagtacccctcattgtgctgtgaccacttctcccttccagggtctctgcccaccactccagctagcgtggccactgcttccaatacctcctttttttccctaggggcccagctctgaactatccttcccggcactgtcccatccaccctttggcacctccttggttcctgttttccctgcgcttctgcccacacacgccctccagggcttcagtgtgttgccgtgcctcctctggctgttgagtgtggctcctggtgtagggaagtgaggccgggggcctgctccatgtctgttgaatgggagactggaaggcgtcctgtggcacaggcggccggcccgagttcaccggcttcctgtgcaccaggaaggaaacgcacacacctgtgccaggtccgggagcaaagcctctgtctcgttcctgggagggctggctccaggccgcccctgtgatgctgactcagctcacagggctggtgagcagcaggtgatgggtgaggagcagggacagtgctgcggagacacagtgaggggagctgccacgcagggcacgcagaggaaggtgcgggcacccttgcccagcactgcatgggccggatgccgcggggccttccgcagggagcagttaaagcaggagagtaaggagagcttcctgtaagacctggcctccgtaaacaacgcattcccagtgcactggtggctcgttctcagggtgcccctgggtgctgagtcctgtcttccaggaaaggttgttggtgagcaccattgagcacctggtgtgtacctgcctctggctttctcttcttcccaacttacagtgggtttgacctgtgattttgactttaagatggtccaaaagcaacatgcattcagtggaaactgcttccactgcccatacgaccgtcctatttttcattttgagtgtggtattcagtgggtctcctgggatacccacacttgactagagtgggctttgtgtgagatgcttctgcccgactgggctaacatgcgtgatctgagcacgtgtaaggtaggctggctaagctgtgatgtgtggtaggagaggtggatgacgtgcatttcgacttagggtattttcagctcatgcgggtttatcgggatgttccttgtaagttcctcgttgtaagtcagttcctcgttgtaagtccactctttgtgagtaggtttgctcctgcctggaggacagcggcacggtgacggcatctgttttggggccaagatccagtgccttgcgtggtcctgggattcctggggaagggagtggacccatgaggtgggttagaatcgtgtgtgggattctccagccccctgtacctgtgcgtgtggtatgcgcggagccagccagcactgcctggcgtggagctggcgggttctcagtctgacatcaactcccggagaatggcatctgctgaactcaacgcaggaagccgtgcggggccagcgcgctctcaggcagcctgagtggcagggtccttttgtcagctgtttggatctcccacgtggcccagtgccccagcagcacacacacacacacacacacacacacgcgtattgaacaaaacaagtttcacaggacatttatccacgcccaggagatttatcttttgtatggcttcattttgcagaaaattcacttgtttgatttcatggcctggtgatccacagaaggccgcactctgatgagtctctgatcatcggagagatgagtgtcaatgaaaagatcagtccttgaaatgtttttcttctccggagctgacaggtgatctggcctagggataattggaaagtgtccccgtcagctgctcccagggccaccgcaggtgatgcatttatccccgtaagaaggggagctgggggggcccagcttagagtagctcagggcatcggccacatgaagcccccccgccagcatacaggtgtccagctccaatccctttaacggaaactgcatgtccatacaagcagtataatcgctgaggcactttgatttgtggtgaattgaatgatttaacatttactgagaaatagtgtttccagtttagatagagtcgtgccacaagatctttgaaaagtcagagttgtatttgcctgtatgagggtgtccaggtattcacactcgaacattcattgttggaactaaagtggtaagaccttgtcaagagtcagaccagccagcatgtccctgaagggagagacagttgttgacaccctcaggtgtgctgtggggtggggcgggtgggtcagtgtccacactggcgttgcctctggtggttccccccagaggggcccaggtgtgtgagccccaggggcgtgtggagcccctaccttccgcccccagtgctggtggccctccctccttgcctgacgccgttgtgggtgcaggggttcccccagacagggccccagggcacagggttaccaggtgatggctgtcaccctgctgggctggaggagcagctgctgtcaccctgcctgtgcttttgtcttttgagagctgtttttggtttgtttcaggcctctttttagtaccacagaaggatacaatttcatcctcatccatatcactaaaaggaagtaaaagggtgaagggaaaaatggaagcgtgctcaagtgccctgtgtggaattctgtgccgcccccttcattaaacttgaccgttagcgccttgtgtgcggtttgggggtcacgctctgccctgtcctgttcttgcttgcttgggtcgtccgaagtttcttgttgcttttgtctaattggagaagatgcctgtgactgacaagaggaagatgagccacattcagaaccggtggggtgatgccgtcaccgtgacaaaagcgtccaccgctggacgtttttcctgctccgtcatggctgctcactgtggttaaggaaattcagcagtggctgcggatagcgaacagatggtgggcatggcaccctcgccgtgtgggaggggactgactgtctgaattgtctttttcgactgtaggtaattggtacgcctcagagaccggcagcgtcaaacaccctggtggtaggaagcccacacacccccagcactcactttgcctctcagaaccagccttccgactcctcaccttggtctgccgggtgagcacttccctctggacccttagagttgtaggactgcttgcggttcgcacctccacgttctcctgggccacgtgtgtcacacagtcgtgcgatggggctcccacgcgcgttgacgccagcctccgaatcacactcacccatcatcgtggcctgcacaggtgtgcagccgaggcgcactgcctcggtcatggagaagtcgggctgggcaccgcccaccccgctttgtgtctggtgtagtgggtgctctctgaagggctggcagctcttggccaagacggggagaagctggcctcgtactcgccacaggacctcggagactttccctcgtctgtgctgggagcatgtgggatggatttcacccactgcccctgaattcagcctctactgcccctggggttacggcccccgcgggtggtcccgccagagctgctccttccactaaagcaagatctgatgagctgtgtctttccttaaaaacacacacacgcaaagctgcaaaagcctgcctgtgttggtgcccaaagcttcaccagctaggaacctcaggtggcctttcccgccatgtggggactgaccagagtgtacagagttgggctttccctcgacctgaagcacacttagtgctttgcacctgttgtcaagcggctgtcacagcccaagctgtatgaaattacagcctgctgaaattagtcctaagaattcccaaatttacactgaaacgtcccatagttcctgattctggctgccctctttagaaaagtggtgcttggggctcacgcctgtaatcctagaggccgaggccagcagatcacgagttcaagagattgagaccatcctggccaacgtggtgcaaccccgtctctattaaaaatacaaaaaaattagccagatgtggtggcacgtgcctgtaatcccagctactcgggaggctgaggcaggagaatcgcttgaacccaggaggtggaggttgcagtgagccgagatggcgccaccgcactccagcccacgacagagcgagactccgtctcaaaaaagaaaaaacaacaacaaaaagaaaagtggtgcttggtgtaccggcacatctcccatatgctgatttgggtcctggggacgcctcccgttttccctgacgcttggaaggttagaggtgcagcctgctggggagacactcgctttctgacctgcaggaccactgggcctgggggctggggctagggggtcctggcctgctcacgtgttggatctgctgcgcccgtgggacgtggcccctttttgtgcagctcattagagctctcaggtaaaagcattcctcgattcaggctgatcctcaggagggctgacagtcgcttctcttttcctttgtattttgaaggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagtaagtgtgtgccgggggccgagaggctggggtggcggagcccagcggtgtggtacgtttcgctcttttaatatcgggaacagttaaaaccatacagaaaatgccaagtacagcataaaagaatttttaccaaacgagtcagtaagtgtgtgccggggccgagaggctggggtggcggagcccagcggtgtggtacgtttcgctcttttaatatcgggaacagttaaaaccatacagaaaatgccaagtacagcataaaagaatttttccgatccatttgctggcacgatgctttgtcaactccagtgagtgagcacgtgggctggctctgcacgtctagcggcccagaaatgcacaaatgcccacctcaccagctgggctcgacacccgagagcccccggctctccttctggaacacactcaggcttcgcacagccccgtcttgccctgcgtcatctgtggggtgggagcgctccctgagggcatgttggggtggcggctccgtgagcggggtgcccctttgagccagtgcccatggtctacagtttaaggatccaccggcctttttggatcatttggaaactccactccctgtcatccccaggcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtgccccttcagccttccttcaaccttgatttcccttcaagtccgtgtagatgttttagtcgtcggtcactcagaagggtctgggctccgtgcccttatgctctctgtgtccggctggcagacggtcatgcagacgtctccctgcgtttctcagtcttggctgtcaggggagggagcatggttggcccagacccactagagtctgttaaactctagtgtaggttaattctgaatcctagtttgtgggatttttgttttctttttagataccatagttaaatccaagaaatgagaggaaaggggagaaggtatagtttagaaatggaaaaaaaactcacctatatcttgtagcacctgctatgtctagatttgtccatatcccttcgattacattctgggtaaacataggtaacactgtgaggatgtgaggatgtgggttttaaaaaacgctctgtggaacagttgtgatgattcttcacatgggtggtttgtttttgaaggtggaaagacagaggagacttgaaagaataaaacagaaacagtctcaacttcaagaacttattctacaggtaagagaatacgtatctgtggaggcagggtaatttttattttactaatttagttttataacggcaacatactgccttgggttacactcctgcatggcaaatcaaatgactgctctaagattctgagtgtgagttcatctcataggtgttgaacgtgggccttattcccagagcgaggttgtgcacgtgcgtgtgcatgcatgtgtgtgtgtgcgtgcatgcatgcatgtgtgcgtgtgtgcatgtgcctgtgtgcgtgcgtgcgtgtgcctgtgtgcgtgtgcatgtgtgtgcgtgcatgtgcctgtgtgcgtgtgtgtgtgtgcatgtgtgcatacatgtgtatgtgtgtatctctcgtcacagcatctaaataggcaaaagacagatggagggatgacttcatgcaaaagcaacatttgaaaaatctcctcagaggtgcttaacccaaggcccaggtgccaggcaaggcctgtaaaactgtggtggacacagtgcacctgggtcttgacagtgctgatcagggccctggagctggccttccccacctcccattgagtgctgagggtgggcggcaccactgggggccccgtgtctggtgtggagggggttgtgtgcaaggtgctcactgcagagctggctgctgccctgaccaaggtgtgctcgagccctcccagaggggacggtgtggcagccgtggtgatggaggctcgtgggcaggagctcctcaggacccacagagtgtcaggagggacagtcctggttgccagtgccttaggacctgccaggtggggatagacccagggtggccgggagaggaagggaatctcctggctctacattaatagcaaagaaggtctctccaagtggaacacttggtttggggccctgaggccctggccctggattcagccttgcagggcccattcccccagaggagcacccctgcagcacatgggcccttctgcgttccactttccagggtgggcaaagtccacggcacggcaccccctccaaggccatcaccctgtaggtgccatggtggtaggtggtcttagaggggtgaaggacagcaaggaatcgacttccaaaattggtgttttgttgagcgccgttgccgtggaggacacttttatcagggcacggatggctgtgcgcccgctttcccttagttctcccctcaggatcccgtttcctgagcgcttttctccctgggctgcagaggtcagcacccagcggccggcgctggcatttcagatgtccaggccaactcctcgctgtcacgtggacgcagggagggctgtgaggacccctcgagcacaggggctgcgttcttgtgccgccacgggccacctggctcctcttattttttttagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaagtaggttgtgggcggggagctgttccctggtcacccatctcttttttagggagccgaccctgttggtattgtcactaggacaagttttaaatgttgtacaaatagcaaatgttgcacaaattgctgtccattggggggtggtgggaggctgccgccatgtggcagatggaaggtctctgttccgggagcgtgtgccttagggcatgtcctcctggggagaataggcctcgatttgcctctcatctcatttacttcagagtttataaattctgtgaggagacactgatgactgggaaccgggaagctgtgtgtggcggtcagcgggtcagccgtcctggctccaccccagtgtgtaccgtctccgctgggagaccctgtctttctgactgtgcctttccccttcagatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacaggtcagcaatgcccagacaacctggcgtggctgtgtgaggaatggcccccagcctccgacggtgccctcccctcccggctcgggatgtgtcttgctgagatcaggcccacgtgtgtagggccaggagcaaagacaaaggggctgtgagggggatgagggcaggggtgtggctggggtggggtccagccagtgccgtgacccactggatatgggggccttgagtccacaggtggctcgtgtggatttcctatgtggtttgtgtgaggaggtgctaagtcaggattttaccctccaagtaggcccagaagtagaagttgagattctttgagaagtgcagttggattgctgatcccacccactgatggtagctgattggtcactagggcaaagtcaccaagaaaaagcatttcagagtcattggcgtcctgctccggagggccgggagcacaggagcttttgttgaaggagctttttttctgttctggtgaattctttccttgggggccgtagggtcccagccactgacagcaggatggctttaaggtgagaaattgtgaaggtgtcatatctgctgatccttctcttgttagcctaaacttggggtgtagatttattccctgagagggtcagagattcctccctgagctcttagactgccccagatcttgtgaaaatctggctggtccatgttgtcaggtgacagtgggctctggccgcccacgtgggctgggccctgaccccggcctctgtcccgtgcttcatggagctgccaggatgggctgtgggaagagggtttcagcttgacactttgattcggttccgtttcacgatgggtatgatactgaggcagcagcacacgtgtgccgtttgtaagtcagtgtgtgcaggtatttattgcaaggctgttcttgcctttttagagaagacaggcttatgtgactgcacagcgggatgtcctgctccgtggcgcagtgtggaaaatactggacaagcgaaggatatccggaagcttctacagccgtctgtcctgtggaactgcgcgtcattttgttggttgcctgtgcgtcttgtgttgtttctgtttcatgaccattcgcttattttctttcccttttcagaaatggctcagggaactgttggaggcgtgttcatcacgacggcaggttccacgtctaacggcacaaggttctctgccaggtgacagtcgttgagggtgtgggagaggcgtcatctgggcctcccccggggtccaggggccaaggcagggcagccgtctcaggtgtggccatcaggtctgtggctgctctgacgtggcttgtctgtccaggcagtggggccccgctggctttccctgtgtggagagctgcttttcttagttggtttctgctcactaaaaactgaaagtaatacatggtggtttttttttcatagtatcacctaataagtaaagtaggaatgaaaaccacccaaatcctcctgtccccggcagcccaagtaacagcaagtatttccaggttttttttcccatttttcagaacgcgtctgcggtcacagcgcacgtatttttcagaacgcgtctgcggtctgggcgcaagtagttttcagaacgtgtctgcgatcacagcacacatttttcagaacgcatctgcggtcatggtgcatgtgtttttcagaatgcatctatggtcatagcgcatgtatttttcagaacgtctgccatcacggcgcacgtgtttttcagaacgcgtctgcggtctcggcgcacgtgctgcgatcacagtgcatgtatttttgcgaacgcgtctgtgattatggtacacgtatttttcagaacgcgtctgcaatcacagcgcacgtatttttcagaacgcgtctgtggtcacagcacacatattttgttccgtgcatttttcagcttacattttattgtatgaatatatattgtttctatgctattaaagggcctttatttaaataaatttgtatttaatctttgacctgcaatcccacagagtagaatggtgtccctaggtattgatcttagtgcttcaaagataaatataacttttatggtaaatattaacaaaacaatgattttattaacttttatattgcattgtgatacaatatatagtattactttatattaatcttaagtgttaataaaatctttaattagaaatacaagaactcagtaacctatgggtccgggtaacagggctcgacatagtgagtttcagtgtgcttgagcctgcgttgggatgtgctgtggccatgagatgtaacaggtgtgtcgggcacgtgtagcttcctggccagctctggaagtgcaaagccagccttggcctcctcacctgtaaggtgagactggtgattgatgagttactgatctgtggcaaggatcagtgaggtggtgatggaagaaaggactttggtgacaagcttttgacagaggccggttctccttctgttgtagctatgtgtgaacgtgtggcggtcagtctgtaaacatgtttaatgctgcttcttccatgaggtgggatgtgggtatttttaggacttttatcatcacataatcctttttatggatgtgattcttcagacttgtcagtttttcataacaatggaaacaaagctattaccatttcttacgaaataccgattttcatagtggcatgatgagacattttatacaagtacctcatgaaaggacatctaggtagttcccagttagaataaaaactgcagtgagcagctttacagctgaatttctcgccatttctgacttgtttccaagatacagaattacttcatcaaaaggcacattaacacatttttattgtagtgttaataaataccattaaaatgtattaaaatatgtacatatggttttatgttaattgaaaacatctttaaacattaggaacgtagtgagctctggttggtggtaggtttttgtggtgctgccagccctctgggttctcagtccccgctgccagattcgacccacgctctggactccatcctgtcctgccccgggctctcttttttcctgttgctggttatgagtgaaagtcccggagggagggatctaatggttttacagtttgttccctctggggcactgctcctgatggaatgatgagtgagggagaggcagcgtgtggctctgctcagcctcctgtttctgtcgttatgggttccaggagacagggccagaagagaaccagacagagatggagtaagtgccagagcgttggcgtgctgtagtgcagacactcagcctccccgttctgtttgtgtgactgacaaaacccacacctgtggggcacagcctgtcatttgaccacaagccctgaggcggggggaggctgggtgggccgcctgcactgacggcgccatccgcctcctgccttgcagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcacagttgctattagctgcctgttctaaaacgatagtctttttattgaaacacaaataaacttttctgtaatattttatggtatataaagagactttaattgtttgacttgtttaacttggcactgttagtttttattaataaaacgcgcatgggcattttaaacaagctgtgtttctctaattcaggattattatctagaaatttgtctgtcttgttggttttactttatacttgagtgagaaagtaggttgttaggcccagacgcggtgggcccgggtggtccctgtgggtgcaaaccccaccaccacatgttgtctgaggcacatcctccgggagcccaccctgaaaaggtggaaggtggccaagggtggaggtcttggtggacacagggcaaagaggcaccttccttttcggtgcctgtggtgcagagaaagataagccaagttccttggccttttttcacaatgaaaattgagacaaaatttaaaagtttgactttgagaacaagaataagattgagaggattctgggaagatggtggaatagggagcaccaggaatctggctgcccaggtagatgtctacctcgcgggcaggatctgcctgatgcagctgttctgtaactacggaatctactgaaggcttaaagctttcaagggaggcttggtcagcacattgcagttaattttggtccatttcagctttctaccccgacctctgttccttcatttttctctttccccttttgggagccagacattgaagactaggacgtataaaaacaactgtgttgtatatatggggctgcccagggagaggctcagaaaagacccgagaagaccttacgtttacacctcaggctgaaccatggcacaggtacagcctagagctgtcaaaaaagcaataaacacagcaataacaaaaatggcaaatccgggggaacaggagacttcttttcagagttgtaccacagtaatagattcagatgtccagttttcaacaaacagtgacaaggcataccaagaaatggcaaagtatggcccatttaaagggaaaaaaataaaaacaaactgtccttgaaaaggatctgttggcaggtacactagacaaatacttttaaataactgtgttaaagatgctcacggaagccaaagaacatgtgcagaaagtcaagagaatgaaaatagaaccaaatgcaaggatcataatgaggcagacaacctgaaaaaccaacaagaaattctgtagctgaaaagtacagcaactgaaatgaaaaattcatcagagtgattcaaaggcagaagtagcaaatttgaagacaggacagtggaaataactgagtctgaggagcaaaaagagaaaaga

SEQ ID NO: 14680 - DNA, 16578 bp, Human
agccggcttaggtgctgctttaaaactcctaggcctggagggaagcagtggggtgctgggcttggcaggaagagggggtttcatatttctggtagatgtccgagtttccccagagcttcccaggacctggggtgaaagggagggaggctgtgggaacagcagctccgggatgcgtgggcttcactgaggtggaggctgctccctcgcagtgcctgctgcagcctagagcccccaggcggtgaggtctgagggggttggggggccagggcgcaggaggcaggataggagggggttgaaaaaggggtccaaacttggtgaggggaccttgggactttggaggcctggttatggcagcttctgtgatgaggggagtggcctgggtggtgttgaactaagataggactggctgcaccttgctaagccaaagatgtgagggtgtgtgtgtgtgtgtgtgtgtgtgtgtgtgtgtgcacgcatgcgcagatgtgcatgtctgcactgtgtgtgtccgtatgtctgtgtagcatgtgtgactctgggcatgtatgcatgtgtgtacatatgcgtgtgtctctctgtgtttgtgtgtaactgtgtgtgtgtctgctagtgtgtcttgtgtacctgcttgtatgcctctgtgtgtgagttcgtatgtttgcattgtgtgtgacggtacatatctctgtgtttgtgtgagtgtctacgcatctgtgtagtatgtgtctgtcagtgtctcttcgtgtctctggacttttttgagtgtctaagtgtgtgtctttttttttttttttgagacagagtcttgctatgtcactaggctggagtgcagtggcacgatctcagctcactgcaacctccgcctcctgggttcaagcgattctcctgcctcagcctcccgagtagctgggatttttgtatgtttagtagagacggggtttcaccacgttggccaggatggtctcgatcttctgacctcatgatctgcctgcctcggcctcccaaagtgctgggattacaggcttgagccatcgtgcccggccaagtgtgtgtctttatatgagtttgtgtgcccgtgtggtctttgtgtgggtcagtggatctctgtgtgtgtgactatccaagtgtgtgtctctgtgtgtgtgcgtgtgtctgtatgtttctgtgcttgtctgtgtgagtgtgcgctgtgactgtgtttgtgtgtgactgggtatgtgtctgtgtctgtgtgccactgcgtgtgtgtgtgtgtgtgtgtgtgtgtgtgtgtttattattcagtgtgattgcggaacttgagtcttggccttgagctctgtttgaaaggagtgttgcagggtaactgcaaaggggccgatgggaaaggcctgggggtgtgggggtggatgaggcccatgctttctccaaagctgctggttgggtgcttgttaaactcctttgtgtatgctctgtggctgctcctagcaccagcctgctcactcaggccttcacaacagcaccaatagtaactttgctgcttctgaggcattgcgaaagtctgtgtttgtatgcaggaaccctgggcaggagggtgtatccttgggtgcatttggggggcgttgggactacactgaccccagaggtctgctgcattctacaagtagtgactgagtgggctaggaggtccccctgttgacttctaagtgatgtaacaattagagacaattgtaccccattgcctggtgccacctgccctgccccgtcctgtccctcctatccctcctgtccctcctgtccttcctgccacctcctgccaggctggctctgggaagtgggtgaaaggagatgccaaggccaacacgtgggcctctggccacctcccaggggtggtgcccctctgtgacacctggtacttgggtatgaggaagggatggcttagctgcccagagaaggtggcaggtgggccaggagagacggacagcctgctgaccaccaggctccattctgtcccctccccaggcagcagccacattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaactgcaatgggagttccaggccagcaacagcgagacctcttggttcccctccatcctcacggctgtgctccacatggcaggtgagcggcctagggaggggccgatgagaaagtcctaggggttgcggggaagccacaacctccctggccttctgattccctctctctgaggccacaggctttgcctcctgggtgaattcctaaggtttcaccagatttcaccaggggcccctggctggaatccagctggactgggctggagccggggagagagtggggaggtgcctgggttgcaaagccaggcggagccttgcgtcctttctgtgggatccattccgacacaggcgtaggtgtgctggggcgctcagtgccaggctgggaagagcgctggggccagcccaccaagactctcctgctttccagctggctggtctctctgaacctcggttgcttcctctgcaatctgagggtgatgcccggcatcctgcccagctcccacatggaatagcagggaagaccactgtcttccctggaggtgctgggagctgggaaatgtatgcggctgtgaattattaatattttggagaccctcactagggcagggagtggcttcaggataggaaaggggacgcaaggaagacaccaggaatggccgggcgcgatggctcacgcctgtaatcccagcactttgggaggccgaggcggtcagatcacctgaggtcgggagtttgagaccagcctgaccaacatggagaaaccctgtctctactgaaaatacaaaattagctgggcgtggtggcgggtgcctgtaatcccagctactcaggaggctgaggcaggagaatctcttcaacccaggaggcagaggttgcggtgagctgagatggtgccattgcactccagcctgggcaacaagagtgaaactgtctcaaaaaaaaaaaaaaagacaccaggaacaagagggggacaaggcaggagccccagctctcccgggactccctgcagagaggaggttgctaagtgggggtgagggaggaaggcagcccctgtctgccccttctcctggctctgtcaccataggcctcagaggcccatgttcctggctggcttttccaggagtgtgactgcctcaccctgaccccagcgttgggagcagggcagagggagggttctctgcagtcgccgtggacacagggacctgccctcagctcctgggagctctccagggagactgcagagaccccggcctcggaggggcccggtggacagcagcccgagctgatggcccacaggcctctgcaggcatgtgtctgctggccgcagctgcccatctccccggctacctcctggctactccctccacttgccaccagcagcctgcctattattccaggtcctgccctcaaactgggagggaggtgaggctcggagaaagcgccaccctcctgggtgagctctgaatctgccacatggcctctggcctgcagggttggggcagggagtgggaatcccagagggctgcttctcacacaggcagagcagggttcctgggccaggggctaggaaccgggcacccggcggggaacctactccccagctgacttgcggctcaccacccccagcaggcatctcagcatctccatcagcatgagattcctggctggccatctctctcatgtacacatacacgtgtatgagcccgtgctcattcagagtactgtagacattttattttatgtttatttatttatttgcttatttttgagacagagtctcactctgtcacctgggctggagtgcagtggcatgatcacagcctattgcagccttaacctctcaagctcaagcgatcctgccacctcagcctcccgagtagctgggaccacaggtgtgcaccaccacacccagctaattttttttttttttagatggagtctcgctctgttgcccaggctggagtgcagtggtgcaatctcagctcgctgtaacctccgcctcccaggttcaagcgattctcctgcctcagcctcctgagtagctgggactacaggtgcgcaccaccatgcctggctaattttttgtatttttagtagagacggggtttcaccgtgttagccaggatggtctcgatctcctgacctcatgatctgctggccttggcctcccaaagtgctgggattacaggtgtgagccaccacgcccagaccatacccagctaatttttttactttttgtagagacggggtctcactatgttgctcaggctggtctcaaactcctgggctcaagtgatctacctgcctgggcctctcaaaatgctgggattacagacatgagccacggcacttgaccacagtattgtagaaatttttaaacacgatgaatcatggatactttcactgatcctttcaagtgcccctgcccctacctacgccttttagaggtaaggaaagcaagcaggcacagaacacaagacctgcccaaggctgaagagtgagttcacggcagaggaaacaccctgtgtcccgcccggccacaccaccctcagctatgcagctctggcctgcagcccagtccccacccccacccctgtgactaagggctttccccaatgtcaacttccctaagtcaggccagagtctctggcgtgaggaagctctgtgggtcagtcctctccagagccacctccccctctacaggggcagagacgccgggccaccagcctctgcttgattatgtctgcgacgggctgctcacttagtctgtcactttcttttttcttttttttttttttcggagatggagcctccctctctcacccaggctggagtgtagtggcacagtctcggctcactgcaacctccacctcccgggttcaagcgattctcctgcctcagcctccctagtagctgggaattacaggcatgcgccaccacacccggctaatttttgtatttttagtagagatggggttttaccatgttagccaggctggtctcgaactcctgacttcaggcgatccacctgcctcggcctcccaaagtgctgggattacaggcgtgagccaccacgcatggccactccatcacttttttttttttttttttttttttgagatgtagtttcactctgtcgcccaggatggagcgcatcgggttctgcctcccaggttcaagcgattctcctgcctcagcctcccaagtagctgggattacaggcacgcaccaccatgcctggctaatttttgtatttttagtagagatggggtttcaccatgttggtcaggctggtctcgaactcctgaccttaagtgatccacccacctcggcctcccaaagtactgggattacaggcgtgagccaccacacccagcctactctgtcacttttatactcacactggctcacaccacacatcccccctccaccgcagacacacacaagcatctcatgcgcacacacttccctgtccctttagttgcactctcggagagtaagttagagaagctccacatgtgcttgggtgaatggggcccctgtgaggtgccaaggagcagtctgcagctcttttctatttttttggggtgtggattggtgagaaagcagctgggagccaggcaaggaacaggcccccctccacattgagccaaacctctaggtgcagactttggtggtgctggaggtggtgtgggaggggagaacctaccctgcctgattgtctgcagaggccagtgcaaggaggcgcagaggggcccagggttcccctcagctgtagggctgggaaggtggtgggagggtgggagggatctagccagtcttcctgaggatgttgggtgtggggatggggcaggtaaaacaggatctgaaggtgcacactgtaatctagatgtcctggaacactgccccgactcctcccaccaacagacccccagcgaagtgggggaggtaaactcatgaaccaatcctgtttcacccggatagaatgagcagcctcaggtctgtgtagttcagggtcttgctccacctttcagggaatcctcatcagggtcaaacatcgcccattctgaatccttactttgtaggggaaaaaattgaggcacggagagggatcaggctttgctcaggccacatggccagtccatggcaggtgggtatcagaatccaggcctgctcgtgcccttgaaaccacctggctagttccagctggaactgccctctccagccactctcctctcccgccacctcctcattcagctgctacctgctggctgtcttctcccacagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggtgactatcacttcatctccagaatttataggcacctgctagaaagtgccaggcacaagtggacagggcaggcaggcctcttaatcttctggaactgctggctgggtgcggtggctcacacctgttatcctagcactttgggaggctgaggcgggcagatcacctgaggtcaggggttcgagactagcccggccaacatggtgaaaccctgtctatactaaaaaaaatacaaaaattagccaggcttggtggcgggcccctgtagtcccagctactcgaggctgaggcaggagaatcgcccgggaagtggaggttgcagtgagccaagatcgcaccactgtactccagcctgggcaacagagcaagaccccatctcaaaaacacaaaaaacaaagtgctgggattacaggtgtgagcccatcatgcccagccctttcacggcattttgttttaaggggactggaggaacagactatacccagaagtggttatgaggtcaagacaggctttttttgtttgtttgtttgtttgtttttaatgggagaaataacgaaggagaaggatctaggaaagaagaaaaaaaggatgatgcaggagagaggggacttgctagaggggtgcctctgagtggagaggatgcagggcagaagggagggacagccactgggggaatgggcaagccattgtcactggctagcaggcatgtgggcagctgagcataaggatggggaggaggtgttggggggcacagaggaagacaccggtagtcacctagcagggcaggcaaggcatgattgagggagctgtagtggcgtcacaggcagcctgagggcccgcctgaggccacggtcacacatgattgagaactttttctccagcatgctcaggtgtgcaggtgcagacactgagtgggtggggagcggggaaggcccctctggagaggtggcgtctgaactgagaggagagtggaaagtctggaggaagcagattccaagaaggaacagcagctacaaataacccgaggtaggggcagcttcatgtccagaggcagagaaagaagttcctgtgtcttgatcctaatgagtgacagggagcagcctgagatggcatctgagaggcgggctggagccggaccacagagagccttccagggcattgtggagactgtggattttttgtcaagtgtgatgggaagtctttggaaggtgttaagccaagagagacttaatccaatttggggtttgtttgtttttgagacagagtctcactctgttgcccaggctggagtgcagtggcacaatctcagctcactgcaacctccacaacctcagctcactgcaacctccacttcccgggttcaagtgattctcctgactcagcctcctaggtagctattacagactacaggcgcctgccactaagcctggctaatttttttgtatttttagtagagatggggtttcaccatgttggtctcgaactcctgacctcaagtgatccgccaaccttggcctcccaaagtgctgggattacaggcgtgagccaccgcgcccggcccaatttgggtttttaaaagataactctcgtgctacacctaggggaacagggatgccctggcagccttgggagggcagatctggggtggggtgcctacagggaggtggcgaggccagctgattccatggtcagtccccagggacttggagctgggtatggactagaaccagaggagggcaggtgtgtgaaatgaccactgaccccacccctgggtgcaggtggaaggccccagtgcgcctccaggctggtttcccctcttgccccgcaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgctaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacacaggctactgcgtgtacatactgggtgtgatgtggtccgtcctgggcttcccactgccacaagtcttcctggtgccatatgccatgtggcacagcgtggacgagcagcaggcagccctcctcatctccatcatcggcttcagcaacatcttcctgaggcccctagccgggctgatggcaggacggccggcctttgctagccaccgcaagtacctgttcagcctggcactcctgctcaatgggctcactaacctggtgtgtgcggcatcaggtgacttctgggtgctcgtgggctactgcctggcgtacagcgtgtccatgagtggcatcggcgccctcatcttccaggttctcatggacatcgtccccatggatcagttccccagagccctgggactcttcactgtcctggacggccttgctttcctcatctccccaccactggccggtgaggagctgggagggagggcagccagatagtgtggtaaaaggggaacagtttagacagatctgggcccagtccagcatctccagaggttgtgctacagctggtttccaacctggcactcagagtatgaacagttaaaaacatgggtttggccgggcgcggtggctcatgcctgtaatcccagcactttgggaggccggggcgggcagatcatgaggtcaggagatcgagaccatcctggccaacatggtgaaaccccgtctctactaaaaatacaaaaaaattagttgggcgttgtgatgggcgcctgtagtcccagctactcgggaagctgaggcaggagaatggcatgaacacaggaggcagagcttgcagtgagctgagattgcgccactgcactccaggctgggcaacaaagcaagactccgcctcaaaaagaaaaaaaaaaaagcatgggtttgtgaccaggtgcggtggctcacgcctgtaatcccagcactttgggaggctgaggcgggtggatcacgaggtcaggagatcgagaccaacatggctaacgtggtgaaaccccatctctactaaaaatacaaaaaaattagctgggtgtggtggcgggcacctgtaaatcccagctactcgggaggctgacaccagagaatcgtttgaacccaggaggcagaggttgcagtgagctgagatcacgccactgcactccagcctgggtgacagagtgagactccatctgaaaaaaaaaaaaaaaaaaaaaaagcatgggtttgtgtaccaaacctcagtcctccatcatcctccctgtacctcctttttcctttttgttgagacaaggtcttgctctgtcactcaggctggagtgcagtggtgcaatcacagctcactgcagcctcaacctgccagactcaagtgatcttcccacctcagccccccaagtagctgggactgcaggcacatgccaccacacccagctaatttttatattttttatagaaatggggtttcaccatgttgctcaggctgctctcaaacccctaggctcaagtgatctgcctccctcagcctcccaaagtgctgggattacaggtgtgagccattgcgcctggccacttcctttttcctatcagtaaagtggggataaatagaatctacctccaaggaaagagcttaggagagagtctggtgtgcagtcagcatcctgcagagtttcctgtaatgatcatcccagttctcctgcttcctgcctgtgggacccaggcaagtctttttccctttttgagccacagtgccatctgcaaaatgcggacgagagcacctgccctaatcatttattcacctctgccagcctctgggtgtgcatggggatcaaaaggtctccattcccagcctgaccaacatggtgaaaccccatctctactaaaaatacaaaaaattagccgggtgtggtggtgtgcgtctataatcccagttacttgggaggctgaggcaggagaattgcttaaacccaggaggtggaggttacagtgaaccaagatcacaccactgcactccagcctgggcgacagagtgaaactccaactcgaaaaaaaataaaaggtccccatcccctgggggattaccttctagggcaggagtcaggagtgaaaacaaagagacacatcagcaaccatcctggtgatttatgatgcgagggaaaccaaatagggaagtagaggtgcacgtgagaggcagctgaagagtgtgagattctgagcaaatgagggcaggtttgtaaagccctcggtaccggggagcagtcagacaacacaaggcggcggttattagagtagatccgggaggttgagttcagcccaatggggactccgtccaagtgtggcgttggaaggcccagtttccaagggaattcttttttctttttttttttttgaggcagagtctcgctctgtcatccaggctggagtgcaatggtgtgatctcagctcactacaacctctgcctcccaggttcaagcaattttcctgcctcctcttccctagtagctgggattacaggcacgcgccacacgcccggctaatttttttttttgagacagagtctcgctctattgccaggctggagtgcagtggcgtgatctcagctcactgcaacctctgcctcctgggttcaagcaatcctcctgcctcagcctccagagtagctgggactacaggtgcgtgccaccacactcggctaatttttgtatttttagtagagatggggtttcactgtattggccaggctgttctcgaactcctgacctcgtgatctgccggcctcggcctcccagagtgctgggattacaggtgtgagccaccgctccctgccttagtttttgtatttttagtggagacagggtttcaccatgttggccaggctggtctcgaactcctgacctcgtgatccacctgcctcagcctcctaaagtgctgggattacaggcgtgagccactgtgcccatccaagggaattcttttttttttttttttaatggagtctcactctgttgcccagactggagtgcagtggtacgatcttggttcactgcaacctctgccatccaggttcaagtgattctcctacctcagcctctcaagtagctgggattacaggcacctgcccccacacctgtctaatttttgtagttttggtaggaacagggtttcaccatcttggccaggctggtcttgaactcctgaccttgtgatctacccacctcagcctcccaaagtgctgggattacaggcgtgagccaccgtgtcaggccccaagggaattctttaagcaaacaagtggggagagctcttcagaaggaggcataggtgagacctggagggtgggtgagcaaatatcccagactccactagttccctaccaccacatgcccttaagttctcttgcagcctgaggactcttcctgcccaggccagaggaggttgtgtttcttcccctcctttcattcttcaagtatctgttgagtgtctactgggtgtcagccacaattcctagtacagcagagacaaaaataaaatacctgctgtcagggaacacacagctgagttggggggaggcctggtagcactggcctaacttgatctctgttccccagggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcatgtatgtaaccagcgtctaagacccagggttcatctgtgtgaccagtgtctgagtcctgggatcactgagtgaacactgtctcagcccagcccaggagggggacctctagctccttcaccaggggcttgggtgaagagtagcccaggaagcccgggctgtccaggctctgcaagctgggactctgccaggagctgggactttggaggctggcctctgaagatgccctgagaaactctttttttttttttttttttttgaggcggagtttcacttttgttgcccaggctggagtgcagtggcaccatctcggctcactgcaacctctgcctcccaagttcaagggattctcctgcctctgccccccaagttcaagcgattctcctgcctctgccccccaagtagctgagattacaggcatgcgccaccactcccggctaattttgtcttttagtagagatggggtttctctatgttggtcaggctggtctccaacttccgacctcaggtgatctgcccacctcagcctcccaaagtgctgggattacaggcgtgagccaccgtgcccagccagaggaacccttttctaacaactagcggaatccaggagcaggccctccggacttttttccttgggtaccagggtactcggggcccaggaacctgggtctgagccctgctcaggtttgtcccagccggctcagcgcagctggctgtgtgttgctgctcctacagctcaatgcactggaccttctcgtccagcctggatgcctctatcatttctctttgtctttctctggcctccataccgttctgaagagctcaccttcctctaggttcctcctgccctgctcttcccaagtgacccagccctcacctgtagggcagccaaggctggtggtgcagctgcccccagtgaaggtcattgggcctcgcactgggcagtgcagaggtccaggctgaggagttgagtggcgcgcccatcctggcgcctgtgcagagaacgggaggggggcccctggcttggatcctagaatcggtgaagtctgagggcccccctgcagtctcagcaggacctgctctatcaaggggcttcctccttcctttccccaccctgtctccttggcggggaggattagtgccaggtgggggaagccagacatttgactgacgggagaggaaggcttgccaggcagcccgaagactgttgtgaaaatggggctgcttttgcaagggaagctcttttactccccattcctgtcctccagaggccccccttttccctgccgtgttattggtgtcaaccctggggtaagtggctggctggactcacccctgctccccgtacacctgtgcctgtgactggcggtccaagctccccacacacacatcttgctggtgcctttccctgaagtcaccacccaggggctggctgtcatcagcccattcttgtcccagcagggtaccgagggaatgataaaacagaatgtgtttgaattacacacaaaaatgttccctgcagcaggtcataaactctgtgaactaatgaagctgacaaacagagctggagtacgtttcccctcacccttcctttcctcctagctcagcaaggggtgctcaggttcaggatgttgtttgttgattcaggctcaaccaggctccgcaagaaaaccttatcaggagattttattttcatgaacaggtgccagtcttcccgccagccacgtccagctggcgtcaataagcatctttggggatgtcctgcctcctccaggaccagccatgagtggctcttatggccaaaggcggtactgcaggccaagcaaacggctctgggctggaatagccctacctgagtgccctgtttgactccgccactatctgccatgtgagttgggcaaattgttgaccacctctgagccttgaaaaagtaggaggttactttgttagagcaaaataataaaatttaattttaaaaaagaaaacgtaggaggttcgtttggatgagctagtctcttccggttgaaaagtctgactcggtgagcatcctgacgactccatttccttctggctccccacccagtcttacacttggctgccatcaataccacatgctctgaagggagagtgcttgcatgtactttgccaaatcctgtctgctccatctcagttgaatggaaaaggagggaggtggggctggtagataggtgcttttggtgctagtatccaccaggttttgtgtgcatcccgtaatgagcccacttcctgaaaacatttaaagaaaaaagatatcagctggagatggcagtgcgcacatgtaatcccagctactcgggaggttgaggtgggaggatcactcaaacctgggagtttgaggccagcctgggcaacacagcaagaccctgtcttttttaaaaaaaaaaaaaaaaaaaaaggctgggtgtggtggctcacgcctgtaatcccagcactttgagaggccaagatgggtgggtcactagaggtcaggagttcaagaccagcctggccaacatggcaaaaccccagctctactaaaaatacaaaaattagccaggcgtggtagcagtcgcctgtaatcccagctacttgggaggctgaggcaggaaatttgcttgaactggagaggaagaggttgtggtgagctgggatcacgccactgcactacagcctgggtgatggaatgagactcgtctcaaaaaacaaacaaacaaaaaaaacactttgggaggtcagagcaggaggatcgcttgagaccaggacttcaagaccagcctgggcaacatagagaccctgtctctacagaaaaattaaggaaagggaaaaaaaaaaagccaagtgtggtggatcatgcctgtaatcccaacactttggaaggccaagatgggagaatcacttgagaggccaccctgggccacataaggagacctccatctctacaaaaaatttaaaacttagctggacatggtggcacaggcctgtagtccaagccactcaggaggcagaggtgggaggatcccttgagccaagaagctcaaggttgcagtaagctgtgatcacaccactgcactccagcctgggtgacagagaccttgtccccccttcccaaaaaaaaaaaaggtatcaatgaatgttctgcataggaaactttcatctcacctgctcctaggcaagaatagcaatcatctctgggcagaattccttcaataaatatttactgagtatctactgtgtgccagagactgggcagaggtaagacctaccaagggctgagaattccaccccaaggagggcccctccctgaggccttaagaagggagaagactggctgggtgcggtggctcatgcctgtaatcccagcactttgggaggctgagacaggtggatcacgaggtcaagatatcgagaccatcctggccaacaaggtgaaaccccatctctgctaaaaatacaaaaattaggccgggcgcagtggctcacgcctgtaatcccagcactttgggaggccaaggcgggtggatcacgaggtcaggagatcgagaccatcctggctaacacggtgaaacctcgtctctattaaaaatacaaacattagccgggcgtcgtggcgggtgcctgtagtcccagctattcaggaggctgaggcaggagaatggcgtgaacctgggaggcggagcttccagtgagctgagatcgcaccactgcactccaacccgggtgacagagcgagacactgtctcagaaaaaaaatacaaaaattagctgggtgcagtggtgcgtgcctgtaatcccagctactcgggaggctgaggcaggagaatcacttgaatctgaggcggaggttgtagtgagccgagatcgcaccactgtactccagcctggcgacagagcgagactccatctcaaaaagaaaaaaagggagaagaccaatgagggaagatggggtggcccatctgattcagcaatccc

SEQ ID NO: 14681 - DNA, 41618 bp, Human
atattacccagtcatatatgtatacacacacatagaaaattacacggcagattacttacagtagcgtgagagaatttttgagtgggtgggattctttacagcaagtttttttttttttgcttctttgaattttttttactcttttaggtttttatatttataaaagttatatttactttttaaaagtgtcaaccttaatattgagattcagaaatatgattacatatagtgtgtatttgagcacagagcctgagaatggccacctggacaaatggggtcagcctttccaagtggagctcaggtctctcttaccaggcggagacagaagctccagcaggatcaccacagttctcatatgagaccaggggcacacgccgcagcggttccattggttagggatctctgtatttgaaggaagattgcgttataactccatgaggaggggtagtgatctgagggggtcttatctccggtgccatttggtctttattgtttacagggaaaaaggcagaagttacagctgggtgtggcatgacctaggccgcgtagccacattcccctcaaggctcaggtaattcaaagttccaacagcttcaagtttaaattattttaagtttgaatgatttaatttcacaaaaggtaatatatgcacattgactgaaattcaaaagcacaaaaagatatccaaggaagtacctctcccacttctaccatctctcatcttccagcactccttccagaggccttgcgctatgccggttttctcatttttccttcctgggacagtttagggatttttctacctatcattaaattcgtattttactcaaatgcaggcatacgataaacacgatcctatacttgctttttcccacatactatatcttgaagatcgttcaatgtccatgcaaagctgactgttcttttgaacagccagcgagtattccattacgtgagcgtatcatgacctatttactcagttccatacttcatgggtgtttaaattgtctgcaatcttttgctattacaaacgaaaccacaggtcattttgcacacatgcaaaaatgcaaatccatggtatatttcccaaaataaaaatcattaggtttaacagcacgaacacctttaaatttggaagatattccaattcgttcatcctagagagtataccaataccactcacaaaacttgagggtgcctgcttcccgacattcctgctagcagtgtcatcaacctttgtgatctttgttaacatatgaaaagtggtactctaattttaatttttattatgaattaagttggactttctttcgtatgttaaagtctatttgcatttctttccctgtgaactgttttttgcctgtctttctcctgagccattggtctcttcccactgacttattacatatatgtaaagggaatattggctctacattataaggaaattcgaattttgtgataggtttcaaatttttccctaggttgtctttgacttcatttgctgtttgtgcacacaattttttttttttgtaatgagagtgcgttgctcttatttttaaaatgttgactacattctggggaaagaaggctcagcagccacctgcttttttgcccgggtgggtggtccggccccgagccctcctgactctctcgccaatgcccagaggcgccgcagcgattccagggaggccgcgctctcgccccaaggcaaccagaagcccacgtgccaggagaggcatcggaaccaacaactcgggtccgttttcccgcgccagatgggattcgtttgctgtggacttccggggcggggcctgcctggagcggaagagcctgggcagtgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccaggtgggcggccccgactcggggtgcggggcccaggcctcgccgggtctttttccgcgcggcgtggggctggggtgactgttgtcggggctcttggtggggaaggactgggccggccctgggccttcatctggggccagcagcgctgtctccgcctcgcccagaagggagcggtccctgcagctgggaggggcacagcccggggagtggaggcccccgagcgcacggggcgcctcagtcgggtctgagcctcgttctgcacctggcgcggaggaggtgcccaggaaacactgactactcagtgcaagttgaaggacaatttttggaggaaagttgcagggctagctaataaaacatttttgagaggtttagttgtaatttttactgggctgaatttaagtgaataaagatgtgaagaagcctgttgtctcaaatcaatactttaaaaattctcgttaactatgtctgtgttctctgcactacctttgaatagcagagagcgtttaaggcaagaagtgtcttcgagaatcagcagcatcagttttatctatattgttgtttattttttgttgaaatgcttgctctttcaggaaattggaaagaaagggaaagaaaagccatggtaatgcagagttttcggaattgggtgctaactgacgtggccaaatgtttgcagtccatttggagggctgtgtttttatttaccatgagtcagttgaattcagtgttttctgatcactttttcttcggtacggagacgtagtgaggaatatgacaggcccggtttccagccagagacaccggtattgagcatatttataactatcccgttggcattcctcctgcctcgggctagcagcagtggtcctggcttgtctccaggggaactgaggcagagactgtagaagactgaggactgaggagcagaacagggtctaaagctagccgtaggtcactgtgggtggccctcattgtcggctccttcatttttgttagacttggaggaggtgagttcttccccatgttcagtgaagcttagttaatttatgtgtgtgtgtttttaaacttgagtgttattaaaactgccactgtgttatataaggtatttgagtatagtgttctgtcttctaaatttcactttgggattcattaacagctcgttgaaagtgttatataaatcacacatgaattgttaatgactagcttttgctgtttcacttgcatttcacttgtatgtttcacgatacatttttacagtgtatgagttttaaaaaattaccttcataagttgcatatacaaagatattacaggaatgtttgtattgcgacactgaactaaaatttaccctacgtgagatgtaagatagagatgtaacaaattgttgtcttgagatgaagatttattacatagaattatattaatatattacatagaattataataatattagataactgtttaagactattaaaataacagggcagttaccacctttttttttttttggtatgcagcaacagtatcaaagtgctctattttgggcagataaagtagcttcactctctcgtggtaagtgacaaaatgctaactggttttctgattaatcttaaaattcgttttctatttcaccttgtacctctgaccacttatgtgaatttttccctccagaagaaccccaggacatctattggttggctcagtgtctttacctgacagcacaatatcacagagccgcccatgcacttcggtcacgaaaactggacaaagtaagtgatggtatgaactttaaagctcttcagagctttaaaaaaaatgtcattagtggccgggcgcggtggcttacacctgtaatcccagcgctttggaaagccaaggcaggtggatcatgaggtcaggagctcaagaccaagatggtgaaaccccatctccgctaaaaatacaaaaattagccggacgtggtggcaggcgcctgtaatcccagctactcgggaggctgaggcagagaattacttgaacctgggaggtggaggttgcagtgagctgagttcgtgcattgcactccagcctggacaacagagcaagactctgtctcaaaaaaaaaaaaaatcattagggttttaggtgtatattccatttctgttgaaattatttaaattgatgcaatttttctttgtttttgtttttttgaggtctctctgtgtcacccaggagtgcagtgggatgatcgtggctcactataacctcagactcctgagttcaagtgatccttctgcctcagcctccctaatagctgggactacaggtgcatgccaccacacccagctaatttttaaatttttttggtagagacagagcctcactatgttgcccaggctagtcttgaactcctggtctcaagcagtcctcccgccttggtctcccaaagtgctgggattatagatgtgagtcatcacagtaggcccagtttttttttagtgaaagtgaagggaaaatgtcttatacctaatctgtcaccttctttttcccccatctcccatctagtctctaaattctgaagactgttttctaaacagctctggaatcatggatattcctcttcctccccactcgtacgtgtcaggcctttgatttttttgtctgttctgttacagcctctcttcttgtctcttttccccagtaacagtttctctcttcttatcttccctgtcacaagttcatcttgtgaactattacaggagtgagtagtctttaaaacacggatgtggttatattcccacaaagtcattcagtgacttcccattagctgcaggataaagtcagatgcatcagtaggtctgtgaggccctccttgttttctctccactctgcgtctaatccaccaccatcaatacctggagcacgtgctccagtcacgtggtgctgctgtgagctccttggacacccagcagttattcacactcagggcctgaagtggagctgctgcgatctccttggacgcccagcagttattcacactcagtgcctgaagtggagctgctgtgagctcctcggacgcccagcagttattcacactgagggcctgaagtggagctgctgcgatctcctcggacgcccagcagttattcacactcagtgcctgaagtggagctgctgtgagctcctcggacgcccagcagttattcacactcagggcctgaagtggagctgctgcgatctcctcggatgcccagcagttattcacactcagtgcctgaagtggagctgctgcgagctcctcggacgcccagcagttattcacactcagggcctgaagtggagctgctgcgagctcctcggacgcccagcagttattcacactcagggcctgaagtggagctgctgcgatctcctcggacgcccagcagttattcacactcagtgcctgaagtggagctgctgcgatctccttggacccccagcagttattcacactcagtgcttgaagagctacccagtgctccactcctctgcctgaccacttactcgctgcctcacttactcgctctcctgcagatgtttacttctccacctggttgatgctttctgttgccccgtttcgtcatgcttacctgttgtgcttagttcacatctcccctactgtaacctcctggggcagggccttactgcttttgaatccttggtgcctagtaaacagtaggttcataataaatatggtttaacaggactggattttttttttaactgcaagagtaaaaggagaaattatgaaattagttctattttatgcttatggctttctttgaaagtgaagatacatattattttgaccactacttaaacaaattaatttctttcctagttgtatgaagcatgtcgttaccttgcagctaggtgccatgtaagtatgctcataatttcatttttatttggttgaataaaatgagtgttatgcatctcttaaatatgtgtgagaattttagtgatggagcttagcaggttagtaaagtatttcatgaggaagtgttcctttccttagtcatgtttgctataaaatactgattcttcgtttaccacatgctgacatgcatgaagaaaattctactttagacatttcacatttaaataatgggcatagtatatgttatcctttaaaaattcggatcatgtgtttcgtgttagaagtcgtgagtgatgagcggcacttctgttttccacgtagtatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcagtaagtagtactgtgagcacagctcagtaacggcggcgagaattgccctcattacgtggcagaaacacattatcttcttttacttattactatattaaaacaattgtggttgccaatttatttaatttgcccaccaaaaccaaaaaagattctgagacatttctgagcccttagttgcaagctgtaattgtatccgcagatgcctgcatccaaaataggctggcttgaaacttccttctcatatttgatgccttaagctactccctaaaagtggaataatttttcttctcctttctgtgtttcagcagtgttttggacctacaccaagaaactttgattagcgtacattgtttctttccaggaaatggttttgtgttctgtttgcttcaaagtacattgctatgtaattgtgtatatttcagtttgtatacttcatatctccatgaaattgcacattccttgctggcagacatcatatagtaacttattaagtgacatttacagatcactaatctggatttaaaaaaaaaaataaaaacttattgaggtataatttatatgccatgcagttcccccatttaaactgtatggtttgattccttttagtgtattcacagagctttgcaaacctcaccatggtcaattttagaatatttttattattcagaaagaatccctgtaagccttacctgacctaccaatttctctttcttcccacatcttttttttttaaattaagacagggtctttgctttgttgtccaggctggagtgcagtggcacaatcacagctcactgcagcctcaacctcccaagctcaagtgattctcccacctcagcctcccgagtagctgggactacaggcgcccgccaccatgcccggctaattttttgctattttagtagagacggggtttcaccatgttagccaggatggtctcgatctcctgacctcgtggtttgcccacctcggcctcccaaagtgctgggattacaggtgtgagccactgtgcccggcacagttggctaaattttttaaaaaatgttttgtagagacagggtctcactgtgttgcccaggatggtctcaaactcctgggctcaagtgatcctcctgccttagtttcccaaagtgttgggattacagtcatgagccactgcacctggcccatttatttatatttttggtagaagtttattacttgacttttcaccttagatagttatttttaagcataaaagaatattacacattctaggtttttgtttttgtttttttttctggccactcattaatgtatgtgttgggaagcagattcttctgttaagaaatgcatttatgaaagtgtgtggtacagtcattattttgggacctcttatccattaacttatttgctatgaaatgtgtgatttatttgcaacgcattattatttattttgtgaaattacatttttaaaaaacaactcctaggatattgcttagttcgaagactctcataattcattattttttctaaaattttactttatgaatcttcttcatatccttaatgatactagctgcctgttgctggatcatctttaaattcagttatgtgttcgaggtccagagtctagaatgtgcatcagatttccacatcttcgtgtttatggtagtcgtgagatggctgttgaacgccttactatgtgctagcaccacagagatggtagcatctctagccctcacagacttctataagttagatagtaaagagttctataagttagatagtgtttttatctttttacagatgaggataggaaatggaggccaagagaggttcaatcacttgtccgaggttacaagtaattggcagagctggggtttgaactcaggtctgtgctgcctcagcaggccattgtgctgactgctgtgaccactctgctgcattgctgccagtttctgctcattaagatccttttgaggggtgtctgcctatcacactgtcaatcttggagttttatacacatgcacacacactctgccatctctaaatcattgcactgttttggacaaaacaggtaatgaacctagtagccgtgacatgtacttttgttataaagatgtgttggaacagagcagttgaagcccagggaaggtgaattgaagaagctttgctgtgcattttttgtgtgtttttatttatgccttgacagttgtgattgactaaatccttttaaatgcaataaaaacttctcagcattcaaatacacaattctctatcaaaagttaagtttaagggccaggcatggttgctcatgcctgtaatctcagcacttcgggaggccaaagtgggaggatcacttgaggccaggagtttgagagcagcctaggcaacatagcaagattgtctgtacaaaaaatttaaaaaattaactgtttgtggtattgtgcacctgtaatcctagctactcaggaggctgaggcaggagggtcatttgagatcataggagttcaaggctgcagtgagctatgatcgcaccactgaactccagcctgggagacagagtgagactctgcctctaaggagaaaaaaaaaaagttaagtttaaaagtactgacttaatatgtgactcatcatttttccaacagataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaaggtttggaaactcaggcttttttgttttatgtttagcaaaattaatattgtttggattttttgcctctgaaatcttctaagtcaacaacaggccacatacaggtttaaatagacctactcactttcttaatgtcttcaaatgtaaagcacgttgcagaatgcagtattgtacggtgccttgtgctgtccgaatctagggattgtgataggaagaggccatctttttgagaagtgattgagatagtataaaccaggatttcagtatctcatgcagtgattctcaaccgtgttgctctttacatccttgggaagacagagaaacatccatgtccagttcccaactccagagcagatgctttaaagctcccaggtgatcctaatgtaccacaggcactgagaatcagtccaagtatgttggcagtggtgtgaggtgcgtcaacaagggaaacagaaaatagagtggttggattaatgggattctaacatattttagcctagtgcagtggttctcaaccaaccagagtgattttgccgccccctgccccgggaacagttggcaatgtctggagatgttgtttgtcacagcttaggggcagggagggaggttgagaggttgctgctggtatctagtggttagtggccagaggtcctgcttagcacctgcagtacacaggctcccctgttcccagcagagcaagatccacgcagtcaggagtgcggaggctggtggttcttaggtgacaagagccacctggggacctgcctcagccctgaaagagtagcctccacccaccagatgattcccgtcttcaggcctggagccactgtgtcagcttctgttgcacattttgatcttatgttctcttttgagtttgatttacttagaccaagaactgtagaatcatatttttagttgttggctttttcccctctataaatattatgaggatattcttttttttctcaccatttttaagaaaaagaacttcttgaatcactaccccttagcaagctgtgtaatgaagaacaggaattgctgcgttttctatttgagaacaaattgaaaaaagtaagtaaaaccaaagagttagcacttgctttatgtaaatatcttattccataaaatttggcatctagtcttatattaagttttcaaaattaaaactttttaaatttagcacatttttaagaatagagcgtttaagatacataagattccaaaaaaaaaaaagctttcaaaaatacctttttcctctgaaagactccttatactaaaagattgaattaccaagtaaatgtaaatggaatggtgttgcatggaaatgaagatttttttgttatgcttcctgaatgtttactttgagaaatacgtcccgctgtggaattctgttctaaaattgagaagggaattaaacttactgagaggagtacttataaaacctaaagttataagttttcagaggctctcacatttgttcttgtaaatgttttaaccacttgggccaaacacaaattgaatccacattttattttgtttttgctcattgagtttatgtttacatttctatgtgtttcagtataataagcctagtgaaacggtcatccctgaatctgtagatggcttgcaagagaatctggatgtggtagtgtctttagctgagagacattattataactgtgattttaaaatgtgctacaagcttacttctgtgtaagtatatccatccatttttctgtaggaacatggagttcactccatcttacctaggtgattcacggacgtgctctctgaataatcttgaactagatgataatttaagttatctttaccaattgtagagcactgaacagggtgctgtcttaaaagagcaatttacagacatgaatttgtgcatatttgtagatttattacattaacttgggagggatatacatgttgctcttactgatcttgataatttgcaagtttgaaaattccattttggcacattgttttgtaaaatttattctcaattatgagactcacactgtagatactaggtgtttaatatgctgcacgcagtagctaagccatctcccacatgtatcagttttccagtgtacctaatttaaactttagctaaatgacatatgctattttttgtagatcttggttcggtttaaaatccttgaaattacaaaaattttaattggcaaatacacataacctatttattagtttggtgcaaaagtaattgcagtttttgctgttgaacgtagtggtaaaactgcagttatttttgcaccaacctaataggatttcctgttggttttgattcttttaaataagcggcctacttattttatgtattacaattctgttgacttaaagtaaatgtatgtgataatgtttatttttattcctttcaaataaaccagaattttttctttcatttgtaacttaattatggccttaactgaatcaacctgaagataatggagtgaagaaagtgaagtgttacaacccacagcatcatatgtgataccataatgactgtctacacatagccgatcgtcgtgagtgctgtcacctgctgttttgggggtagtaatgtgtcgctttaactttcagagtaatggagaaagatcctttccatgcaagttgtttacctgtacatatagggacgcttgtagagctgaataaagccaatggtaagacttttttttaaattaaagtaattcttagacataaaacaaatcttttctgtaacttgaaattttgtctctgaaattctggatagttgagattgcaggtaacaacataatggaaccctactataaaagtaacaactggggaggaaatgtttaggaaagtagcaaatggccaattttgttttcccatcagaacaattagttctttatcactgcttcctactaccttttctcaaatatcatttatgtttcaaggtttgttagctttaaattgttgggtgtcagttctgcctcccccccccttttttttttttgtaaattccactggaaatctgatatggtaagagttgataactacttagaaattggaaaggagcagattgtttgctcatgttttccgtatttttaacatttgacatttagttgtgtttggggatgcatttgtccttaaatttttctaaactgaatggtgagctctgtcaggaaggaaaaccctcaccgaatccctgctgctcagagtgtggttcgtggaccagcaacatcgcatttgtggaagctggttggaaatgcagcatctccagctgctctggtctactgaatccaagtctgcatgcaggaaacatcatcttgaaatgccaggatttacacatttctcaagattaaatagtatcattgatctgataaacttgaaagtttgttcagccaaattggttgtgggtgattatgatggtccataatgggcccttggtgtgacaggcatgagcttctaagagaggtgaggtgctttgctgtatcctctgcagtattcgggaagtgctgtcttagggggtgtctgttcccaccttgcccacagtgtgtccttcatctaactctccagttagagagttaattttttatctagaaggaaagacaagtatgaaatcattgctgtaagagcagaattatatgattgtgaagagttgtaatgaaatcatgtcttaaattacatgtgatacgaacaattgttctttttctgctttttcctgaacagaacttttctatctttctcataaactggtggatttatatcctagtaatcctgtaagtaatataacttttagtcttagtttttttttttttacctgtactttaagaaaatgcttaactcgtatttagacaatagcttaagttcaagcaaatgatgttttattaaagtgttgcaacagaatctcctagtgtttattgtacttacaaaagcagcattaacttttcaacccatgaaggtattttttaattataccaaagcaaaaaggtttttaaacccttttttctgattatagaagttatacatgcttattttaaaatacttagcgtatagcaatataaaatactgaccatgacagtcacgcctccctttcctaagaaatgtggataattgtttggcagctttctcacattgcacatgtaagacaacctgttgaattgtgtactgattccaaactgtcatggatcggaatggagaactaggaatggaaaatggaatcagggactgcgtctttaaggacaaaatcaggaatcagggtgtaagactcagacgacaagaatttgcaccctatcccagtgtgaaaccagagcaagagaaaaccagctaaatagtcagaactcggacagagagcaaggaagagccagggtcaggctgggggagatgagcagtgcaggggagtcaggactcacaggctggtttttgaaacagggactcctcaggggccttgtcttgtgtagacgtctccttgagaaagagccatggagtgtctgccctcttctcttggaccttagtagactgtattagagaaatgtctaacttaactagaatatgtgataaggaacatgtagtataccctctgtctaccctaatttgttgcagattccaattagatattccaattccaatctttgtttatggtaaattttgaactttttaggtgtcttggtttgcagtgggatgttactatctcatggtcggtcataaaaatgaacatgccagaagatatctcaggtatgaatttatttttttcctctctagttaacctgtagaattgatgtcttgctcataagctttcaagtagtaattagtgagtactttaaaagcaatgtgaaagaataaatgtttttttttttcttcctttcttttctttctctctttctttcttgccttttcttttccttctcacctcccctcccctctctctcgagggttctcactctgttgcccagactagagtgcagtggtgcaataatagctcacctcaaactcaaatgatcctcttgctcagcctcccgagtagctgggactacaggcaccaccatgcctagctgatttaaacatttttttttttttttagtagagacgaatctcactgtgttgcctaggctggtcttgaactcctggcctcaagcagtcctcttgcttcggcctccgaaagtgttgagatgacaggcatgagccaccatgcctggctgaataaatgttttcttcaagtggtttgttctttataagatgccatggggagagagagaaaaaaaaaatcagtgatgtagaccctattctcagggaacctacatattttatttattaatgagaataaatggccaggcatggtggctcacacctgttatgccagcactttgggaggtcaatgcaggtggatcacctgaggtcaggagttcaagaccagcctgactaacatggtgaaactctgtctactaaaaatacaaaaaattagccagatatagtagtgggcatctgcatcccagctactcgggaggctgagacaggagaatcgcttgaacctggaaagtggaggttgcagtgagctgatatcgcaccattgcactccagtctgggtgacaagagcaaaactctgtctcaaaaaaataataataataattaataaatgagaataaatatgaaacaatagagaataatgtagtttgaaagtttctctctttcgcttacagagatcctgttaaccttttacttttaggatttcttttattaatagttgtgaaattacacaaaactttatgtaaaattggggtcactaaatgtgactataaaacagaattcttagcagggtgaactgattcatgtaatgatttgctgtggttttaacttaaggaaagccatgcagcctagtgaagctatttaaccagtattattcaagtttagaaaaatgtcaagtatgtgaagaattaattacttaaactctgtaaatgttctaatttctgtggtttcttccgtgcaaataaaacagaattggtctctaacggaaacagcataaactttggagtcaaatttgaattctaatccaagttctgtgacttaccaactgaaattccttgggaaagttaatttctcctgctctctctttctttaaaaatggggatgtcagccaggcgtggtggctcacgcctgtaatcccaacactttgggaggccgagacaggcagattaccttaggtcaggagttcgagaccagcctggccaacatggtgaaagtctgtctctactaaaaataaaaaaatcagctgggcatggtggcatgcacctgtaatccccgctacttgggaggctgagggaggagaattgtttgagtccaggaggtggaggttgtagtgagctgagattgcactactgcactccagcctcgccgacagagtgagactctgtctcaaaaaaaataaaagggagtgggggtgggggagatgtcatactcatatagcaggattgttaggaagactgatgccacgaaagtaccctgtactaggaagaaactagaatgttccctggttggttgtatgttcagcattttagaagaacttctacatagaaagatgattagtattgtaaaagttattttgagctatgctgctttgatctagcgtgcaattcagtgatggactcttatcagtggtccccaacatttttggcaccagggaccattttgtagaagccccccctcccagggtggggggactggtttcttgatgattcaagcgcattacatttatcgtgtgcttttttctattattattacattgtagcatataatgaaataattatacaactcactataatgaagaatcagtgggagccctgagcttgttttcctgcaactagatggtcccatctgggagagatgggagacagcgacaggtcatcaggcattagattctcgtaaggagtgcgccacctagatccctcacatgtgcagttaacaatagggtttgcgcacttacgagaacctaatgcctctgatctgacaggaggcagagctcaggcggaaatgcaagtgaaggggagtggctgtaaatacagattaagcttttttttttttcaaatggcaagttctttcttgacatatgaagctttactcacctgcctgccactcacctcctgctgtgccgcctggttcctaataggccagggactgataccagtctgtggcccaggggttgggacccctgctctacatgaaacaggtaacatttggataaaagaaaacttaaaatacaaggaagtagggtatcaccccctatgtcttccacgttttgtgatatgttctctttattccttgtgggttaattatacagtgttcactgtatacaattattcactgatatatatgagtccagtccctgtaaccagggtatatctgttgaccatcatctataggatatcgcctaatccctcaagccttggtatacctgtctttaaaatataaatgaatttatcttgcaagttattaggatgagaggatgtatctactaggttacaaaatggagctcctggattaagtaatatctgtaagttctatttagaatgctaatgggttttgctacagtgcataaaaagctgtggatctcctcaaatttcttaaaattttgctatactattaaacagttttagttcaaatgaatcaacacaaatgttacattagtgtttaatgtggtgacagcttgtttactaaatggatgttaatgtttttgaggccatctccttatataaaattaacaattcaagaataaatactagctgggcacagtggctcgtgcctgtaatctcagtgactcaagagcctgaggcagaaggattacttgagcccaggattttgaggctgcagtgagctatgatcataccactgcattccagcctccagcgacagagcaaaactctgtctctaaaaataaaaaataataaataggctgggcgcagtggctcacgcctgtaatcccagcactttgggaggccaaggtgggtggagcacctgaggtcaggagttcaagaccagcctgaccgacatggtgaaaccccatctctactgtgaatacaaaattagccgggcatggtggcgggtgcctgtaatcccagctactcgggaggttgaggtaggagaattgcttggtatctggaggcggaggctgcagagagccgagatcgcaccactgcactccagcctgagcgacaaagtgagactttgtctcaaaaaaaaaaaaaaaagaataaatactatatgacttaaattaactcttttgttttagcaaagccacaacacttgagaaaacctatggacctgcatggatagcctatggacattcatttgcggtggagagtgagcacgaccaagcgatggctgcttacttcacagcagcacagctgatgaaagggtacggcagagcaaactcatcaaactccatgaagggatgtttttcctaatagaaatgaaatttctattactattactgctatttggttgctaaactaaacacaaacattttacttgccttttaatctagttgcttgtgattgtaaaataactatgaaagtggaggggagagaagctggtgtatgcatttgcctagcagttgattccaaccagtgcaagaagcaaccaggaaattaggccagtggaggagaggagttctggaagcccttcctcacatgctcatgcaagaataaaaatattcacgagcaaaattattatatcttatctattaccaaaaggtatttgatgtggcttagtggtaggtgcaggactgtatttgccagtattctagatttatatcaatattaaatgtattgaaactaagaatgtgttactttgaggagtagagtattgctgttcacattgactgtttggtctcaccatcggttacaacttacagggttggtttgtgtggactgcttctattgactgatgactgcatccctgcctggagaggtagtgggagtgcagtggtccagaggcctggtctggagtcatacctcctggactcttcctggctcttccactcccagccatgtgacgttgggcaagttttttagcctcctgagaaataggaataatagcaaaatttactcactggcttattgtgagaagtaattgagataataccaattaaagactttgaagagtgtcttacacatagaaagcactcagtgaaagttagctacttgtgtttatttacttgtatgcaggggtggaatcatatatttatctgtattgaatgtcatcctgttaggtttggtctctttgcaaactgttaggctctttttgtcactcagttctgcgtttaaattagtacccacctcagtcagtagtcatagtaacttggtaagtatcatagctccttagctgtattagtcagtagggctgccataacaaaataccacagactgggtgacttaaaggacatttattttttcatagttgtggaggttgagaagtccaagatcagggtgctggccagtgcagttcctattgaggagtctcttcctggtttgtagataactgccttcctgctgtgtcctcacatggcagagagagctctggtgtctcttcctcttgtaaaaacactagccctattggatgagaaccttacacgaaccctattggataaaagccttacactagccctgttggataagagccctacactagccctgttggataagagccctacactagccctgttggataagagccctacactaaccctgttggataagagccttacactagccctgttggataagagccctacactaaccctattggataagagccttacactagccctgttggataagagccctacactagccctgttggataagagccctacactagccctgttggataagagccctacactagccctgttggataagagccctacactagccctgttggataagagccctacactagccctgttggataagagccttacactagccctgttggaaaggagccttacactagccctgttggataagagctttacactagccctgttgggtaaaagccatactcttaggacttcatgtaacctttattatcttttcataggccctatcttcaagtacaggcacagtaggggttagggatttaatgtatgaatttggggggcagaggggacacaaacagtccatagcactaatatattactagaaaataaccttccagagtagagttgcacacccagttatggatccacctaaatggtcctcatactcagtccaggtctctccatcctgttcaccaagatgagtgagaccttttccagttctcttctgaagctcagctccagtatctgcatatttcccctatgtatcaatatgataatttgttaccaaaaaaaaaatctcaataattcactatgagttggtttttatgagcatatgctacagtctggtaatttttatttgatattttgggttctcagaaacagaatagttattagttagttcctagctgggaatcagaatcaatgataattaatgacacaataccttcagtgtttccaaatctaacaaactttgtcattaaattctcacattaagctaggtgtggtagctcacacctgtaatcccagcactttgggaggctgaggtgggaggattgcttgaggccaggagtttgatactagccctggcaacatagtgagaccttatctttacaaaaaaaaaatttaaaattagctgggtttgatggtgcctgcctgtaatcccagctatgcgggaaactgaggcaggatggtcactgtgccaccacaatccagcctgggtgaccagttgagatacatctcaaaaacctcatgatagctcatcaagataagcattatttttctttcaagtttacttatctgtcagagcagctctgcattttcttaacttgtctgtgtttggataaatgtttgaaattggatgaatatttttacgtgtcctttatgatttcttttttgagtcattggttatttaagaatatgttgacatttaacttccacatatttaagaatttcccaaattttcttcttttgttgttttttaacttaattccattgtagttagagaacatacttcgtgtgattttagtccttttaaatttattgaggctggccgggcgcagtggctcacacctgtaatcccagcactttgggaggccagaggggtgtggatcacttgaggtcaggagttcaagaccagcctggccaatatggtgaaaccccatctctactaaaaatacaaaaattagccgggtgtggtggctcacgcctgtagtcccagctactcgggaggctgaggcaggagaagctcttgaacccagaggcagaggttccaatgagctgagatcgcaccactgcactccagcctgggcgacagagtgagactccatctcaaaaaaaaaaaaaagaaaaaaattattgaggcttttttatgagccattctatagattgttccagattatttgagaattctgctcttgttgggtgaagtgttccatagatacctgttacatctgattttatagtgttgttgaagtcttctctttcctcattgatcttctacttatttattctctgcattattgcaagtgaggtattaaagtctccagattttattgttgaattgtgtatttctccctccaattccggcacatttcacttcatatattctgagtctctgttgttaggtgtgtacatgtttataattgttgtattttcttgatggattgagccttttatcattataaaatatcactaattatctctaataatacttttttttataaagtctgtttcatctgatgttactgtaggcacaccagctctcttttgttactgtttatatggtgtggtttttttcattcttttaatttcaacttgtgttttgaatctaaagcatgtctcttgttgacaacatacagttagatccatttatgtttaattactaacaagataggatttatgtctggcgttttgttctttattgtctatacatcacatcttttgttcctgtatttcttcttttgtgttgagtaaatattttataatgtcccattttaatcccctttttttattatactatatcttttgagttattttcttaggttggttatctttaggattataattagcaccttaatttaaaacgacctactttgaattaataccaatttaattttaatagtacgcccaaaccttactccgatatagctgtttcctcttgcctccttgtgctgttagtgtcatatagaatacatcttacacattataagtccatcagcacagatctgttattattatttattctgttgtcttttaaatcagatagaagagttaaaaacaagcacattttatactgtctcataattaccaatgtagctatttttatcagactctcatttcttcgtgttgtaaaccaaaaataaaatttgaagaccctccccaaccatctaaatgggcttcctcctctaggccagggccgtctaaatttaacctgaaagactggttcaggccatgatgggaagtgggggtccaacacgcctctttacgccctccagcattaacatcaaatggaccttcagtctgataagaagaaacacttaccatctatcctctctgaagcctgctacctggaggcttcatctgcatgataaaatttggtctctgcaacctcttatcataacccagacattgcttactattgataataactctttcaaccaatcagaaaaatcttaaatctacctgttacctggaagcctgcacttcgagttcttagagtttgactcttctgcaacaatgtggatttgaattcctatgtagtatccttctgttttagcataaaggactccctttagtatttcttactgggcagatgtactaatgacagattttctcaattatacattgttattatttatgtaattttgtttttcaaagaagctgtgaggaaagaaggtgtatatacttatatcatttgttatattaaccctgttatttaccattttcagttctctttgttcctgtgggttcaagttaacatccagtgttactttcctactgtaatacagctttgctgtcacccgcttcctattacactgttactggtaaaccttacatttctgtatatgataggcccaacaatataattgcacattgagtatccctaatctgaaaatccaaagttcaaaatgttccagaagcccaaactttttgagcactgtcatgacactcaaaaagaattgctcactggagtattttggattttcagaatagggatgcataaattccaaaattaaaaaaaaaaaacctgaaatcccagacacttctggtctcaagcatttctgatgaagaatactcaacctgtacatagagtctcactctcttgcccaggctggagtgcagtggcaccatcacagctcactgcattctcaaactcctgggctcaagggatccttccgcctcagcctctcaagtgtctgggactacaagcccataccaccacgcttggctaattttttattactttttagagatggggtctcactgtgtgtcataaactcctgggctcaagcattcctttcaccttagcctcccagagtactgggattacaggtatgagcccagggggctcttttaggagctaccagacaggtcaaatagcagcagttccctgtggggtgtttgaggaactctaaattaattctgctttctccaatggctgctaggctaatggctttacaacggctgttgttatgagactgcttgtttttaaggttaatgcaaagctagggaaagggagatgggaataagacaagttaaagcagcacaaagttgttcttactgagatttagccatcttttcttgaatatacactcctcagattgttttaagagcttggttaccttccaaagttctgaaaaaattggttttgataatttttgccagtgttgttgttgcttctatggatgaatagatttttggagtccttatgctgccattttgaaagtacttctaccaggtgtaaatatttttaaagaatttgtcatgaccttctgtagaggatataatcttaatttgagttatgactctagattagaaccaaagcacacaccaagcaatcagtatttattgatgttctgagatcatcatcaaggaaagattgtcttattacacttgctttaatgcaatcactgatcccaatcgtgtgaacagatgaaaattcaattaaaaagtagttctgactctgcctagaactgtctcagaaggtgggaaaattgaatcaatacacagggcattattcataactcttctgcatagaactgattataatgggaattcacagaagggagagcatttatgttagaaaagtcagaggtagcttcataaagggaagtagaagttgaacccaatcttgaaggataaatggtggtgagtaaataagaggaagaccagtgtcggctggggcatgacattagcatcaaggaggaagacagcaccacagagacctgcccttttgctttagagagtttttgtttttttactgtggaataataatgaaaattaaaggtaaataagttgcagatagattctagaagtggcagctgattagtccaaagcccattaggcattcattaaatatttgtaaattaagagaaaaaagtaaatgctgtgttttggctacctttaaattattttgcagataggatttgaagttgacagattaatttctgctaaatcacagtttttggtgttgaatatgtgaaattttccaattttttaggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagagtaagtactggaagaccagaaacccttctgttaactagtgattgtaaatacagtaggtgatcactagagttcactgacaaaagcgactcttcagtagatttgtacttttaaatgttctattttaggagaaggagatagaaaaaaaagagagaaactgttatcttggatttccttaaaaattctaaacccaggttttggtctttttttgatctgagctaccacttcttttcttacatgattggacagttcagattacacataccccacagtgtggctgggggcactgtggaatccttagttatctctgtgttgataaggagttgaatttacgtatttgagaagaatttgacatggtttttgaaacaaaagtgttttctatttagttactagtaagtcagaaaatttaattcctggtcagtgtaggctttactgtactctagaatatttgtagaataagtgatttggtgttatactcaaagagaaaaatgtatgtaatcctttgcatttcatgatatacaaattttaaaatggtaaattagtttcagttttttttggtttttgtttttgtttttttgagatggagtctcgctgtgttgcccaggctagagtgcagtggcgcattttcagctcactgcattctctgcctcccaggttcaagcgattctcctgcctcagcctcctgagtagctgggattacagatgcccaccaccacgcccggctaatttttgtatttttagtagagacagggtttcaccatgttggtcaggctggtctcgaactcctgacctggtgatccgcctgcctcagcctcccaaagtgctgggattacaggtgtgagcctccacgctcggctgtaaattagtattaatactactacagtgtcatttatggcatgtatgtgttctaaaaaatgggttatctaggtattttttaaaagtttgaagctttaaaataaatagtaatcttttaatataatacagtaatcatcagtatttgcgaatttgcctactcattaaaatttatttgtaaccgccaaatcagttcctgaggtgctttctgagccattggcagacatgcccagggctgggagaaagctgggtctcctggcacacacacttccagctggagtctaagaaggcaacgctctgccttttttcccagttcaactataaaccagtgtacttcttgtggtctatttagtgccacagttttcacatttttgtgctttttgttgatgatttcactgttttgaaataatccccaagcttagtgaaatgctatctagtgttaattgtgatacacttttgtgttacagaggaaacacatgtattagagaagcttcattcaagcaggcatcagtatttatagtgctgctggccctgacttcaatattgatgaatcaacaatatgtatcaaataagacgtctttaaatagaaacacacataaaacaaggttacgcattgatcaattagagaaaatgtgaccagagaattgcaggaatctaactgtatttcccctggcagccgcggttcaatatttgctaactcagtgtacacagtgactttatagaacataaatactgtggttgggtgcggtggctcccgtctgtaatcccagcactttgggaggccgagatgggcatattgcttgaggccaggagtttgagaccagcatgtgcaacatggcgaaaccccatctctactaaaaatacagaaattagccagggatggtgttgtacacctgtaatcccagctgtgtcaggaggctgaggcacaagaatcacttaaacccgggaggcagaggctgcagtgagctgagatcgcaccactgcactccagcctaggtaacagagtgagactcttaaaaaaaaaaaaaaaaaaaaggaatataaatactgtatctcccaaaatcttgaaatcttgaactcttgatattaatgccgtaaaattaatcatttgtgacttaactttgaatttttataattatttccagcagtttaccccattgcattttagtactactagaaaggtaatcaaaaatttttttaaagtttatatttgctaatttcgaataatctgcaaccttttttcctttcattttagatggaaaacagccgaaaaatggtttcttgatgctttggaaaaaattaaagcaattgggaacgaggtattctttgtagtacctgtaaatatacacatatacacccctgagtgtttactgttaaatgaggaaaacaacacagaaatctcttgccttcgaagatagtaacctgatattttcataacaagcggctgttaatgtttgcattgtcagttaactgttttaccacatggtaagaaatgagttttttccctaagagggcaagtgttggcgtttgcttcttaaatgggctctagctttgaaacgtgagaggcatcagaatagattgggtgattatttgaagctaggaatagtcattgggtcacggaaacaattgggcactgtagcgtcagatgtaatattcctctagaacttcagagagcttctttgactgaagggtaaataaagtatagcagcaggtcccacttctgaaaggatagggatgggataggtattactgaaattcacaccttttgttgctgttactgcatactgagtgtgtatttgggcctttccattttaaaatatttgactgcttctgttgtatgaacgatcccgtgaattggtgcttatgagttaacctaacaattatcaaggatgtgtatatactgatattacttaaaagtagtaacagttttagataccataaacttgcatagtaagagatttgcatgatgctcttctgtttcattcgtgcctgttttgtttcattctattctgattttcacttctcagcttcctgctgttactgtttgtgcacacctgcccacagttttcttctcccttggctgttagctctctctgctgttacagacacagctttgcctccctgccaagcgatctgcctgtccccatagacacagctttgtttactttggtctctcatgtcatctgaacttataaacactatttctgtgtttgcacatgcgtgtatataaagcaggtgcctctgtcgcatagtcttgggtagttctggataatccaagtgttttgttaataggggattgccacttgccaccttgtcagttttctaagaagtgactgccttatgccccagacgggctcagcagcatcagcatcacctagaagcctgctagaagtgcagaatctcagaccaactgaatcaaaatctgcagttttagcgtgatgcccaggggattatcacgcacagaaaagttttgagaagcactttcctaaaccatacttaagttgagcctgtattctttgatgattaaggggcactaaatttagagtcttacagaaacttaatggttttaagtatgaaagcacaacactattgaaatgtcaaaatgctcattaaaaagttatacgaagagggggaaaatattgactttattagaaactgcagcaaatgtcaaagagaaacagtcatgcctaagagtcattaaatgatttgtttttcattcacatgggctgtgcctcctagaactggtctcaatagagttagagaatctgtggctcaggtctgttcattcatttagttgacatatatttaatgagtgtcagccatgccataggctctgagctaggccttgggatgcaaaggggaatgagtttactatttcctgacctcagatcaactggcgaatgtaagtacgtaaattgacagtgaaaatacggtgcaattgaggaactaaaggtgcccacagagaaaggcagttcacccagaaatgagccttttgcatacacctcagtcctgaaagtcatcagacatcagctaggcaaaaattagggcaagggtattccagtgtttgcaaaaattggagctaattcattatggcttggattttgagttcacagagaatgtcaaggagtgggtcaggagggttaagtgtggatcactaaaggcccagaatgaaagagtttgtgccttatcctgaggagaatgggaaaacaaaagggatttaagaaggaaacaacccggtcagacttttatgattggggcccagatttgactctgttaatgaggaaggtgaggactaaataggttggagttatgcctagcaattagaaggaaccagccctggtgtgcctcatggaagggtcagagggggtgggggtgccattcactgactggaggggcactcagaagcagtgaggtcaggggctgggatggccagggagagatgggtgtggtgtgtggtgcactaaacttaaagtgcttgtaacatttacaagcagaagtatttagcaggcagatggatagagaggtctggtgtttgagggaaagctctgagttgcagatactcatttgaactccagcagggataggctcttggataaacttgtcctaatgataacagagtcctcaggaagtctcctagtaggaaagaaagggagatagataaaacagcagttaccctggccttgtggtgtgctggcggcacacactgggagagagcccagcttgcaaggcgtgaaataattcagtgcaaacaaatcaggctgaacagtgacatatataactcgtgggcttgatgttgctatgttttaggtaacagttgacaaatgggaacctttgttgaacaacttggggcatgtctgcagaaaacttaagtaagtgaagtagagcattttcagaaatatactttgtgtctcaaagtttacttaattttgaatactttgtcatattcttatttcatgagatcaaccagctttcttgtacttggctgctcagataaaatcagcatcaaatcagtttttattatttatctgtgttggtgtaattttattttagaaacacattgagaattttacttttttatatgaaaatttagtgttcaaaattaattcagaagaattaggacagtaggatataattaaaatcctatccatagtctgttttctgctagaggttttgtggtgtgataaacaggcgacagttgaaaaatgggttttttggttaaatatgtctgggcaattttaggttattcaagatttaacaagtatttctattgcaggatttctttgagtctttactatgtattacgaacttatagcattttccaaagtttaattgagcataaaacatttttttcacaaaagactttacaagtcaagtattccagagaactttaaggagcacttttctaagtaaatcttttggaccttaaagcgatactccttgactgcttttatctacccctgatatgggacactgactgtcacctaagagggtggtgtgtggtaagggcacagccaggaggcatggattaggttctggttgcagtgtcccactgaacatcaaaaggaatacagcagacatccctgcaggagtgcccttggccggcggagggagtgggcctggaagatgcatttagagggcatattgagatgcatgagagtaggtgtggagaacattcaccagtctagactgctgttctcattgagacagcgtttcttgggtgttgatatggatggttgctcatcttagacttaggaatttagtgcttttactgtagccaataattgtgttctctcccacagaaagtatgctgaggccttggattaccaccgtcaggcactggtgttgattcctcagaacgcatccacctactctgctattggatatatccacagtctgatgggcaactttgaaaatgctgtggactacttccacacagtatgtcttttctttgtacctaattttaaatctggttaacattgaccacttccttttttgaaaatattttttctaggtaatattgacttactattttaatattctttaggcaaccttacgtgttattcttttctttgcagagaaaagcatgtgggtgttgtacagtattcatcaaattagaaacaaacatgaatcctgtccttagtgtttgcagtgaggtgcgcaggtgcccagtggcactcaccagtgatctgagtgctgagcacggggttatctgtccacagtagcccctttgggaactcgcagtctttctgttcatgactgtccccttagatcacattagtagatgaacaaaacagtctctgcagtcatcacaaggaaagaacctttcattaatccatgtaccatattccatcaaatttaagacaccatgagtaagcaggatgaccacaaagaaaaaagtgctgccaattaaactttaacataattttttcccggcacttaatttttttgtacttagagaaaatattcttgaacatatttaggcagatttgtattactctagtacatacatagaaatgtacatataagtgaaataaatggttacaatattcagcccagagggccagtatctgtgttttctcaaaatagtgccctggtgctagcacacacgcccagttcctgactctgggtttcctcccagccacagacacctgctttccaactctctctctctctcgtccctctcagtctgctaaagtgtcaacagaaggtttttagaaaaccacaattcccgcatctgtttaagtgttcctcgcatggtttgtgatctagtctgtgctgccaacataaccaccaagttcacgcttctcaggcaggttacccatatcacagtggtggctggtggatggcaataataggaaaccacaggtaaaagggaagcaatgtttgaatttgagaaaatgtgggtcttagaatcagtgaactaatggtatttggagaaagagataaaatatgagaaaatttatcaaagataaactcatgagcgcttcgtaactgattttcaagagttcattagagattttgaggttagatgaagtcatgaaggtaccatgatggtcaccagaacactgagtttgtcagaagtttggactaagcacattttctagtcctgtatgatcttttaaatatgtatatttgagtattgtataatttacctttcttctgagatctgattaatacagaaggctcagctgggcgcggtggctcacgcctgtaatcccagcacattgggaggccgaggtgggcagatcatgaggtcaagagatcgagaccatcctgaccaatatggtgaaaccccgtctctactaaaaatagaaaaattagctgggcatggtagcacatgcctgtagtcccagctactagccctgcgcccggtcccaggctgaggtaggagacttgcttgaacccgggaggcggaggttgcagtgagctgagatcgcgccactgcattccagcctggtgacagagcgagactctgtctcaaaaaaaaaggaaaaaaatacagaaggctcagaagaactctgtatggagatagaacttcttttttttcttttgagatagtattttgctttgtcgcctaggctagagtgcagtggtacgatctcggctcactgcaacctccacctcccagcagttttcctgcctcagcctccagagtatctaggattacaggcacctgctaccatgcctggctaatttttgtattttttattagagacggggtttcaccatgttttggtcaggctggtctcgaactcctgagcccaggtgatccacccgtctaggcctcccaaagtgctgggattacaggcatgagccactgcgcccagtcgagatagaactttttaaaaaatcttttttggggtagatttccagcataagaaaatagaatagtgtgatgaacctccatgacccataaccaacttcaacaatctttggttcatggccagtcatgtagctatgtctggccacttcccccaccctggatgccctggaatattttgaaatgaatcagtgtggtaagagaaggaaatatgttttcttttaataaccatgctgaatcttttatggcaggcccttggtcttaggcgagatgatacattttctgttacaatgcttggtcattgcatcgaaatgtacattggtgattctgaagcttatattggtaagataatcgttattcttattggtattgtactccattttttaggttgtcatatgtctctgtttatgtttctcatattctcgtctgaggttccaagttcatctttctaaccattcgtgctgcattaaaaacaagaaactccatttattttattagaacaatgctgtgggggagttagtgactcaccaagggtgcgttcagtttaaagctgaatacttgctaagtgcaaaataccactatagaatatgtgtaaagcactttgttatagaaggactcatctgtttctataatgggaaaagaaatcttagcaacatttttctgataaacaattgaagaggctctgtcattattttataatgcagggtataacaatataaatctttacatttcaatagaatgttgagatgccatacatttccataacagtgaataagtaatagtataagtttggatggaattgctgtacttgggcactcgtttagttataaacattatgtgataaggaggatgtggtgaggttattgagatctaggataggaaagttgcaagcttgctaactcccgttcctactaaagtaattttttttttttttgagatggagcttcgctcttgttgcccaggctggagtgcaatggcgcaacctctgcccaccgcaacccctgcctccctggttcaagctattctcctacctcagcctcctgagtagcttggattacaggcatgtgctaccacgcctagctaattatgtatttttagtagagactggtcttctccatgttcaggccagactggtcttgaactcctgacctcaggtgatctgcctgcctcggcctctcaaagtgctgggataacaggcatgagccactgcgcccagcccctactaaagtaatttctgatgtaatttcccccaaagtcaaaaagatcaggtaatgtgatacaaaacagagcagagccttagattttgagagggatctgtctgcttatgtgtcttggggttccctgaggaaaacagaggtttctcctaaaacggggtctgtggcaccctctggttttcccaaggagcccgaggctgtcagaaattaccttgggtcctctcatgtggacatccagagtggcgagaagacagactggggaactaatctagccaactgagaagaaaaacaaaaaatgagtaatacccattgtaaagttggataaactgaggcacatcacagtttaaaaatgcatgttcccataggctccacagctcactctcttaaccatcctgtaattgtgcctgctctatgcccagtcactgatgcacttgtgtggtagctcatggcacacctagcaaacagtttccctgcccccttagaacctgggtttcgtttcctgctctacggcagtataaacagtttttctctgcatgtgttgggttctaaccctatatatctcaaattttattaatattactgaatctttttttttttttgagacggagtctcgctctgtcgcccagggtggagtgcagtggcaggatctctgctcactgcaagctccccctcaccggggttcatgccattctcctgcctcagcctcctgagtagctgggactacaggcacccatcaccacgcccggctaatttttttgtatttttagtagtgatggggtttcacagtgttcgccaggatgatcttgatctcctgaccttgtgatccgccctcctcggcctcccaaagtgctgggattacaggcgtgagccaccatgtctggccaatattactgaatcttacagggggctgtgatgtctttaatccttagaaatattaatctatagacaaaggaatacatgaggttaaacagtattcacatttctatatgctttaaaacattcaggcaatgtattaagaaacacacctaagaaactgcagtgaatctactctggatgaaaatttagagaatatctcttcaaaagaagctatctaggccgggcgtggtggcccacgcctgtaatcccagcactttgggaggctaaggcaggcagatcacctgaggtcaggagttcaagaccaacctggtcaacatggtgaaaccctgcccctactaaaaaacaaaacaatacaaaaaaaaactggccaggcatagtggcagacgcctgtagtcccagctactcaggaggctgaggcaggagaatcacttgaacccgggaggcagaggttgcagtgagccaagattgtgccactgcactccagcctgggtgacagccaatctcaaaacaaaaaaaaaagtgctacgtattggtagttatgcatattcttacatatattaacagtattttacatgcttaaaaccttaaaaataattgaaaatgtcaaaattatatgccatatacatttctgtgggcttgaaaatgatacaatataggttgtttctttaaagcagtcactaaaatgtgtaaacttctagatagagtaatcactaaaaaggaaagttcataccaaaagtagtaatactaggaataaaagagggctcaacactgcctttgggagtcctcctcccatgaaacatggctggatttttctccttgtcctgtgtaacctcccttactttatcatagtttactgccttagttactctctcattcctccaaggagagcctcaagaaatttaggtaacaccagagtgtggccccagccagttgccctcagttaccaaggagcaattaggtaggaaatggccactgaaagactgaaaacaagaaaaaaactcaggtccctcacccaaactgggcagtggtggtcaggcttccacacggaaacctttcactgtcaccagagtgtccccagccagagacctgcagttgcctctgtgcttagatgctgtccaccaagggtcccgagttggaaaagggaaaggggggggagttcccctatgtagagcagagggatccccacatggagatagctccagctcatgcctgcaaatgaaggctctctagagagggaaaagggaaaaagaaatgaaaaataaatcccaaaatttgggcttacctcccgactggctcaccaaaatatgttactggtgtggaaggtcttcactacaagttgtccaggttcttggcatggtgaacaaagattgaacaaaacaaagcaatggaacatgaaagcataggtgtattgaagtgaaagtatactccacagagtgagaggggcttgagcaagcagctgatgagccccagttggggtttaagtacccttaggggtttcgtgttggttacaccctatgcaaatgaaggattggtctgtggcagatcagaggctgaagtgaagttacaccctatgcaaatgaagactgtgaccaatcagaggctgaagtgaaggctccctgtctttagaccgtattctgcctcagttaagaagcaaataaaggccctcagggaaatgaaattaaaaccataatgatggtggtgtgtgcctctagtgccagctactcagggggctgaggcaggaggattactggagcccaggagatcaaagctgcagcgatcacgccactgcactccagcctaagcagcagagtgaaaaccctgtctcaaaaaagtaataataataaataaaaccttagtgagaaaccagtacacacccaccagaatggctgaaagtacaggatgtggtgttggtgtgatgtggagcaacttgaactctcatagattcactgctggtgggttataaaagggtaaagcctctttggaaaactgcttaatatcacaataaagttaagcctattatatcagctctctattgctgcctaaccactccaaaacctcaaccaacaacgtgttatttttacaattctgtgggttgagtgacccatttgtgggtcttgtctaggtttactcatgcagctgtggtcagcagatacttgactgggtagatggtctaaaatggtaccattctccagtagggagctcagcttgggtgctgagtctctctctgtggggctttcatcttaggtttctttgtagcacgatgttcccagggttctaaaggacaagaaccacagttcaggacctcttgaaaattcagagttgcacaacatcacttccgtcacgttctgttccatcagtacaagtctcataagctcagagtcaatgtgggagggggctgtaccagggtgagggtgctgggaggtgtgattcattggggtgggtattagggtgatgattgaccatactgattttgtgatgtagcagttctactcccaggtatgagcccagtggaagcaagtgcttctgtccactaaaggtcacaaacaagagtattcatagctttattcattacagcacctaactggaaatgactcaaacgtccaccagtaggagagaggagaaataaattgtggtatgttcatacaatagaatactatattatttgaaagactactgaatcatttagaaacatgcatcagtttcacagatttttttattttttattattttttctgagatggagtttcactcagtcacccaggctggagtgcaggggcgccatctcggcttactgcaacctctgcctcctgggttcaagcaattctcctgcctcagcctcctgagtagctgggattacaggcgcatgccaccacacctagctaattttttgtatttttagtagagatggggtttcaccatgttggccaggctggtctcgaactcctgacctcgggtgatccgcccgcctcagtctccgaaagtgctgggattataggcgtgagccaccacgcccaacaaatttcacagatttttgacaaaaatgtgaatatgtactaattacttccatttataggaagattagtgtattagttcattctcgcattgctgtaaagaaatacctgagcctgggtaatttataagaaaagaaatgtaattggctcacagttctgcaggctatataggaagtatgatgctggcatctgcttggcttccggggaggcctcaggaaacttgaaatcatggcagaaggctaagtggggagccagcacttgacatatccggaacaggagggattgagaaagggaggaggtgctacatactttaaacaaccagaactcactatcacgagaacagcaccaagaggatggtactaaaccattcaggagaaaccacccccatgatccagtcacctcctaccaggccccacctccaacattgaggattacggttcaccctgagatttggtgggacacagatccaaaccatgtcaattagtaatgaacaaaactaattggtagcgatagaaaagtccaagaagtgcttatctcaggcttgggaaagctgacagtattgaccaggagtgggcacagggtcttaaggagctgcatgtgttctgtgccattctggcggtagtcatctgggatgcatgtacatagggttcattcagccatgtgcttaaggggattcacacttgactcttggttttagctcaattttaaaaaacaaatttaagctctggtttctgagagatgctaggttgaagcctcagctctgcccctcggcagccctgtggcaagaaaggcaagtctgagccttagtttcctcatttgttcaagggtgggaagttcataggaagctaaataaaggctagagagttgataatgagtcagagggatgtctccttgccctcgcagaagagatttacctttttttttttttttttttttttttgagacacagtctctctctgtcacccaggctggagtgcagtggtgcaatcctggctcactgcaagctctgcctcccaggttcacgccattctcctgcctcagcctcccaagtagctgggactacaggcgcccgccactatgcccggctaattttttgtatttttagtagagacggggtttcaccacattagccaggatggtctcgatctcctgacctcgtgatccacccgcctcggcctcccaaagtgctgggattacaggcgtgagccatcgcgcccggccaagatttaccattcatgtcatttttatttttagaaagtttgcatgtcattatctgccaaactacctatttctgaaagctattggtttgaactgtgtaaaactcattttgtttatgtcgaatgattgtacctaatacatctgttcagatctgttcaaatctatattacccttaaggttttaatatatgggaaatggattttatttcatcgtggcttttttatgcataagattggtgactatacccaatgggcacagcacagttctttttttttgagatggaatctcactctgttgcccaggctggagtgcagtggcactatctcggctcactgcaagctccatctcctgggttcatgccattctcctgcctcagcctcctgagtagctgggactacaggcacccgccaccatgcccggctaatttttttgtatttttttttttagtagagactgggtttcaccgtgttagccaggatggtctcgatctcctgaccttgtgatctgcccgcctcggcctcccaaagtgctgggattataggtgtgagccaccgcgcctggccacacagtgcagttcttacctgtaacagctgaggagaaagttgtccacaggcctcatacgtatttaggaggccttggaaatgggcaactgttgaaacactggagctgcaactgcatgtgcttctgaaagtcttctgacacttcctttgcaaatggtggaaaacaaatgaaaaagaagattggaatgttgttttccttctgctctcaacttgtgctcttaaaagtataatttgacttaaatgatagagatggtgtataatgatggaaatgataaatgatggagttttgtattttattctaaatagtataatctgacttaaatgataagagatggtgttatataacaatagaaatgataagtgatggaatttcttattttattctaattatagtatttctttttaggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatctgttatgtctttttttttcttttccaataaacttttattttggactaatttttgatttacagaaaaatggcagagatagtacagagagcttatgtgtgcccctcacctagtttcccccattggtaacctcttctcttcccatggtacatttgtcatgactaagaaaccaacattgttagtgtccattcactaaaatccagccttgatttggatttcaccagtttttccgtaatgtctgctttctgtcccagagtcccatccaggcacatactgcatttagtcatcccatctcctttgcgttctcttgcctgtgacagtttctcagacttcccttgtttctcatgaccttgacagttttgaggagtactggccaggtagtctgtagaatgtccctcaattggagtttgatgtgtttctcaagcacctttctcatcacatcctactgggtggttgtaaccaccacacgacctatcccaggcagtgctgaccttggccacctggtcacagtggtgtctgccagatttctccactgtcaagttcctgtttttccctttccatactctgtgggttgaggaggtttcagctccaacccctggagagagcagtatctgtgcatgttattcttcttgaagatttgtttcttctctcctgtttattcgatcatttatcagtatggactcatgtttacctacaggcatgccttggggacactgcagttttggttccaaactggcaagataaagcaaatatcacaataaaactagtttcacaaattggtttcccagtacatataaaagttatgtttatactgtagtctattaagtatgtaatagcattatatccaaaaaaacagtgtatataccttaatttaaaaatactttcaggagttcgagaccagcctggccaacatggcaaaaccctgtttctattaaaaatacaaaaattagccgggcgtggtggtgggtgcctgtaatcccagctacttgggaggctgaggcaggagaatcgcttgaacccaggaggcagaggttgcggtgagctgagagcacacccactgctgcactccagcctgggcaacagagcgagcctccatctcaaaaaaaaaaaagagaacactttattgttaaaaaaaaaaatgcttatgatcctctaagcctttagcaagttgtaatctttttgctgatggagggtcttgcctccatggggatggctgatgatgatggtgctgaaggctggggtgaccggtaacttcttaaaataagagtgaagtttgctgcattgattgactctttcatgaaagatttctctgtagcatatgatgctgtttgacagcatattacagtagaatgtctttcaaaattggggttaatcctctcaaaccctgatgctgctttatcaagtaaatttatggaatcttctaaatcctttgttgtttcaacagtgttcagagtatcttcaccaggagtagattccattttaagaaactattttctgtgctcatccatagagagcaactcctcatctattaaagttttatcgtg[450 bp omitted]ggatgttgtg

SEQ ID NO: 14682 - DNA, 27592 bp, Human
  misc_feature (1)...(27592): n = A,T,C or G
tatcaaacagagcatttcaacaggctggctaatgtgtaggaagctagcttttctttgtgatataatttgtcatgtaaaatcataagctattttacaagtgtatttcattcactgtatcttaaaattcatatggttttatttaaagataatttcatcaaacagctgaattctaaaatcctacctttttttcaaaatcatttttcagaactttgcaataacaggaagtaaagaatcagaagggtgttaaaaaattgacttggggggaaaaacatttggacattttgctggctaggtttacgaaatatacacatccagcaaacatgtgagtccctttagggtacagtgcagtgaagggagaagtggaaatactcaaggttctggggaaggtcaaatgaagggtccctcacattggctgaggccaacctggcttcagaggtgtgcagaggcaccaggccgagaacagggctttgcagtggtgagggcaaaacatgaacacaagaaataccctaagttactgacctggttgtgcctggtgacagatgggaccagctcttttctccatttggtaattttggaaaatttggcagagttaataaagaaatccccttggtgcaagattgctacaataagaatctattatagatggcagatgtgaagttcacagtcctttttattatcctaacctagtaacatgactagaggtaaaattaaatattgagttagatgattgtttaatattttaaaaccagagggaagacatacaaatagattgagagcagtttctttctaaagataatcagaatatatctcctatattttaaacactgcaggaacagtcaaaattttaaaataaatggtttccacatttttttatccccatctctccccctgactatatagtaaaatattttatttggcaaccacgttttcctacttttaatcacacatcatcagagcttttcatcagcctaactagtcttcctactcactgagttgtgacgaaagcctggtctaggcacttttaccacggccatgtttttgttaagatccctgcagactgtgaactatgaaaaccagcccctggccccgcttgtgggtgctgcagagccgcgtgtgaactgctcctaggaaaccgcgtctctgggcagggtggctctcgggccgtggatccgcctaaaagcttttctgccagtgacgcccttggtctctggatgtgttcacgcctcagtgattttactctctggtttcttgtgtgtgcttgagattcttgagagaaagcgtgctgcagatgaaaaatgcagcctacatgaaaaagagaaggggaaagccattttaaaataacttccatgtaagttactgtaatcaaagtgctgctgcctgtgtgttcataaaaaaatatgtgcaagggcccggagcggtggctcatgcctgtaatcccagcactttgggaggccgaggtgggcggatcacttgaggtcaggagttaccgagaccatcctggccaacaaggtgaaaccccgtctctactttaaaaaaacaaaaaaattagccaggggtggtggcgcgtgcctgtaggtcccagccactcaggaggctgaggcagaggctgcagtgagccgagatcgcgccactgcactccggtctgggcgacagagcgagactgtctccaaaaaaattaagaattcaaatgtgaacccggctttcatggcgccccggccacggagagcctgggggagtgggataaaaacggtgctgggatgggagggcggcttgtccgcgaactcctcccaccacgcccggaccaaagccgccggcgccccgcttccggggccgccctaaaccgcggccgccgctccctgaggggccgcctgacccggcggaaagccaggctgtgtggccggaggtcaccaccccgaccccgactagtcccgcagcgcctgaccccttcgtgggcggccccgaccgccgcggctcgaggaggggcggggctggggcggccgagctctcgcgaggtttcgtcgggggctggcggctgcggctcggcggagagtgcggcatgcgctcggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggggacgggggcggggcgcgcaaacctcgcgaggagaggacggccctgagtggagggagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggggccgggcctcccagcgcggtacgcggtgccttttgagctccttgtccacgctccgccccggtgggaacggccgcgcgctccccgcaggtggtcatccgccgcctgcctccgggcctcaccaaggagcagctggaggagcagctgcgcccgctgccagcacacgactacttcgagttcttcgccgccgacctgaggtgaggcccgccccgaggggaggaagagagggcggaacccagagctcggcggcggtggccgtctcgttgccttacgttccttaccctgatttctcctatatgggagtcgtgtgagctttttgaataaatacatttcagtaaaacgtgtccgttccgtcaaagaaaaataccaccaacaaagaaacacagatgtggtttacatgaaaaatgcggatgattttcagacggctaacgcttaggaaagcgggtgcctttgaaaggaccagcgttgcccgcccggcgcctcccgggcttccctgctcgtccgcggacggggcgctgcggggccggggggcgccggctcttcctgtggcctccacgctggtgccgcagccagtgcggttttaaataccggagaaggtccccaagtcaggagagtctctcggcgccacgggttcctctgggagtgcgccctggccttgccttagggtttcagcctcggaggaccggttctgggcagtggagaagggacctgagttctgccttgtaaagttaacgttttgcgtttgtttttgctaaagaatatccaagttgttacaattaactgagatgatttggcacaaaagttttatctaaagtagtttgttgtgcccagaaaaggaaaaagaggctaaattaatggactattgtatttttcactgaccattttcactgttatctcttatttcagtctttatcctcatctctactcaagagcatacattaattttaggaatcctgatgacatccttctttttagagatcgttttgatggatatatcttccttgacagcaaaggttggattattggtttttaaaaatctattataatctgtaggtatactaatgaagtattgctagaatattcgtgctttttaaattattattattttttgagacagggtcttgctctgttgcccaggctggagtgcagcagccgcaatcacggctcactgcagcctcacactgcggctcaagcaatcctccagcctcctaggtagcagggaccacaggcgtgtgccaccatgatcggctgatttaaaaaaaaaattgtgtagagacgggggtctcactgtgttgcccaggctggtcttgaactcctggcttcaagtgatcctcccacctcagcctcccaaagtgctgggattacaggcgtgagccacagcatccggtctatttgtgcattttaattaaaaagttctcagactaaaataagtttataaattttgattatgttactgtaattatgtgcagatattaaaaattgaaattatttaattttattatttaatccaaaaaaattccagaaattctgtgtaatagtgacagcctatttatgtattatcatcagagaatgaaggttttcatgagtgagtttgttgcatgagagaacttgatctttttaggttctaaagctaaactattttacctgataggaattttccaaaatgtacactgacttctatcttcctaaacagcatccttcatgactgtaccatttatgataatgtcaccaggaagtcactgctgttaaacagctttgcctgcggagacagcagtcttcaactctactctcaatagttcccttatcagtacttctagggttctgctttcatctttttccttctcttctcctgtcaggctgtctgctgttgtgttcctggctgtcaagtttgtatacctttcacagcaagttgttttctgccctcccctccccagccaccctcttccgactccacgtgttttgacactgatgagtgttttctttttctccaatgaggggtaaggactagaaagattgttaaaaaaataagcattagccaagctagttcctgtgactagaagcaaatgtgatgcttgaactgacctttgtgttcattgctcatttattcagtaacttactgagtttccctttttcacttaaaaaatattggtgggccgggcacagtggctcacacctgtaatcccagcactttaggaggccaaggcgggtggatcacgaggtcaggagttcgagaccggcctgagcaacaacgtgaaaccctgtctctactaaaaatacaaaaattagccaggcatggtggcaggcgcctgtagtcccagctactcggaagactgagacaggagaattgcttgaacctgggaggcggaggttgcagtgagccgagatcatgccactgcatcccagccggggcgacggagcaaaaaaatatgtatgtgtatgtacgtgtatgtatatgtgtgtgtgtgtgtaaaatatgtgtaacatggccaggtgtgatggctcactcctgtaatcccagcactttgggaggccgaggaatgtagatcagttgaggtcaggggttcgagaccagcctggccaagatggtgaaaccctgtctctactaaaaaaaaaaaaaaattagccaggcatcatgaggcatgcctgtaatctcagatacttgggagactgaggcatgagactcacttgaacccgggaggcagaggttgcagtgagccaagatcgtgttactacactgtagccttggtgacagagtgagactctgtctcaaaaaaaaaaaaagtcacaaaatttataccatactgttttccacagtgactgcgccattttaggttcccacctgtagtgagcaaggggccagtcgtccttgtttccggttatctttgttgtcgttgttttgttttttagagatggggtctcactatgttgcccaggctggtgtcaaactcctgagctcaagcgattccccccacattggcctcccaaagtgctgggctacaggcgtgagccgctgccctgccgttgtttttatggtctctggcctaagcctgtgcttttgatgtcatatgcaacccattgccaaatccattgccatggagcttttcccctgtgtttttttccaagtgttttatggtttcaggtcttatatttaggtttgatccatatcgagttactttttgtatatggtgttaggtaagggtccagcttcattcttctggctgtggatatccagttttcccagcaccagttgttgaaaagactttcttttccccattgaatggtctgggcacccttttcaaaaatcagttgaccaagtattacaaaggtttatttctgtgctctctattttattcccttggtggatgtgtctgtctacatggcagtaccacactgattactttcagctttggaatcagggagtatgtcatctgccattgaatgagtatccactgtgtgctaggccttgtgggtggagcggtgacttggacatcgtccctgctggtccagtgccctgccgtccccctgagtcttgactttattctggatagtggaggttggcacaaaaatatctcccagttaaaggaattataattcagtcacctgactattactgacaagtcaaaaaaaaatgactcagtgggtttagtaccaaggtagcagtgttccatttgatgattcagcatatagcaggttctcttagtgaacatttctctttgtgtatttgtttttcccccacatagcaacgaagttagtttctaatgacttccattctctacttttatcagaagcagatttcacctggaatattctataaaccctttgaaaccctctattttagccatggtgtcttctaagcaaagtaattttcttgaacttaaataacaaattgatagttgaattaaccttttaaaataaaatgtaaagtgtagctaagaaatcattatttaaaggtattccaacgataaattatttgggatggggctggggaggtcaggtatattgaggtgtaagttacatatggtaaaagtcacccttttaaagtgaacaatttgatgaattttgaacaacttcagttatgcaaccaccacaacatgatggattgttttagtaaatgttcttcttaccaggagttcatccttgtttaagtctggagtttgccgtgttaaggttgcaggtgcttgaaagtgtaataaaattgtaggttttttaatcttttttttaatctcttactggaaggatgaattatagtttaaatagtaataatgcattgtcgttgttacacttactctttaagtaagttaggtcattattttccgaaatgaatgtagtagaatttcagaatggcttctggaacatgtttcctgttaaaaggcctagaatatcctgcagtggtagagtttgctccattccagaagatagccaaaaagaagctgagaaaaaaagatgccaagactggaagcatcgaagatggtgagccctttccaagtgctacgttatgaagctgccaaattaagaacactgagcaaatgtaattctcccgtagttgggaaagattatatttattttcttcctactttttaatgtctagatccagaatataagaagtttttagaaacctactgtgtggaggaagagaagaccagtgccaaccctgagactctgctgggggagatggaggcgaagacaagagagctcattggtctgttttgctcatttcttctcttttctttattgagagatttactcgtagaggatatacgttttttctctttttcttgactgtgataacaagttgaaacttgttacaggcttgacagaaatgtagagtgatttccagttttgacaaaagaatggcaagatggcagcatgggaaaatatttctgagcgttggttgatggagagcacgtgatttttttagttaagatcattttaagttatgatgcttccgaatgagcagtgcagaagacacatgaatggtctgttcctgagcgtcagggaaggcatgttgtgtcacatagttgaagtcagtggtcacagacggatgcctcaagagcccataggaatgagatgttttgcttgcggtgaggtcatcttgctgcttcaacacaaatgccaggctccccgagccaggccaacttgtggataagcccagccagagcacagaatcgagtttaaatccagccttccaccccatgcccacaagtggtgtactttagaaatagttacttcccagtagcaccaacatacttcccagtagcaccaacatgaaaatcaggcaaactgttgttgtttagtcccagacacacctggtagtgtttctcttctctgtggatctcctttcctcaaagccctggttcttcacctctcatctctcccgcccaggctgtgccctgcccacccatcaagatggatgtactttgggaggccagggtgggcggatcacaaggtcaggacttcgagatcagcctggccgacatggtgaaaccccatctctactaaagatacaaaaaattagcagggcatggtggtgcgtgcctatagttccagctactgaggaggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggaatatgggagggaaagaggttgggagactccctccaagatagtggtggagctggagctgagactggctgcgggagggaaagaggtcaggagatgagctgagcctggccgtgctgagcagtggaggaaggaagcgccaggggcagggccggctgctgtcgcttttcactgcaggcgcagagtgcaggcttgtggggttggcacacatgggtgagggcagcgtggttggaggttcagggcactgcaagacatttagattcattccagggcaactggaagccactgggggagtagcatggtctgattatttgtccccgtcactttggtggtgtcacatgggatagactgtggatgccaagagatgagcgtgtgttttggaggtgggctggacaggaccgacagacggatagggtgtgggaggtaaggggacaggaagaattaagactccagtgcttggcttgaacagatgggtggattgtggcaccattatacacaagggaacatgagggtaggacagtattgggggcaaagtcgagatttcacttaagaacttgataaattgaagaagagctagaagcagcaaattagacgttattacaggcctcatctccctgcccctcccatttccatctcactttgttttaaatgtccccttgcaaaggatcggtcactttagggctgttttgagacatacctttttggggcagacacgtggctcctgccggggtggggagaggggggcatgtcctggcacctccccgagagtctgctgcacagccaatgcttcacaaaagttggctgaatgaatgaatgaatgtggcttagaacccaccatccctgatgggagcgattaattcattccaggacttggctgtagagtcttccttgtttctgtgattgctgtttctatgtatgaaaaattgaaacttggccgggtgcggtggctcacacctgtaatcccagcattttaggaggctgaggcgggcagatcatgaggtcaagagattgagacctttctggccaacatggtgaaaccccgtttttactaaaaatacaaaaattagctgggcgtggtagcatgcgcctgtagtcccagctacttgggaggctgaggcaggagaatcgcttgaactcggcaggcggaggttacagtgagccaagaccacgccactgcactccagcctggcgacaaagtaagactccatctcaaaaaaaaaaaaaaaaaaaattttaggcaattcatggcagattacctttttcttttctaagcttttggcctccagtggattcttctgcacaggtctgagaagcaagtgttaaatggaaatactaataagctgtttctggcaaggactctggagttgttgagttagtctggtgcatcggcctttagcatcggcctttagagcagacaggcctgggttcagctctgagacttctgtttacttgtgttctgttgcatggttgtgcgtattctgtctgataaataacatacttttatgatgtgtagaacactttcttattcagggtctaacgtactttgcccgtgatccctgtgggtgatagggcagacattttataggaagaggaaggtgggcaagcggagtctggggtcagcctccccacacatccaggtggtctcgcccggctcctggctgacaagttcaggctttccacagagcagagcagaaccctggctgatttgagataatttgcccattacaaagagctgaccatttacctgagccagtgtgctgtactcaccctgagccagagttcatggtcagcccagggacccctgggggagtgttctctgtggcaactgtgtctgccacgaaatgtggcatttgtacctgcatcagctcttccctacaaccactgtgcctggggcagggctcctgggacaatcggctcttccctacaaccacagactgtccctggggaagggcttctgggacaggtgccatttcatctatgatgtcagggtgtcaggggttctcagttccaagtgatggatccctggccagggcttctcctatgattcctgattcattcctggtcctcagaattccagagatgatgtgtcagttttcaggtacatccagggattcttcccagccctgtttagtctgagatcttacagacccacagagtagaccccgtcttcccccttcccatttgtgtccttgtgttggtgggatgtggggcctgtccatgtcagcgcaagtccctctgaggtggggcctgtggggcctctagcttgcctgggcacccacatccaggtcagatctgagaggtcgggcatgaaagcgaaggaccaagatagagtctgtagaaatgttcattccctagtagttggtgccttttctgcaatcagcagcgccatatggagtcattttctttttcttttcttttttttcttttttttttttttttgaggcagagtttcgctgttgttgcccaggctggagtgcagtggcgcaatctcggctcactgcaacctcctcctcccgtgttcaagtagttttcctgcctcagcctcccgagtagctgggattataggcgcgtgccatcacgcccggctaattttgtattttttcagtagagacggggtttccttaggttggtcaggctggtctcgaattcccaatctaaggtgatctgcccgccttggcctcccaaagtgctgagattacatgtgtgagccaccacgcccggcccatgtggagtcattttctaaactacaatccagagttgtatgtcttatcattgggattttatggagtatatattgtaagacattacaagaatccatgttattttaaaactgttgcttggagaacggaaaacgaaaaagttctcagaatatgcgatgtatcaaaataaatatatgttatttaatgatttaaggcacctacaaaaatatcatcttggaatattttaagcctcccttaagaatcaggaattagatgtctactatgtatgaaattgttgatactttcaaattacttgacctgacagtaatggaataaaaactcccctggagacagtgtgtaaatttaaaaagtaatgatatggttcccgtatttattttaaagattacattcaaaacaagtatttaaaatacatctttctttaggagttaaatacaatattacaatttttgtgttttagctagaagaaccacacctcttttggaatatattaaaaatagaaaattagaaaagcaggtaggtctggcctttacctgatgaacaccctccctgcttctgccattctcatccaggcagtttatacacacgctcttccatgtctttagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaaggtaattctgaggaaacatttcctttttccaaaaatagctctgctatagtaattacactttttacatatcttagttctttagaattttgaaaacattctgaattaatctaatattgtgttgttatttttttccatcttttccatctttctttccatcctacagcagtggttatcacagtgcgtcctgagccctgggagtcctcaggctgctgttgggtgcctgtcctcctgggtgtgcagtggggagcacaccccacaggagccccacgctggcacacgttgggctgctgctgacgctcttttttttttttttttttttaaactttccaactttcattttcggctcaaggcgtacatgtgcaggtgtgttacatgttcattgtcagctcaacgcgtacacgtgcaggtgtgttacgtgttcattttcgactcaaggcgtacacgtgcagatgtgtcacatgttcattttcagctcaaggcgtacacgtgcaggtgtgttacgtgttcattttcgactcaaggcgtacacgtgcagatgtgtcacatgttcattttcggctcaaggcgtacacgtgcaggtgtgttacgtgttcattttcggctcaaggcttacacgtgcaggtgtgccacatgttcattttcggttcaaggcgtacacgtgcaggtgtgttacgtgttcattttcggctcaaggcgtacacgtgcaggtgtgccacatgtttattttcggttcaaggcgtacacgtgcaggtgtgttacgtgttcattttcggctcaaggcgtacacgtgcaggtgtgttacgtgttcattttcggttcaaggcatacacgtgcaggtgtgttacgtgttcattttcggctcaaggcgtacacgtgcaggtgtgtcacatgggtaaatcaagtgtcactggggtttggtgtgcagataattttgttgcccaggtaatcagcacagtacctgatgtttttcagtcttcaccctcctcccattctccaccctctacattttcctttaaaaaaaagttttcctcccagcactttgggaggctgaggcgggcagatcacgaggtcaggagttcgagatcaccctgactaacatggtgaaaccctgtctctactaaaaatacaaaaattagccaggtgtggtggcggacgccttaatcccagctactcaggaggctgaggcaggagaatcgcttgaacccagggagcagaggttgcagtgagccgagatcgcgccattgcactccagcctgggcgacagagcaagactccctctcaaaaaaaaaaaaaaaaaaaaaaaatttcctggccgggtggggtggctgacacctataatctcagcactttgggagaccgaggcaggcggattacttgagttcaggagtttgagaccagcttggccaatatggggaaaccccatctctactaaaaacacaaaaatgagccggacgtggtggcgtgtgcctggaatcccagctactcaggaggctgaggcaggagaatcacttgaacccaggaggcggaggttgcagcgagccgggatcgcgccactgcactccagcctgggcaacagagcaagactctgtcttaaaaaaaaaaaagtttccctgattaaaaaatacacatttgaaaaccactggttttgcctttctgtgtgaaggctgactcagaaccgggttttatcatttctttggcagtagcactaatgagtttctgtatttcttgctgagttttttctgtgactgatacattcatttatgagggtggtttaatacatagagggaatttttctctgtgtgaaatgtgttggccagaattgggaccagccattatctcctcagtactaaacctagatttgaacctaaggtatcactcattacttattatttattgaataccttatattcaataatattgtacaatatgaggaaaaaaatgaaatgtcaggacttggggaaagaagatagcttaggaaagggtggggaagagatcattgaaccatagatttgtttctgatatggtcagcagtcaaaaacagaaaagttggctgggtatgatggctcattcctataatctcaggactttgggagaccagggcaggtggattgctctagcccaggaggtcaagaccagcctgggcaacagagagagaccctgtttctgttttttgtagagatggggttcccactatattgcccaggctggtctcgtactcttggactcaagtgatcttcctgcctcaccctcccaaagtttggggattacaggcgtgagccaccatgcctggcctggtttagcttttaataagtatctgtgctcagtatgggggtctttcacttctaaatcatgtggaaaattgaaattcttttaatgcctgaaaaatggaatctgtggagaaatgcaaaagaaggtgtatcaacagcttaaagaaagacagatggctcatggctattttgctatttttttgtttggttttggtggggggggggtttgagacagggtctcaatgtgtcacccaggctggagtgtagtggcacagtcacagctcactgcagcctctacctcccaggctcaagtgatcctcccgcctcagcctcccattacaggggtgcaacatcatacctgaatagctaatttaaaaaaaaatttgtagaagtgggggtctcactatgttgtccaggctggtcttgaactcctgggctgaagtgatcctcccactgctggggttagaggcatgagccaccgtgcgtagcactcatggctattcttaataaagagaaatatggtttgggaggccgaggcgggcgtatcacgaggtcaggagatcgagaccatcctggctaacacagtgaaaccccatgtctactaaaaatacaaaaaaatagctgggcgtggtggcacacgcctgtagtcccagctactcaagaggctgaagcaggagaatcgcttgaacctgggaggcagaggttgcagtgagctgagatcacgccactgcactccagcctgggcgacagagcgagactccgtctcaaaaaggctggaccgcggtggctcacacctgtaatcctggcactttgggaggccgaggtgggcggatcattaggtcaggagatcgagaccatcctggctaacacggtgaaaccctatctctactaaaaatacaaaaaattagctgggcgtggtggcgggagcctgtagtcccagctacttggaaggctgaggcaggagaatggcatgaacccgggaggcggagcttgcagtgagccaagattgcgccactgcactccagcctgggcgacagagcaagactccgtctcaaaaaaaaaaaaaaaaagaaaagaaatacggcacacagaacagctcagctgtttaatgttcctctgaggatgctaagcagtgagcttatgtgtggccacatgggtgaacacacacaggcgagggctgggagggagcacagctgcccatgcgctccgcttggcctccggaagccttgcagggcgtggcagagctggcctgctccccagctcgtctccagcagctctggcctgctccccagctcgtctccagcggctctggcgtgctccccagctcgtctccagcggctctggcgtgctccccagctcgtctccagcggctctggcctgctccccagctcgtctccagcggctctggcgtgctccccagctcgtctccagcggctctggcctgctccccagctcgtctccagcggctctggcgtgctccccagctcgtctccagcggctctggcctgctccccagctcgtctccagcagctctggcctgctccccagctcgtctccagcggctctggcgtgctccccagctcgtctccagcagctctggcctgctccccagctcgtctccagcggctctggcctgctggtttctcatgaatgcaccagcggattccacctcaggactccgcacgtttccctccacagggacttccccagatgtgcccgtggctccttcttggcatctggtcttagttcccgtcttggctctgcagagagccctcctgggccctcctcttcctgcgtctctgatgctttactctcccttcatgtctgttcgtagcttttgatgctacctgaggttatcttattcctttgtttcctttttcatatttttgccactgttcacagcattcccccttgaccaccgttgcctcaggtggtgcatcaggcgcaagttccttcgaggcaggggcacctcttgtctcattcacagccattccctagtgcctagcacagggtcttaggccctggttcctgcacacagctcctcagacctcgggaatctgcagtaatatgagtgtcttatatgccaatgagaggactaggggctgggggccccaggcagcttcaggatggggactagttggccagaaagccaaggcaggactagagggttgggactttcagtcccaccctagcctccgagagggcagagggcctagagagaggtcaccggtggccagtgacttaatcagtcacacctacataatgaaaccttaataatgcctaaagacagggcttccaggggccaggcacagtggctcacgcctgtaatcccagctctttggggggccaaggcaggtggatcccgaggtcaggagtttgagaccagcctggctaatatggtgaaaccccgtctctactaaaaatacaaaaattagccaggcatggtggcgcatgcctgtagtcccagttactcaggaggctgaggcagaagaatcgcttgaacccaggaggcgaaggtacagtgagccgagatcgcgtcactgcagtctagcttgggtgacagagcaagactccatctcaaaaaaaataaaaaaaatagacgggccttccgggttggtgagcacatcaaggtgctgggagggttactgcatggaagctccaagtaccactacaccataccccatacccaccttgtgcattttttccgtttggctgttctgggttgtatcctttatgattagccaataatcgagaaaacagtgcctttctgagttctgtgagccatttcagcaacttaccaaatctgaggagaggccatcgggaacccctgaatttattgctgactggtcagaagtaccggtgacacactgggacttggaactgtcgtctgaaaggggggcagtcttgtgggactgagcccttgacccgtgggttctggtgctaactccaggtcgatgatctcagagttgagttgaatgtggagcacgcagctggtgtcggaggggtggtattgaaaaagacgtgcagtgtcagaaatgtaagaacagttcctaggcacacagaatatttgttgaatgggtggatggagatttgcacttcctatggttcacatttattacagacatgttactgttgcaatttttataaaagatgggcagttaccagaaaggaaatgtttaagttcccagattccacataggcagaataagaggatgttcacagctgacatggggcccacgcttgatgagaagcggcttccaatgctccaccttgcatgatgcgttgtgttcccaagtgaacacgtgtgattgaatgcatctgtgtatggtcttgctatgctgcaattatgagtgagaacagaattctcagatgtacaccttccatttctgttctacaaatgatctgtctgtggtgcttccgttttttttttttttctcccttttctcaagttagctgaggtgctttagtttcaaaaactatacagagagcagggagaaaggccaggggcatacagggcagatgaaatatgtcgtggcgacttgttcattaattctgtttcaggaaagagaataatcagtgttttgaaaactataaactattctaaaaatcatcagtaggaagcagccttttaaaaatttttttttccttattacaaaactaatacttgtctatgtcaggaaaactagaccctatagatgaaaggaaataaagtcatttcagttctgccatctagaaataatcactattggccgggcatggtggctcatgcctgtaatcccagcactttgggaggccaacgctgggggatcacaggtcaggagttcaagaccagcctggccaacatgatgaaatcccatctctactaaaaatacaaaaattagccaggcacggtggcaggagcctgtaatcccagctacttgagaggctgaggcaggagaattgcttgaaccagggtggcagaggttgcagttagctgagatcaagccactgcaccccagcctgggtgacagagtgagacgtcgtctcaaaaaaaacaacaaacaaaaactacaaaagttagccaggtgtggtggcacgcccctgtagtcctggctattcaggaggctgaggcagtagagtcgcttgaacccaggagacggaggttgcagtgagccgagactgcaccactgcactccaacctggacgacagagcgagactccatctcaaaaaaggaaataatcactattaatacagtgctgcagagccctttaggtggtggtgtgtgtgtgaacataaatagaagtgggggctgggcacggtggctcacgcccataatcccagcactttgggaggccagggtgggtggattgcctgaggtcaggggtttgagatcagcctggccgacatactgaaaccccgtctctactaaaaatacaaaaaattagctgagcgtggtggtgggcgcctgtaatcccagctacttgggaggctgagacaggagaatcacttgaacccgggaggaggaggttgcagtgagccaagatcgtgccattgcactccagcctgggcaacaagagtgaaactccatctcaaaaaaaaaaaaaaaaattagacgggtatggtggcgcatgcctgtcgtcccagctactcaggaggtggaggcaggagaatcacttgaaccttggaggcggaggctgcagtgagccgggagtgcgccacggcacttcagcctgggcgacagagcgagactctgtctcaaaagagaaaagtgtaagtgagattgtggtgcatgttctgttttttagccctttattcattacgtgaacatctttgcatcacattaacctaccttacttttcatgactaaaaaatatttcattcactgaatgttccaccacgtattaaaccaaaaacctcatttttggacctttagctttaattctttgctgtgcaaacatttggcttcaatattggggtatatttgtaattatttatttaacagcttcttttaaaatatgctctcaaggtgatactttactaacattgtaatttctcagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtgagcgtgctttcattgttatgaccacgtcagctcccagtcatggtgacgtaggctttgtcagtatgagtatgcctatttcacactgttcttggaatccaagactttccagggtgtgcgagtacacgttagccttcatttcccatcagcatggcaggaacgtagtgaactcgtcttgtctgcagtctcaagtctgtcttcagatcgggagtttcttcctgttgtttgctttgcttttgcctccatgtcctccttttactcctgagccgcctcctggattcctgctgttgcatgtcaggtcttcaggatctgtcttcccagtctttctttttgttttttgttttttatttttctctgtgtttgtgatatcttgccctttgctcttttatcccccttgcaatttatctacagaattgcatatttgggaaccccctcttttaggtctggcagatcttttgtgatagagaaacagaattttaagtgctgtgatcctttggttgaagctgtccctggctcctctggctgtggatcttgaccagcagctttggctgtgcactgtgggtcctccctttttcttttcctttgctgcatatgacagtgcagctctatggagggagctcatctgcgaaagggacagacacagcattatctgcccggtgggccagagagaccagccagatgccagtcaggagggatcctgtccctcttgctcctggcatccaccatcctcagggccccaggcacctgggcttaccttcccctccgggactcctgcccactcactgcctctcgccacccacagtctcctggtgcccagggccacttggcccacaggggatgatggacgtggattttaggtgggaagactaatgcgattaggctgccggcttcccagagccatagtcgtaggtgtgatttctcactgcctttcgttcagagttgatgaagtattttttctacttcttgggagttttggtttattgctttgtttataaaatttatatatgattatcaaatccatgattgtgaagcactgtgatgatgttaccggtgttgttactgtgacagttgatgacacagcaggacctactgccacgtgtctgctgtgaattcatacttggttacagatccttatggtccccaacagccctggcaaatgagcgaagcagccatttatttactattcatttaatattctgataaatgcataaagataattaatctgccattattaaatgtcagttaattttactctgcacatcatgatggatgtgcacctgggctcccaggacagccactggaccactttagtctcagtcattttatctgtagaaaagaaggtttattttattttgttttattattttattttattttaattttatttttgagacaaagtctcgccctgtcgcccaggctggagtgcagtggcacgatctcggctcactgcaacctccgcctcccaggtttaagcaattctgcttcagcctcccaagtagctgggattacaggcacccgccaccatgcctggctaatttttgttttttttttgtttttttgaaacggagttttcctcttgcccaggttggagtgcaatggtgcgatctcagctcaccacaacctctgcctcctgggttcgtgcaattctcctgcctcagcctcctgagtagctggaattacaggcatgcccctccatgcctggctaattttgtattttaagtagagacagggtttctccatgttggtcaggctggtctcgaactcctgattttaggagatctgcctgccttggtctcccaaagtgctgggattacaggtgtgagccgctgtgcctggcctaatttttgtatttgtagtagagacaggatttcatcatgttggccaggctgctctcaatctcctgacctcaaatgatctgcctgcccctggcgtcccagagtgctgggattacaggcacatgccaccacacctggctaatttttgtattttcagtagagagggggcttcaccatgttgaccaggctggtctccaactcctggcctcaggtgatcccacccaccttggcgtcccaaagtgctgggatttacaggcgtgagacaccatgcctggtcaaaagaaggtatttactttggagggttattgagaattagaaaatatgtataaaaagtaccttagcatggccaggcacggtggctcacacctgtaatcccagcactttgggaggccaagatgggcatatcataaggtcaggagatcgagaccatcctaactaacacagtgaaaccccgtctctactaaaaatacacaaaaaattagccgggcgtggtcgcgggcacctgtagtcccagctactcgggaggctgaggcaggaggatggtgtgaacccaggaggcggagctttcagtgagctgagatcccgccattttactccagcctgggcaacagagcgagactccatctcagaaaaaaaaaaaaaaagtaccttagtataaggcatattgcctatctgtcactcaactgaaatgacagatactattactatgatttattcctctttgtagtggtttttatcaacgcctgctgtgtgcccatcgcagtgcagcctcagcagtgcagcgctgagcacttcgcatgggtccctgttgtctgggaacctgtggtctagaaaggagggtgggcagccaaccggcggtttactgcagttgctgatcatttgtgttgaatcataggtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggtttttattaaacccaaaaagaaaaatgtgtctggctgtcttaaggtccaggctgcatgctgaccatgtcacccccacttggccttgtgtcttggggaacgcagtgctttgagcattttcaagagcagtttttcctgaaagtcagatcccagagtgagactagtcatcatcttttctcagataatcaaattatttttcaccaggaaaaagaaagattttatttagtataaaactagcacgtttatatgattcacttgagaataagattattaaatttacccttgagacaggaaggaaagttttaatgatatttcatggaggtttcttccacattattaacaacattctgattattggtgaatattcccatggctcacaaacacctgtaagttagatctgcacggacggtgagcacaggactgtggttacccccttagccaagcaaacaacttttttttttcaggagctaatttttgttcaggttgcattttcccagcgcagcactacagatggcatcacctttctgacagcaccaggccccaccctggcctcctagcaaactgagggctgcctagggttccagttcccactcacctccctccccatgtctaacccctggcagccactgtctgttctctgcctctgtgattttgtcatttcaagaatgcttgataaatggaaacacacagtatgtgagctttgagagtggctttcttcactcagtctaattcctttcagatccttccaggttgttgtgtgtatgaacgatgttcactttgaaactgtttcagtgtagctgggcatggtggctcacacctataatcccagcactttgggaggctgaggcgggtggatcacctgaggtcaggagttcgagaccagcctggccaacatggcgaaaccctgtctctactaaaaatacaaaaaatagctgggcgtggtggcgcgcctgtaatcccagctactcaggaggctgaggcaggagaattgcttgaacctgggaggcggaggttgcagtgagccaagatgatgccattgcactccagcctaggcaagaaaagcaaaattacctctaaaaaaaaaaagtttcagtgaagtcaaggctgaaagccagaggagagccttcttgtcttcacccttgaatgaacacctctagaatactccagttctctggggttgcctggacctcggggtgcacaaagtacagccatgcgtctttttgatagggcgttgctcataggagtcctcagtcttcagttggcttattttagcagtggtgaatggcctggtgtttcccccgacctgaggtgggggagcatttgctcctgtgtttagcctcacagtgctgtggtgggaatgaggcgctgtgtgcaggagctactttcccgggagcctggcatttgtcatgtacttctaaggtcaggctccatgctccatctgtgtatacaggtattgccctggtaagaagcagaattgtcggcccggtgcggtggctcatgcctataatgccagcactttgggaggccaaggcgggtggaacacctgaggtcaggagttcgagaccagcctggccaacatagtgaaaccccatctctacggaaaatacaaaaattaagcgggcatggtgacacatgcctgtaatcccagctactcaggaggctgaggcagaagcatcacttgaacccaggaggcagaggttgcagcgagcccagattgcgccattgcactccagcctaggcaacaagagtgtaactttgtctcagaaaaaaaagaaaaacaaacagagctatgcgtgctggctccaggcagcctgtccaggggcctgctgagcctgttcccacccctcccattggtcaggttcataccaaggaaaagaaaattaagttaaaccccctggtggtaagcagatgtgggcttccacacacagtccaggaggaggtagaggtgagctggtgaatcctggagaaggagcgcatgagatgtacccacatggtcgtccttgcagcccacacttgggctcctggtggctgttggaggctaaggctgcagctctgcagggagaataggcagggagcgggaggcgcgtggagcaggagctcacggaagctggaagccgccttcctcctctgccaccccttcagtgctggggcagggctggtggccccatcaggaggaattgtgctgctgtcgctgctgacactagccttcagggccactctatgcttccctggctgttgccttcttcaggccctcaacagctgcccttcatggacttcatgggtcatttttattgcttcacctccaggagtttaataaaatgatggggtgatgtcttctaaaaagggaccagttcagtctccctgctggtacatgctaggcagggataagccccatggaaattgcttactactcacgttaataagttttagttggcagatctgaaaccatctgtgagggtccacatctcattttgttcacttcccaactcagagggggacgtcatgattgtactgttcccacagattacatgttcttgtttgagcaataacatttgcccagataaccagtgtttacatggcttttttaattgccttagaatgcctggtttctgagatagtgctgtgaaaaaagggctgatttttagctgcctagttgattttctttggacaattcatatcatcaagttctagaaatatagggagatattgacccttctgtgttgctacctcttggaagagtaacatgccctcttatcctggcaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaagtactgaaatattctttgaatctgtgtcagggaaattctgatttgttagttcaaatgcctgacagcataatcatacagatcttctcttgtcttggtttggatgacactgagcagctgtcagaaacgtgcaaaaaattccaaaaggtaaggccttaaaatattttactggtaaatattacacagactttcaaaaggacagagaatgacttggaaaatcttttttttttttcttggagatggagtctcgctctgtcacccacgctggagtgcagtggcgtgatctcagctcaccgaaactcacgcctcctgggttcaagcaattctcctacctcagcttccagagtagctgggattgcaggtgtgcgccaccacacctggctaatttttcttaaacaaacactgtctacatctgccctatcagagcaagagagaaagacaaaacactaggttatgacaagcaaactcacccacccactctttaaaaaaaaaaaaaattcagggccaggcatggtggttcacgcctgtaataccagcactttgggaggtcgaggagggcagatcacgaggtcaggagatcgagactatcctggctaacacggtgaaaccccgtctctactaaaaataaaaaagtaaaataaaattagccgggtgcggtggcgggcgcctgtagtcccagctactcaggaggctgaggcaggagaatgaacctgggaggcggagcttacagtgagccaagatcgtgtcactgcactccagcctgggcaaaagtgcaagactccgtctcaaaaaaaaaagaatactaaacacaattcagaagagccacccagagggagacaacaatgtcacaactacttgtgccacacacacagactgtgctcttgtctattggttctacttgacatcaaagggaggctagttgtttgtttcatcaatgaaccacagctgcaggtggatttccacaccaggatgaatgaagactcagacatcaccttccatttccaagtgttctttggccgttgtgtggtcatgaacagcgtgagaatggggcctggaagcctgagatgaaatccaaaaatatgccctttcagaatggcaaagaatttgacctgagcatcttggtgctggacagtaagtaccaggtaatggtcgatggccaatgcttttagagctttgaccatcgaatcccgcctgagtctgtgaagatggtgcaagtgtggagagatgtctccctgaccaaagtgagtgcctgcaattgagggtgataaccagacttcctgttgacaaag

SEQ ID NO: 14683 - DNA, 36652 bp, Human
cattaaggtgagatgcactgaaagttctttaacccttagacatttctaaaagttggatattcatgccagtgtggcaggcagctaggtcttatccctacatcacctttgacaaaaaagccagccttcacaaggggaagaaaaaaggagagtgtggagtcattacccctttacatttgaggagcctcctactactttgcttcccctcccatagacgatgatctccttccgtttcccctgggagcttaaattccactccattcttccttccgacttccataaagaggaaacccctgtcacaatatacaagaggatcctgaccctggacaatgaatctaaaaatctttagaaggacttcaggggagtttcatgctccaccaacttcctatttcgttgagcacatttttgttgaatacatactccctactaaacattggagatacaaagggagacaaaaataatccctgagattatgtaagcagtttatggtggtggtggggtcaggcagtaagaatttacaataaagtgggataagtctaaatttagaggatgacaaagtgctataagaacacacggagaggacacctagctgtcttgaggatgttagataaagtatcttaaaggggaagcaatggcttgatgaaaccaaaggttgatgagttagccagggaaaagtagttgggaaaaagatatgtgcaaatgctcagaaagaaaatggcatatcctgggatctggaagtgtagtgtggcctgaatggaacacagtgtgagtgagataatgtgaaaataagctgaagcaagatgagatctaaatgggcttaaggaatgtatttcctcctcctagaaatgaatgctttgtttggttgctatactagtaacaggaattagacacgtttattaaaccgcttaccatttaacttggtaaatcaaagaacaatgatttttacaggtatcagtaaatgcctgtaattagatacgtggtaggctttcctgttaatatataatggttattctcagtgtttaaagaattaaagggactcgggtaattaccagttttagagtgaaccatttgagagataataccttaccattacaaaacaactcctagggaaagttatatgagacagcaaaggtaatagtaaatagtaaaataatatgaatagtgaataatatagtaaaaacagttaaaaatgatttagcaatttcttaaaaacaattgaccacgaaaaaaattcacagtaaaaccgagactgggaatatttcattcaaccctcacacatgctgctattgactggaaatttaagaaatgttcatttgttttgacaaaatggaaagcaactgtacattcttcctggaaactttagctgaggtcaaagttgtaaatgaaaaggatgattttttagagaacaattcagtagtattgttttgccttgtcatgaagaatttttgtgcttccacaaacaaaaatcttggattgttaggtgaacggtggcaatcaagtggttttcagaagactcaagtttcttcatctacaaaaatgacaggagtggggtcaggatgttcccgaaggctccttctactcataagagcataagatctgtgcctctaatttctcgcagaaacaaataatgagaacttcacaccaattcatttattatatgaatgttttgtcccgtgagaacactggtctatctttagatatgtaatttatcaaacttctttgggcaacccatcttctttacttttttatttttaattttttggttttctctttgtcaaattttcatggaataactacattcaggtgtagtaatagtaacgcaaagctctgaacaccacgagacaattcgttgcttccgaaacgcagccggcagcaggtactcgagatgagtagtgtgagctcccgagcacccgtaggtcggattatctggtaaggcaccggaagtgaccgcctcgcggctgcttcctctcctggagtccagagtcccgttgctccgccgcgatattcagtaaaccactgggagtccggcagcatggaggcagcgcgccctcccccgacggcagggaagttcgtggtggtcggcggcggcatcgcgggcgtcacttgtgcggagcaggtagggcggtgctcaggcggttccgcctctttccccgaccccaaaggggatagcactggaggccttcctcccaccccctccctttttcttcttccgggttccttttttgctgcgcccttttccgcacttattgctcccagattttagaaactgcttggtggtcctcagatgacctcactagctttctcttaggcgcagggaggagtgggaggcaaattatagccgagaaaccaaagctggctgatccgtgctcagatccttgtaatgtcagagcagacatgaggactttgtatttagacaaaaaattcagccccctttctttttctttttttttctttttctttgagacggagtctcactctgtcgcccagactggagggcagtggtgcgatcttggcttaatgcaagctttgcctcccgggttcaagcgattcttctgttgcgtcagcctgtagctgggattacaggcgccagccaccacgccccgctaatgtttgtatttttagtagagacgggctttcaccatgttggccaggctggtctcgaactcctgggctcaagcagtctgcccgcttccgcctaccgaagtgctggcattacaggcctgagccacagcacccggccctcagccccctttgttaattatcgtaggtgattgagtttagtttccagatagttgccaagtctttagtgcatcttaactaattaataaagaatcccatatgtaagttttctatacttcgaactcccaagatagaagaaactttatttctagtaaagttttgtaaaataatcagcgaaggattaaatgcatgtagggcttgctttcttgattatactgaatagccagaccatatatattcagatacatgtgtgtattccaaaaagttctacattattttgttgatataaagtaaacatgagcaatcactgaagtcataagaaatagtggaagaaactcaagtgtttccatcgttggatgcgtattttccgtttattcactaagtaaacatatatgatgcaggcaccgtattaagggctgagtgttcaactatgaacagcatggtatataccatgctggggactcacagcctgctggaagagacaatattacaatattgtatgtctatgcaagagatatcaacggttatcttagaggtgcctgtggagtatgtagggagtgaattagggaagaggaaatttttttaatcaaagaaggtatttttaaaatctcattatgaaagaatgagtgaaagtttaccaagtattcaagaaaagaatgtcatctccagtggaaaagcatggatcatcagggagcagtaaagcttaaagcatagatcataaggagtcttagcatgctgagaacttaacaagaatttacaagtagtcaaatgtttttgagcagtggagtaacttgatcatatgaaaaggcttgaaagatgattagttacaatgtatttgtggcagaggcagctggtttatacgtgaaactggagagccaattcgaaggtgatttcagtagtataaagaagttttgaggacctcatctagcaatggaaacagcagagatataaattacagaatatacagaggaaagaaagatggagagagtaatgatattgtcaaatatagaaagttcaaataaaatgagactgagaagaatcgcatgggtgttgggcacgatagctcacacttgtaatcttagaactttgggaggccaaggtgggaggattgcatgagtccaggagtttgaagccagactgggcaacatggcaagatcccatctccattaaaaaaaaaataaataatcccttggattttaaggattcatagatccctcaaacatgctgttttagtgatggagtaggaatagaagccagattattgagggtggtggtgtcgaggaaccagactttgagataagaaaatgctttcaggtacagagtgaagaagaccgaggttgtagctaaaggaaaataatgaaacattaacaagttatacctctaaattttgtggaagcaattattaaaatggctttatcgtcccacaatatgtactgactggaagaggcagaataggagtgccagagcacctggggaaagttagaccaatattctaagtgtttaatattgagggtttgctttaatttcatcccattgaagacaaatgaaatattattttaagataaatagaagttggtttaactggtaattaggaagatagtttattctcatcctctgcattataactctaaattggtataaaaaatagttgaagtaaataaaggatatttctttatatcacttttcttgttcaggagttctttgttagtgtttactgtaaatattattttctcagtatcagagtttaatattattcaccattgccccatcaagaccaaggataatggagacctttagatgaggaacagtgggtttttaattttctagattaattacattattaaaattgcattattctcaaccccaaaccatatataccagtacttaaagtaatttgtcctaattttttttctctctttttaaaaataagttggctactcactttccatcggaagatattctcttggtaacagcttctcctgttattaaagcagttacaaatttcaagcaggtaagaacctttgtataacttcttaatattaatttgaaaaaattgcaataacttgcatagcagttagggtaattgtgtatttttttctttcttaaaaattgacaagtacagttatatgctgtacaacatgatgttttgatacatgtatacattgtggaatggctaagtcaagctatttaaaatctttccaatttggatgccttttatttctttctgtccctaatttaattgctctagctaggactttagtactgtgttgaatagaagttgtgagagtgggcatccttgtgttgttcttgatcttggaaaagctttcagcttttctccattcaatatattattagctataggcttgtatatgaccatttttttgttgtggtacattccttccatacctaattgttgggtttttattatgaaaagacatttaattttgttgaatattttttctatatctgtagagatggtcatgatttttgtcctttgttctgttaatgtggtatatcacatttaccgatttgcatattttaagccatctttgcatccctgaataaatcccacttgattatggtgaattgattgcttttttttgagatggagtctcaccctgttgcccagactggagtgcagtggcacgatcttggctcactgcaagctccgcctcctgggttcacgccattctcctgcctcagcctcccaagtagctaggactacaggcgcccgcaaccatgcccagctaattttttgtattttttagtagagacggggtttcaccatattggccaggctggtctggaactcctgacctcgtgatccatccacctcggcctcccaaattgctgggattacaggtgtgagccaccgcgcccagcctggaaagttttctgttgttatttctttaaatacatgttctactcctttgtctttcttgtctccttctataacgcctataattcaaagatttgctcatttgatgccatcctttaattccctacttctatgttctttttcattcttttttcttcttcttcccttctgactgtatattttcaaataatctgtcttcagattcacagatgttttcttctgtgtgatcagttctcttgttgacatagtctgttgcatttttttttgtttcattcattgcatctttcatcgtcagaatttctgctttagtttttaaataactttttaaattttttgttttggttgcttattgtttttctgatttaattgaattgtttgtaacttcttgaagttccttcagcttctttaaacaattattttgaattcttaggcagttctgacatttgtgttcttttggtggcatatcttcttggtttatcatgtttcttactgccttatgttgatgtttgcacatttgatgacacacttgctgttttcagaagtatgggctagttttgctgtggaaagaccttcccctatggggagggctgcttgctagatgggatgtagcagttctggcaccagtgagggtgcccactttgtagtctgtgcagctccgtcagctgagttaattgttgttgaagattgcagggatcctcagcatccaactctggatgtctgcagtggtagtgagggttgttggggttttcaatgtcaatggctgctaatagcctcccaatcttttcttctcccacaaaggaagttgtggcttaggggatccctgttggcactgagtctgccttctgggttcagtggcagcagcgctggtgtctgataagtggtgcctatggagcagatagagctgaggcccaaaacacaggcatacacggaggaattaaagttctgggatctgggactgtaatgatattggtgcctagggtgcaggtacccgtactgctatattggtaatagaatatgaggtgaggatgcttgtgaggcagccagggaaaccaagaatgggaacacatgtgtgctcagagttacagcagcttcagtgtcagggcagggcctagctttcaatggcagctgagccagtgcctagattgcagacatgtgcagtgaggattggttgcaggccccaaagtgcaaactagcttactatggtgatggctctggtgtctgagatgtaggtgggcccagtatgggccgtagaacctgggtctgaggtgtaggcattctcagagtgaccatggccctggggttggaacactcacagggttgaggacaaagtgactcctttgccaaagcatcttgacattggccacttctttgtggagacaagatatgccgccatgtctcccactctagggttccctggcaggaatggttgttggtcccctcacagtagcaagggatgccagtttcctctgcagtgcaggccaccatttaccacagtggtccccaccatgtggctgatactgatagcctctgcctttctttgctcctagctatctcctagtttctcaggtatgccagggtcattattgattcttttatgtggttattctccattttcatgctccactgtgttgctgcagattgtttaatgggccgttgagccctctttgggctattttggcttgtgaagatttgtctatatttgttttttttaatgggggaatgaaggctggtatctcctacttagccatcttgatgacaatacctccatgtattctggagtgttttaattgtttaaaattacaaatattcttttgagagttattttaaaaaagctcgagttgagaattattcagatagaataccagaagctcccagaatgatactaaatttttaatcttctattctttttctccattttccttccacttagaattacttttgagaaagtttccaataaaaaattttcaggaaagatgctctgcaaatctaaaatgggtacaaatatacatgatatttattatcaatatgggtaggggtgtgtgtgtgtgtttacacatcagaaaagtgcttccaagccaagtttatacttatagataattagtgtctcagaatactttgtattccattaatttatattcacattatagtaggagtctaagaacagttgggtaatagtatcatagaaaagtcatctccaaactttttttttcctgtagctcaactgttaaaaagttttgccctgacatcccaatatatgtatactaataagttatgtgtatgagctacagaactacaattataaatgttataaagcctatgcaaaataaaatttctaaaatgtcgaaaaacgtacattctgatctttcttcccacccttcagtgaagactactaccatagcccttcatttaatacgatgtctctggtaatatcctgataatggaatataattttctcatgttgtaaacccataagaccaagggtagtttagtggcatataccatgttgtccctttataacctaaatagagatacatatgatagcttagtacttaggtatagccaaagagttatggagtttgggagaaatagaggaaaaattatagctattaatctttaaaaggtaaaagtacatatttaatgacaagctaagactgtatacataagagaaggatgtatagctgggtctcataagtatctttccagaagacctaattcagtataataatccaagagttgtgagacttgaattcagtttttgccggttttgtaagttatatacaacagaaggaaaaagcttggtttctaggcctcttatttactggtcgggtagccttggaagatctctgtaagctgcttcacctgtagtattaggttaatactttccttgcttacttcacagggttgtgaacttaaatgtgccaataacaaatatacaaatatcagctattctgtgtacagcagtaggaaatggcattatctttatgatttattgagtgcctatattatatattaaccaatgtgctaggcacataagataaggagattaaaagtatagaacataacaccaaaaagtcactagtgcttatcctgagggattaaggatgagatatgaagagtgatagagactttaacatttactctgtattatgtattgtttgtttagtgttacaaagagcatgattcatgacttgtataatttttaaaggagaaaaaagattactgctaataattcacatttattaagtgcttaccatgcatcaagtagccttctaaaggtttcagatctattctatgatccttaaataaccctagaagtaggttcttacataatttgtaagactgtaaaggggtcacgagaccaaaatttgagaactgtcagggccatgcagtaagatttccatgcagtttttaaggagcagctgaggttgaatatcaatgtgtaaggctgtgtggtctttctgcagcaaactgggcttaggactagagcaagcagatagtttatagggttgagggttttcaggttaacagtttaggataagagagcaaggaagtaaaggatttagggaaaaggtgaaatgattcacaattgaactttagctggacagaaaggaaagtgagtctagaatactgatggttttatagaacaggaaagaagagtgcaaagactagatgaccataaggtctgctagtaaatagagaaagcttgaaggataaggaaataaataagctgtttggctaaactgtagaaatgtaagtggtgttacccctcattttacaggtcagctctcattttattagccaggaaactatggcttgtagcacctgacttgcccaggagcggccaagcaaatatttaagtctctaaatgctgagtctagtcctctttccactctatatagtgcagttggctaacttgtttgttttataaacacaaaatagtgtataaaagcaaagtatttttattatttaagattcttgaaagaaaatactttaaaaatatacatttttaatctcttggatctatacagatttctaaaatattggaagaattcgatgttgaagaacaatcaagtaccatgttaggaaaacgctttcccaacattaaggttatagaatctggcgtaaagcaactgaagagtgaagaacacgtaagataattgttttcttaataacattttccattgttgaatcttgatgaagttttgcctgcctcttttcactccagctctactaccaccaccatttaagtttttaacatgtaaagtttagtgacattgatttccagtattattagaaaaaatacagtttttgtaagtttattggaattatataattagatttgggattttagtcttcacatttcaaattacattaatgtttataaagtgtccactgtgttctggatactgcattaggtgctgggatgcagtagggttaatacgaggtgttggctcctaggaactgtcagtgtcaaagggaatatgaacatgcatactataattatattgacatataaaaaacacagtcactgaaatactatcaaagctctgatatcagggcttaaggaagactttacagagagagtaaaatgaggggggtattaacagatgagtgaaattaagagttccccaggtggaaagaggcattccaggaaggggagattgaatgttcaaagacccaaagaaaggaaaagaaatatgaagaatagagatgtcaaagggattagggtgtggttaagtaaaggagattggcaatcaaggctagaagataagtaagtgagaacctgaagggtttttaatgtcacactataagaagttgagtttgggccggtgcgttggctcacgcctgtaatcccagcactttgggaggctgaggcaggcggatcatgaggtcaggagattgagaccatcctggctaacatggtgaaaccctgtctctactaaaaatacaaaaaattagccgggtgtggtggcgtgcacctgttagtcccagctactcgggagacttgaggcaggagaatggcgtgaacccgggaggcggagcttgcagggagcccagatcgcaccactgcactccagcctgggcgacagagcgagactccttctcaaaaaaaagagagaagttgagtttgttttatatttgggagaaattgtaaggtgattttaagagctggggcatcaatgataaaatagatttttttttttttttaaggaagatacatctgataggagtgttgagcatgaacaagtggctagtagccaaccaaactagaaggtggttatgatagtcaaaaattatgtgaagagtcaggaaattatgtacaggctcatgcctataatccccagcactttgtgaggccaaggcagacggatggctttagcctagaagttcgactctagcctgggcaacatagcaaaaccccatatctacaaaaaatatacaaaaagttaatcaggcatggtggcgtgcacttgtagtcccagctactttggtgactgaggtgggaagatcacctgagcctgggagttcaaggctgcagttagctgtgattgcgccactgcactccagcctgggcaacagagtgagaccctgtctcaaaaaggataataataatttttaaaaaattgatttgaaaaatgatgtaaggtctgaactgagacagggacaatgtagttgtaaaaaatatcccagatttgagtgagatttctgctataaatttggcaggactcaataaccctttacatgagaatgaagaaggcagtctcaggaaaggatgttgttagatgatttacagtatcctcagatgagcttcaggtaagatgagaagtagatttgtagttgtttctataagcagttctaatttatgagttctagctcataaattagagatgtgttttatctcctttagggataaaacacatatataccacatttgaaacacaagtaatttgagagaaaaaagtactgaattttatcaggaaaaaataaaaaatctgaatccccaaaccagataagtttctaatacttatagtggtattacatattccaagtaatatatttgtcaatttatttgtaaattgaggtgggctctcaaaatatgctaaatggattgtcagggaatttatgtgttagggcatttgaatgaatcagagtgcttcccgttaccatttgaaaaatatcccacatgcagcgcatgtctgccttctcttatccattgtcctttacatttttgtttttttaacagtttattataatttcttttatttaacaatctaggaagttggcagccatcagcagttctagtgctatttcaggtgcagttgggaattcgggaactcagtggagctgttagtgtagcgaactttgtatgtaaaatacatgcatactgccaggcgcggtggctcacacctgtaatcccagcactttgggaggccttggcgggtggatcacgaggtcaggaggtcgagaccgtcctggctaacacggtgaaatcccgtctctactaaaaatacaaaaaaaaattagccaggcgtgggggcgggcgcctgtagtcccagctacttgggaggctgaggcaggagaatgacatgaacccgggagattgcagtgagctgagatcacgccgctgcactccagcctgggcgacagagcgagactccatctaaaaaaaaaaaaaacacatgcgtacttttgatagcacatgtgaaggtatctctctaaaattgacctcattggtttcattctcagcaaactgagctgggccactcaacatggcttttatcatgtctgatgttaatgcatgttctctttttacagtaaattcatggccatcagatgatatcaatttcacatacctggcatcagggccttcacagccaccataggttttctcttccccatccattttgttcttatgaaatgctactgtgcttccccaggaacttcagtagtttcctagtgaggcgaggacgcagagtgtgtggctcacttccgtctggagaagtgtcctttacattttttagtgaattagagatagtatgttttactttcacgtctcttgccaaaaatttagcagtagctaatggaaagagtttttgtgtttgtttgtgctatttgtttttacagcagctaaatgcaaattatttttaaagttttgtcagtgcctataattaacttttgttcttgtcagttgaaattctaaccagattatttaaaagaagacttgtataaaatttctacatggattatgctatgctggattactggttttatgtatttgttatggaactgaagaattaatttgagttataaatgtctcattggatgttaagtgctatgatacagtttaacaaggtttgtaagtcaaacacttggcacagacattaacccctaaatcattcgaacaaagttgagcatctctcatagtagcatgcatttatgtttaaatgttttctaaaggctactatttatatgtggtttttcattcagtattaaagaacaaaagcaatatatctctgatatgtagttttagacccatttatgttattaattaatataaatttaaagccaatacatgctaggattaaagattatcatattttttacttatactaaaatataccccaaaagcatttggtttgctcgtaaagtcattatttgtacttaagaatataagtactattttttttaagcacttctagtctttttagattaagaagacataccataacctcttgttccactcactgcttttctgtactcataatagatatgaaggtaggatatggttagaattactaggtcttcttacagtaacttcccttgagatcagaaatcttcatcaaggcctgtcacaggtataatgagaatgcttaaatttaaaaatttcttgaagttttgtttttaacgtggggtcaacataccttttcaaccaacatgggattccctgaagtttaatacaaaactttgtgtgaatgtacctttttatgccaggggagaaagactagttttcaggagatctcaaaatggttcatgagcttaaaatgatttaagaataactggattagtacatgtattctcatgcttagttttgtaattgctataacaaagaactgagtgccaccaagaggcaaccttaatatattatgttttgcttttgccttattgaatttttagtttaaagtgaagttgtatccatgttgattatgtgtctcccttttctttcattgtttgatgtatttacagtgcattgtaacagaagatggcaatcagcacgtatataagaaactctgtctgtgtgctggagctaaaccaaagttgatatgtgaaggaaatccttatgtattaggaatccgtgatacagacagtgctcaggtaacattttaaggttggatcgtgagaaggaaaataaaagaattttctacatttgaattaaagtgttccacttacaattcctaaactgtaagggcagaagggaaatttttgtttcatgaccagtaaaccacagagtggttatgttttattcctgccaattttctttctttttttttttttttttgaaacggagtctcgctctgttgcccaggctggagtgcagtggcgcagtctcggctcactgcaagctccgcctcccagtttcacgccattctcctgcctcagcctcccgagaagctgggactacaggtgcctgccaccacgcctggctgattttttttttttttttgtatttttagtagagacagggtttcaccatgttagccaggatggtctcgatctcctgacctcgtgaccgcccacctaggcctcccagagtgctgggattacaggcgtgagccaccgtgcccagcctattcctgccaattttatatttttagttgacactatgtttttaagttcatgctgatgtgttatcagcgtgagataacccagatataatgactgtgctgaatattaacaacttatattacacacacattcattactctacttggggaatatgtgatttgcaacctaaataatataacaattttttccaaaaaggtgaagcgtattcaaaatgtactgatcttattctccagcaaaaaaaattcaaaagatctttgtggtacaaaatcatgatagaatcatagaacagaaaaggtcacttggcttattgttctgccctagataaactatcccaataaggtgaaacatctgtttttggagcattatacaaattccttttggtaatttaatttaattcagggcttattaacccttattgccaagaagctcttcctggtttcacaatactatgtctaacctcaagttcgttgttctgtctcatgacatgatgattttgcattaatataatttatattctgaaaatttaataatgttttctttcagcctattctcttaataattaggaattgagagaaaattaaaggaacttgattatcttcttataaacaatttaagttcatattatcagagattgagctcataactgttttagctcggtcctctacatacatgaactcattgaatcctcatgataatcctgtgtgacgattattactcccaatttacaaataggaaactgaggtcaagagattaagtatgtatctatactaatttagctgttaagtctatcagatacacaatttaaacttgtgcttttcacctctaggtccagtgctcttgcagatgtttcttaaattgcaatatcctcaatgaaggacaaactgaaataaacttcagttgtttttttcttggagaattttaaagatgtcagcttcagtgaatattataagtttggagataaatttaatataaatttagtaggagggccagatgtcattctgaagcagtgggactattctatacttctgaaagtgcccaaagaattaccactggcttctctctcttttttttttttaatatatctatatttattatactttaagttctagggtacatgtgcaccaagtgcaggtttgttacatatgtatacatgtgccatgttggtgtgctgcaccctttaactgtcatttacatttaccactggcttctctaagctcattgtgatcttttttttctggggggtggaggcatcaatgtatctgtcttagaatgttaataacatttttttttttagtagaagtttgacattattgggtgcgtgctactcctaccagctttgtctgtgtcatctcacataatccttacagaaacattaggatatatagtcccttatttccatttatagttgaaggacctgagatgcagatagggtaagcaacttgcccaaagtcattcagttagtaattgctagagccagtgcttccagagtctgtgctcttaaccactatgctgctgagcttctcattcctagaagttttaagtgttgagtaactctagggaaactgagagtctaggtgaaaagaaagaataattgatttggtcaaataattgggaatgtggtaagttaatagtgcctcctgccgaaattctgaagtactgtaaatgtaatgacctaaaaggaaaggaaaatcaggagaggcattgctataaaggcagcttgggataaagcataaagggggacttttgttatattaattgagaggatgtaccctgatacagtgggaaagtgagattcatttttttcctttacaaattcaataaaatatttacatttttagaatattatcgaagcctcatatttcagattattgcccactattacaaaatactacctcattattttctttttaacataggaatttcagaaacagcttactaaagctaaaagaataatgatcatagggaacggtggtattgcacttgagttagtgtaagtatatatttttaaatatgataacatttaaattgtttaaaaataatttgtttttaaattaaacaattgctttgtgattcttgtgatttgttggcagactggaaaatgttttttattctgaaaatcaaagataaatataattttcatatgttttcaaggggaaaaatccaccatatttttttagctcttgtggaatccgtaattgtagaaattttattataaaatatatatgttttgggaatgctttaggtctcaaggtgattggccaaatttggcccataaatgtgttttataagtatattttatgtttaaaaataattcaaatatttacaccttttgagatttctagtgatagccctcaccactttttattgcttatatgataaatcctgctacactcatttatgttacctgtctggccagtgtcacccaaaatgtttgtgactcctgttttaggatatgtggttcttgcagctctttttttggtagcttgggaaatgtgaacacattaattaattttcatcttaagacgatattacaagttcaaaaaccattgagaaatatcctgctgtgtcctgcagaagattgattcacttcatgattttatcctctagcagatgattgacatgaaatagtctggatctttttcaggccataaagttgagtcaaaccacaaagaggacaaatttgaatcaaaataaggactctgccaaagccatatctttgctcacttgcattcaatccaactctcagactaggtttttgcccctcttttagcggatgatctcacccagtggaagcctgtaagagttcttaaattgcctgagtactatgggtaacagtcattattgttattatgaagtttgtggcattatatggagaaatacagagaaagggtcaaaaccaaaatgtgggccaagagggaagaggtatagatttattgtaaatggggcttcaaatccttgtgtataatatatacatgccagattttctctatcagctctcaccaaagtatcacttactattattataattgttatttacatttaaaaattttatgttcaaaaatgttcagagtcttacatttaatcctattcatcattttctttaagttggagattgaagactgtataattggataaaactcatagttttgtatttagtaagctcttctttggtaattaaaaatggacccacataatgttattctctgacttgaggtctgctgcgtgattaggtctttgtctctcgtgaaacttggcatacccataccctttctacactgtgtttcagtgaaactaatactaatgttcttcattatacatttatttcagttattatctgttttctcctttctaagtgtaagttaatcctttccttttcaaacagatactgtttttcataacttcacaaaaccgcaatatctcattgtctgcttctgtagagtcattttcaaaatgaaagcagtatttcccctctgtgtgatgataatcgtcaaactgtgcatcttgctgagaacatagttcaagtcaggaaaagaggattagaaggtgtcctaggaggtagagcaagtactgaagtttcttgtggttacttgtaataactttgtctgctagtcagtcatcagtatgctgaagtgcactgataggtgttatagtgtaatattactttaaatttaaaaatggtaatatagagaaattcccagtttttcaaaaagaaagcattacatgataactgtatgcctgtatgtaaattgaaatacaaactttattaccaaatttgtgtgtattccactttccgctggtcagtaatgctatatgaccagagtaacataaaatagaatgttcacccaataatcttctatgtttactgacatagaagagctggaaaaacgaagacttattaggtaaagcaaggagttccttatcaccatatgttgaaaagtatgaatatcaagtgacctggattcagatgtactaaaccttttttcgtaatctgtttattgattagtcttgaaaagtcgtgtaacctatgttatatcagtctgtgaaataaagatggcaatactttgtaccgtaaagaaatgtgaaaaattaataccttaactttttacagtattttattagtatcgcaagtttagataaaatcctattatagttaggatggccatatatcttgtttgtctgggattgtctccatttccaccagttgtaccaaaaatgattattagtagcagatagtatcccaggttaggtgataaattatgtgatcaccttaattataatggacttcagggactttgtgaaaggaatattgttaggaaaaccacttcttagcatctaaacctagaataaaatatcacatgcccattaccttacattagtggtaaatagtaatagaaggtggcttatatataccattttcattctttccttcctctaagatccttgatccttgatcttgatccttaagatttttagcttataactctgattctttccattttctatccctttccgtaatgtgctttgaagatataaaaagttgttaccaaataagtgactgattctcaatattatagctatgtgccatccatccattacttgattacactataaccagattttttaaaaagcactgcttacccctgggggccattcatataataagtgtattgtagaaattgaacattttctaatgatgtacattgtaatgaaattttacttgatattcagtacatgtatttgtcacttaaaggttctttctgtaaactgcttcagattcttttactattcaatttttaattcttaatatctgtaaagaacgttaatattcctctttataatcaatctttcccagttagccttaaaaatgtattccctacttttgcttcaggagatcattatttgcaaatgcaaagattttttacttagacttttgaaatcactcttagtaactttaacattgtttttaggtatgaaattgaaggctgtgaagtgatttgggccattaaagataaagctatagggaatactttcttcgatgcaggagcagctgaattcttgacttcaaagctcattgctgaaaaatcagaggctaaaattgcacataaaagaaccagatatacaactgaaggtaagtgtagcacctagctcattaattctcatacaaaacttttttaaaaccatatagaaaagggctacaagaaaatttaataaaataaattttggaaatagtaatatggatatttatatatctttacatgaagttttcagattttctattttatatatatgtatgtattttatatatatatatataattaaaacaagaaatttaaaataaattgaataactcagcccatctgcatctttgcaaacagatactacattttggcaatacctgaagaagttttgtaaaaaatgcagtgagttgaaaaactaatacaaacttcatatttttttaagtttgatagctttgaaaaacttttagattataaaattaaacaagagttttgtacattttggaggtgctaaaaatagataaaattataaaaatttgaaggctaattttcttacccttccagttaaccgtgtaacatccaaaacgtaagttgagtgtgtttatactcaacacacaactgaaagattatctgttttgtaactctacatcagaaaaatattaatgactaaaatgattaatatagataacataggttagtcatgctgtaatgtatgtatatatatgaatcattacattgcctaaataaaaaacttcagaacactaacatatttctctatctggtaatttttatattatttaatttcatctctttaggaaggaaaaaggaagctagaagcaaatctaaagcagataatgtaggaagtgcattgggaccagattggcatgaaggcttgaatcttaaaggaacaaaagaggtatcttttcatatactaattggtcatgtctaaatgtaattttaaattcttgaaccatttattaaagactggtaataaatatatagtcaacgaactgctaggtcactttacttaaaatccatagtgttaggaaaagacctccaatgcagttggtccatttggccaccaaagaaaactgaatgtcaaagcatcgaagactggatctcagcctacgttttaactcttgaggtgtgatactgtaatatatatacagtcataccttggagtattgcaggttcagtcccagaccatcacaggaaatgatataccacaataaagtgagccacacgaatttttcagtttcccagtgcctacaaaagttatgtttataacatactgcagtctattaaatgtgcattagcattgtgtctaaaaatacaatgcacataacgttaatttaaagatactttattgcttaatatgctaacaatcatctgagccttcagcaaatcataatctttttttggtggaaagttttgcctcagtattggtggctgatgactcatcagggtggtgcttgctgaaggtttgggtggctgtggcaatttcttaaaataacaagtttgccccatcaattgactcttcctctcgtgaaagacttctctgtagcgtgcgaagctgttttatagcattttgcccagagtagaagttctttcaaaagtcaattctctcaaactctgctactgctttaccaagtatatgtaatattttaaatccttcatcatttcagcaatactcacagcatcctcaccagaagtaaactccatctcagataactacgttctttgctcatccatgagaaacaacaactcatcttttcaaattttatcatgagattgcagcaatgtagtctcatcttcaggattcatttctaattacagttcttttgttatttccaccatatctgcctttctccattgaaatcttgaatccctcaaagtcatccatgaaggttggagtaaacttctttcaagcttttgttaatgttgatattttgacttactcccttgaatcatgaatgttcttaatatctagaatggtgaattctttccggaaggttttcaatgtacttttcccagatccatcagatgcatcactatctgtggcagctatagccttatgaaatgcatttctttaataagacttgaaagtaagaattactcctggatccacgggctgcagaatggatattgtattagcaggcatgaaaacaacattcatctccttgtgcatctctgtctgagttcttgggtgaccaaatgccttgtcaatgagtgtagtattttgaaatgaatctttttttttttttttctgagcagtaggtctcaatggtgggcttcaaatattcagtaaactatgtaaacagatgtgctgtgtattactccattctcacagtatataaagaaatacctgagagtaggtaatatttataaagaaaagaggtttaattggctcatggtcccacgggctgtacaggaagcatgactggggaggcctcaggaaactttcaatcacgggggaaggggaattatgcacttcttacatggccagagcaagaggaagagagagaagggggctggtgccacacacctttaaacaaccagatctcatgagaactctaacatgaaaacagcactaaggatggtgctaaactattagaaactgtccccatgatccagtcacctcccaccaggccgtacctccaacattggggattacaatttgatatgagatttgggtggagaaccaggcccaaaccatataatgctgtcatccaggctttgttgttccatttacagaggacaggcagggtagatgtagtatagttcttaagggccctagaactttcacagtggtaaataggcattggcttcaacttcaagtcaccagttacattatcccctaacaggagagtctgcctgtcctttgaagccaggcattgacttctcctctatagttgtgaaggtcctagatagcatctttttccactggaaggctgtttcatgtacactgaaaatctactgtttagtgtagccacattcatcagttatcaattgtatatttttgttgtagagatggcttctttacttaaacatcatgaaccaacctctactagcttcagccttttcttctgcagcttcctcacttctctcagcctttacagaattgaaaacagttaggggcttattctgggttaggctttggcctaagggaatgttgtggctgatttgatcttctctccacaccactaaaactttctccatgtcagcaagaagactgtttcgctttctcatcattcatgtgttcattggaataccactttagatttacttcaagaatgtttcctttgcattcacaatttggccatctgttcagggcaagaggcctggctttccatgtaccttcctcaataaccctaataatcattgctaccttttgatttaaagtgagagatgtgtgatccttactttcacttgaacacttagaggccactacagagtaactgattgccctggtttcaatattcttgtgtctccgggaataaggaggcccaaggagagggagagacataggacaacagctggttgatggagcagtcagaacacagaacatttatcgattaagttcactgtgttagatgggtgtggttcatgacaccccaagacaattacagtagtacatcaaagattactaatcacagatcaccataaaagatctaataatgatgaaaactgaaatattgcaagaattaccaaaatgtgacagagacacaaagtgagcacatgctattggaaaaatggcactgataagacttgcttgatgtgggtttgtcacaaaccttcaatttgtaaaaaacacactatctgcaaaacagtagtgaagcacaataaaatgttgtgtctgcagttttctggcacacaactcctaaaatttttggcatctccaaagtgatgtgtccttttgtatgctaacgagttgactggttagcccctaggtggcttcagaatggggactggtcacaggaaagaccaagacatgattagagtttagactttccaacctacaggaagggaaagaggttgaaggttaagccaatcactagcagccagtaatttaatcagtcacctacataacacagtttccatgaaaacccaaaaggactgggtttggagagcttctggatagctgaacatgtggaagttgctagagggtggtctatctggagagggcatagaagcttcatgccccttcttatatgctttgccttatgtatttcttcatctgtttcttcgtgacatccttgataataaaccagtaaatgtaagtaaagtgtttccccaaattctgtgagatattctaataaattaattgaacctaagaaaggggctcgtgggagccccttgatttatggttggttagtcagaccaactggtaaaacacccggggcatgcaattggtattggaagtggaagacagtcttgtgagattgatccctcaacatgtgggacctgatgctatctccaggtagataataacatcagaactgaattgaattagaggacagccagatggtgtcctgtgcagaattaattgcttgcttagtgtgtagaaaacaccccacacacatttggtcacagaagtattctgtgttgtgagactatagtaggagaaactgagtttgttttttcctatatcctcagatcagggatagagctttctatacccagactacagtgaatactcctgtcctattttaaattaatcttttctcaaaggtcacttcagatgcatgcagtaaacttacaaaagttattagatggattggaaatacacacttaatatcctaattggataaggagatgatttgcttttcctcattttgttagatattttgattttttaatagttgttaaagggctgtgaaatctaaatgctgtaagaagcatgcatgcagtccttcgttactttgtgtgatttctttagagcattggtttttggctttcagtaggtaggaggggagctggctgcacggtgtatctaatttttgtgatggaaattacacaaagtcccttcttcttgcaccttcagatcctaatattatatttttaacctgagaacttcaacagtttaattcaataagcatttattgagtatttactacctacgtgggactttattaatgttcagggatacgacagtaagtcagaactgacctgaagaaaattttatagtccataactgttgtcattttttaaatttttatttatttatttatttatttattttatttatttattttttttgagacagagtctcgctctgtcacccaagctggagtgctgtggtatgatcttggctcgctgcaacctctgcctcccgggttcaagcgagtctcctgcctcagcctcccgagtagctgggactacaggcgcacaccaccaggcctggctaattttttaattttagtagagacagggtttcaccatataggccaggctagtcttgaactcctgacctcaggtgatccacctgcgcctcggcctcccagagtgctgggattacaggcgtgagccactgtgcccaacaactactgtaatttttaaaaaatgcatttgtaattatcaatgaggcctaggctaaaaagcattccctcgatgctatctgctaatgcagctaccagatctcttaagttactgaatgaatttttgttcactcctttcatgtgcatagagagacttattttagggcacccaatgtggtttcatttatattataagaattatgttttctatacgtttctacaagtatacgttttttcttcatcattagtaacccgggttattctttctgcaagtattatgctaaccagtattttcttaattttagttttctcataagattcaccttgaaactatgtgtgaagtaaagaaaatctaccttcaggatgagtttagaattttgaagaaaaagtccttcacttttccaagagaccataagtcagttacagctgatacaggcaagtaatgaaataagaaaaaatatatataaccacttaattaaaaggaaaacaatcctgctgtgttctattaaaaataacttcgtatttccatataaaatttaaacatgaaaagtaaaaataaaaccataatttaataacattaactcacttcatttcactatctgttgttttctagtaaattaaatcgtatagggcattacatcttacatagagctgagtgttttgaccaacaatcagaatatattataaatcaaaataagacaaaaacctagagctcttaaaggtgacatgatttcacccaaatcagattgaaaatgtatatttttgggactaagatgcagctctcctaactccagttccacaactcctctgagaattgccatgatttgaagaaatacactcagttaactagcatatgaaatattctactgttctgaattctttgaatttttccataggaaaggggaatttgaatatgagtagtgagggaagacacctagttgaactaaacacttaagtggagtgtaaagtattacaaaagatttttagagaaataatttagaaataatttaaatgtactttgtcaaaatttatgtgtccaaatttgaaggaaaaacatttaaaatgccatggttttaaaattatacccaaacgagatgatgctaattgcattaaaattgctttagcaaatatgcctcataataattgctaaggagtgtgttacaaagttatctcttgcctttctttttctttctttgtttctagtcattgtagtcacatacactgctgtggtgatggttccatttacaaataaagtctgtttttttggtttttttttcttaaagagatgtggcctgtctatgtggaattgaccaatgaaaagatatatggctgcgatttcattgtcagtgctacaggagttacaccaaatgtagaaccttttctccatggtaacagtgtaaggtgaaatttttttgtccagctgtgaatatatttgaagtatttttgtgaagatctctaattctcaaacatgaataattattattttagtgtacaactgtaacttaacatggttggaaacagtttggttaaaacattgtcttgatttacggtattttttactgcttaaaatccttacatagttatatccttgcataagcgtcatcagtaatggtttataatgtacaatttatttatctaaatgttggtaagagactgacacctcccgtgacttctcaaaaatgattcttttagagaaaccatcttgtattttttgcttttcagcacttgaagcttacaaaaaaaaaaaagaatattcttgtagttatggataaggtagtcacatggttattggatacttttcatgttgaaattctgacagttttatggatcagtcttagttggaatttgatccatggaaattcagctcaggtgtctaaactttgctgatatttttcattttctcattaaagatgagcatgcaaagtgtaacaatttaatttgttcttttactttaaaatggaaaaagtcgtttcatttttcttaacacttaacgcttatgaggaatgttgtttagtttgatctaggagaagatggtggcctgaaagtggatgatcatatgcacacatcccttcctgatatctatgctgccggtgacatctgtactacatcctggcagctgagcccagtctggcagcaggtaagctagcatatataattatatgttttcatcagagattctgtctgaaaataaagcggttgttaccaacaaatccaacttctggttttccaacttttctgcttaagtaggaagctagcacagagttgttatatatattttaaaaaaaaactagaatatttccctgtttggtaagttatcattataatggtagactgagacatcttttactttaaaagaaattatgggctattactttgtttttcattcttacctgcttatcagcactgtccaggagaactttctgtgatgatggaaatgtttaattcctcaccatctagtcaggtagccagcagtatgtcacatgagcacttgaaatgtggttaatgtgactgaggaactgaattatttttacttacttctcattaactttaaatatatgtggctacgatgttggacagcacaactttagattaaaaaaactactaagattgtaaattatatagaaaagcattctattcctttatgatcctattctgtccctgtggtaatcattactaaaaaatgttctgggcgcagtggctcacgcctgtaatcccagcactttgggagggtgagaggcaggtgtatcatctgaagttaggagtttgagaccagcctgaacaacatgatgaaaccccgtctttactaaaaatacaaaaaattagctgagcatgatggtgtgcgtctgtaatcccagctattcaggaggctgaggcacaagaatcccttgaacctgggaggcggaggttgcagtgagctgagatcgcaccactgcaccccagcctgggcaacaagagcaaaactctgtctcaaaaaaaaaaaaaaaaattcctgtagtaaacacctttcctgagccttaacaagtcccaactggatctagactttttcctaccctcacagctttacctacctcctcctaacggtggaacaaaaatactagaggaagataaagacagtgaccagaggtgtgcagaggggtagagacctaggtagatgtttgaaataaaggaaccaggcaacatttacctttgttaaagaccagctccacagttagggacattattcattcagattatgcagtgtgaagtaggagaagagctaaaagtatttcaagaggcagcaccatcattttgtgttcttacagacagtagagacatcagtaagaatggttccagcctttttgtttctaacctgcctcattctatgtcatttctgtggcaagactatcacaaattcttagagttggagtttatgggtttttttttttttaacatttttaattctctagggtaaattatatcttaatgtgttataatctgaaagaggggaaaaaatccgaaaataaacagatggccttgttttgagtgcaccttataggccccatttcttggcttacacaagcaataaggatactaatttatgcagttcaagatgcaaattttccggccacttgtattagctgttctctagttgttactgtgctcagtttattctgacccccagccataaactgcctttcacttcatcaaatctataataccttgtttacagaggagattgaaaaaaaaaaatctatcacttctgctagaaatgcttaaaactcatgtctatgattatgatattatttctgcaaacaaaagacagcattaagtacatatgcacatacagggaggtagaaggaaaccaagtgcttattatacgctaacctgtttaattctctcaatagttacagagtaggtagtgttatgtttacgtttcaggtaaatgaaccgaggcccagaaaagttaaatatatatgtagatctgttgatattaaaatccactgtgactcccaaggtcagtgtttttttttttattattattatatttaagttttaggatacatgtacacaacgtgcaggtttgttacatatgtatacatgtgtcatgttggtgtgctgcacccccaccccacaagagtccccggtgtgtgatgttccccttcctgtgtccatgtgttctcattgttcagttcccacctatgagtgagaacatgtggtgtttggttttttgtccttgcaatagtttgctgagaataatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgctataaacatacgtgtgcatgtgtctttatagcagcatgatttataatcctttgggtatatacgcagtactgggatggctgagtcaaatggtatttctagttctagatccctgaggaatcgccacaccaacttccacaatggttgaactagtttacagtcccaccaacagtgtaaaagtgttcctatttctccacatcctctccagcacatgttgtttcctgactttttaatgattgccattctaactggtgtgagatggtatctcactgtggttttgatttgcatttctctgatggccagtgatgatgagcattttttcatttgtcttttggctgcataaatatcttcttttgagaagtgtctgttcatatccttcgccgactttttgatggggttgttttttttttgtaaatttgtttgagttcattgtagattctggatattagccatttgtcggacgagtaggttgcaaaaattttctcccattctgtaggttgcctgttcactctgatggtggtttcttttactgtgcagaagctctttagtgtaattagatcccatttgttaattttgacttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatcccgtttcagctttctacatatggctagccagttttcccagcaccatttattaaatagggaatcccttccccatttcttctttttgtcaggtttgtgaaagatcagatagttgtagatatgaggcattatttctgagggttctgttctgctcgattggtctatatctctgttttggtaccagtaccatgctgttttggttactgtagccttgtagtacagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggaattcactcatgatttggctctgtttgtctgttgttggtgtataagaatgcttgtgatttttgcacattgattttgtatcctgagactttgctgaagttgcttatcagcttaagattttgggctgagctgatggggttttctagatatacaatcatgtcatctgcaaacagggacaatttgacttcctcttttcctaattgaatgccctttattcccttctcctgcctgattgccctggccagaacttccaacactatgttgaataggagtggtgagagagggcatccctgtcttatgccagttttcaaagggaatgcttccagtttttgttcattcagtatgatattggctgtgggtttgtcatagatcttattattttgagatacgtcccatcaataccttattgagagtttttagcatgaagggttgttgaattttgtcaaaggccgtgttcttttataccagggagtctcaaaacttcatagaaataaaataaaaatacaatagatgaattaatacggtcatgcaaaacaatttaaatgacttcccagaatcagttgctgagatatttatgttgtcttggtgaggcaccaagagtctgtctaaccactgaggttaacagcacagcagaccttaagtagtgcataaaaatgaaggttgctggaaaatagaacaaattcttcagtgataatttgacatctctgttaatggtgatgacaaatttttgaagaagggactggttaattaaaacatttttctcacctggtatagcttaatatagtttcataatatttaatagaaatgctactaaaacaggtgtgattggtatcatcttttaattttagaggcagtaatttagatagaattaacaaataccaaaaatcagtctgattagttatccattggtgactgcttctgtggcaaagatgacagaaagactgtcaaacattgaactcctttaagtgaatttacaaggttaacatttttcagataatgatcatgaaaaatgacattgtgtaacattttttcatcatttcagatgaggctgtggacccaggctagacagatgggatggtatgcagcaaagtgcatggctgcagcgagttcaggagactctattgacatggatttcagctttgaactgtttgctcatgtgacaaaattttttaactataaggtaagatagttaagcatattaatgccttctctgcttgttagtcttatgactatgataaatcatgtgattttcttgcttgaataaaaacgtacatagttttaatcatctacaaaaaaatgacatttttcatttcttacaaaccaatacctggtattattgctagtcttaatccctaatcatctgataattatccaccttaccactattctattttagttaagagggaaaaaaatttctctctagatctgttacttgttggtgcatttttaacttttacttgtgattcatcctttctttgtgaggggaactaactgctgttgtactcaaaaataaaccaagagctttcctgtatctattatcttattcagtcctcttcacattgacaaaggttgttttgggtttttttttttccctaatttacagagaaggagaaacatattcaaaagcctcagggaaattaagaaacttttccatgaaagctctaattcagttccttgccaaatctttaaaccacgactccacatggtttaatgtatccacatcctacatatttatatatttactgtatagttttaatgttcatatagattggtagaatcacctacctatattcactagatatttttagtgttaaaatattaaacattaacatttgactatattcaccagaattttttaatgtcagtgtagagtgtgtgatagtgtcatctgtagaattaacgcatgctgttgaaacattttctttgggactctccccaataacatttttagttatgaaattttgtggcataagttttctgcggctattcaaacttgacacaaaataactacccattacattttctttatgatactcatgacaataacctttttatctctaaatataggttgtactgctgggaaaatacaatgcacagggcttaggttcagatcatgaattaatgctgagatgtaccaaaggacgagaatacatcaaagtcgtcatgcaaaatggacgaatgatgggagctgtcttaattggtgaaaccgatttagaagaaacatttgaaaacctaatcttaaaccaaatgaatctttcatcatatggagaagatctgctagatccaaatattgatatagaagattattttgactaaaaatggaatttcttcaggaatcatataaagttccaaatgacaccagaaaaatcacaagtcaataaaatgaatgactgtattgagttaatgatgaccacactgaaaattacagaagtgataatgatattagtggaaaaatataaaaacataaattctaagtttgaaatcagttcaaagtttatttatagatatatctttccaatacaacactgaccgcttagataaaaatcttaagttatttatttctgtgttttaaacataaatatgtttacttgtgatttagctttggagcaaatttaggtaagttatctatttagccaaatgtactctagtagattagaaccattctttgtgaaatgtcaaaatatggctgtggtttcaggaactttaaaatcggttgtattttactttaaatagagatgtagcaatatctcgtttgctaatatttatattgatgacttactccttttttgttgaattgtacttctggttttataacctgaaatcatctacaagcttgtccaactctagcccacgggtcaaatgcagcccaggacagctttgaatgcagcccaacacaaatttgtaaactttcttaaaacttgagatttttcttgcaatttttttttaagcttatcagctatcgtcagtgttagcatgttttatgtgcggcccaagacaattcttcttccaatgtggctcagggaagccaaaagattggacatccctgatctacatatttaacttaaagtatcactcagtgagcctctgtcagtgtaatattgctttcaaaaagatagttatgtcaaaagaaaaaatatagctaagtatataaaggcataaaaaacttaagacaattatatggacttattctcaaatattttacattttttgtaaactttcttaaaacatgagatttttcttgcaattttttttttaagctcatcagctatcatcagtgttagcatattttatgtgcggcccaagacaattcttcttccaatgtggctcagggaagccaaaagattggacatccttgatctacatatttaacttaaagtatcactcagtgagcctctgtcagtataatattgctttcaaaaagatagttatgtcaaaagaaaaaatatagctaagtatataaaggcataaaaaacttaagacgattgtatgaacttattctcaaatattttacatttaaagggttttacataaaaatttttcccttgttttatactggaaaattatataattcatgatctctaattttcaaacattctcaaaagtttagatcttcagagataagctctgaaaatatagatccatacatataaaatatctatgaaattcttttaaaaactattgtctaactacaaaaataatggcatatacatgcataaaccatctttaattagaaaatttagtaacattcatatcaggcatcatcgatttttcttttcttagctcctgtattcttagaaccagattgctgaagcatgtttgcagccttcttctggaagttgcctgaatttttttcctccatctttttatcaccttgttcagaatgacaagtttgagacgattcagcctacaaaaaaaaaaaaataacaaagcaagcaccttggtaaaaatccagctattcagttttctcatgagattaaatatttcaaaatattctttctgtatcagttggctttttaagtatacaggggtctagttttttatctacaaatttctattcaaatatgagctctattttgaataaaaggggctacgttgtgagagaagttctaaagacctcaaatgtccttagacacaatggcacttgacttgacatgcttttgcagacttgatagtatttggtttaaaacagtggtttctaaccactggaacagcagaaacagacttctcaactattagtaatcacaaccaaataagagcagagtgcataacaaaattagatattcaaacggagtcctcccattccaagaaactggaaacccctagtttatgttaaaaggccagtctaaattctttcacttacatctttacagaaaactatattttctctcttccatacccagaaatctaatcagaaaactgacttttctcatgttcaactggacctaggggaatatgacagaaaagcatcccataggctttaatatactttttaaaatatataaaactgaaaattaatagccatttaccctgaaagagttctgcgtggactttgtcacttgcatagtaatagcatgtgcctcattgttcagaagattagctttaggtcctattttcaaatacgaaatggtagcataagctgtaaaactgtagtcttctctgcagaaaataaaggccaacaataagaaagcttttgaaggaatcacggaaaacaaatttataaaagaaataactatatgcgcagtaattcttaacacattgacttgaaataataaaatttacaagaatgcaaataaagcctttaaagaaaatattttcgttacttttttttatttatagtgattaaagtttgagtgttttaggtaaattactttctatagcatttaaaagttcacacaaaataactgcaaaaccgtttattctgttgcaatttttaaaaaaaaccataaagacaacctgaaagaataatgaatgagtttgtacatacttaagatactgctgtattagaaagtgtgcaataatcttctccagatcttcacgaggaagtgtgggagccacaacacctgctactctcagttttgctgcaccctttcccatccaagaatcaatcagtttcaatggagtgagtttttcattcagttcctctgcctgcttcaggatcttgattagatctctgcagtactctgttatgttctttctttcaaatgctgtaataaaacaaatatggtagcaggtaattaggatttagaaatgagggcaaagataggctatcttaagtagttaaactggtttaaagctggttatcaatgtgagccaccctaaacattgatttttaaatgtattctgaattaagactaggctattcctcaagtctctgtcactagaccaagttatggtctctgtaagcattgtggggtttacagtgatatatataaaaaaaaattggttatcagaagccctgccatatactctagaaatcagaaagtgtctgccagacatgattactaagttactaagaggtgtgttttataggagaccctgtctgttctagtataggctcctgagtgaactctgatttagcaacaagaatgtcctcaactgataacccaattattaagagaccagtactctgatttatatataacactcttgttattttataagatagtctaataaactcataaatttctctgtctgcaaagttaaaaatacagtggcttccacctaacaaggcatcagaactcagtaaggtcttaccatgaggtactggctagtccagatcttgaaatacaacacacggatgaaaaaaagttaaaatatagtgccaaaatgctgcaggcaaatccgaaaattgggactcagcccaggagggttcccagtttcatgcaagaaacaatctgagagcaagccaacagagtaaagtgaaag

SEQ ID NO: 14684 - DNA, 129899 bp, Human
  misc_feature (1)...(129899): n = A,T,C or G
ccagaaaggtccccataggttcgtaggaccatggttggagcacgtttacagtggagcacccaagcaccaaattaggcctaaggactttcaaagtcacttctacccataggcttactagctttgtaatctggaacaaattattttacacctaaatgactgttagactagatttctttaaggtctcttggagctttaaagtattatgattcctttgagaacatttcaaaatgtgtgtgtgtgagttacaaacttaagctgcctacattacaaactgaaggtcttgctttaataatttcaactaactgataaaatcaaaggcttctttatgtgattcttctgccctactaaacataggtgtggatagtattaaatgaatctgtaaatatgagtggggatcaaacacatcacctgactaacatttttacaaagcagttcccaaaacactgaaaagttcattgcaacaaaaccaatttacgattgatgaagaggtatctcaattgtaacctttacatgcatgacatttcaatcagaatattgagttagcagtttcagactttgacttttcagacatacactcatacaaaaatacatttcatatcattattgtttaatatattatttttgtttaaaattgatagttgtcctataattttatgtctagctgaattcccaaagtagaagtactaatgtgcagagaattcatgaaaggttttaaaatgtcttacaaatgtaagattatttgaagctgtatcagcttgtaatttaaggcctgcagctgctggtatgatagaagtatcaaatttcaaaagaaattatggtagagtataaataagcagaatgaagagaaaagtctcctgagaagaaaataaaatgagaatgaagcatatgcattgttattgcattgctcctttttttcttcattttttatttcaggttcgaggggtacatgtgcaggtttgttacacagataaattgcatatcaccaggatttgatgtacaaataatttcatcgcccaggtagtaagcccagtacccgatagacagttttccgaaccccacctttctccctccctccttcctcaagcaggccccagtatctgattgttcccatctctgtgtgcatgtatactaaggcactgcttcttatattcaaggtttagtactaaaatgcaaatatgaagtatataatttagtaagttttaatcctgctgcaaaccaggtcacataaaaataatgcaaaataaaatattaaaattattcagaagttcgatatttattctgttgtctttacaccttataaaatggaatgacctaattactcttaaataaacataaagacaatttaaggtcacatttgttacattcacataatttgttaaacacaatagaaatgttagtttactagaaaagaactgtcataattttaacatgcagagtttgtttaccttctattatggtgatctttgtttaagattttctcctcagatgttaaaagtttttcacttaaagaggcttagggaaagtgatttttaaagagtcactgttacatggtaatatgccgttcatttggatgagactagtatataggtaatagtcacaagttctaacttgcatgttaatttgaagagatttttcgtaaaattgtatcaacattagtttctaatggaaaccagtcttagaagttttctgctgtttgtttgaggtaaagtttttttaagaaagttataattacattaaactatcatgctttagggtttaaatgttggaaagttggttttgtaagaagaagagtttggtttcttgtttgtttgtttgttttggtttgtttttggcatgcgaagagctgtgtcctggaattggtgcccaaaaaattttaagtgtggtatgaactgtttatgtcactgagtaaaattagacacgtctgttgctaatgtgaggggatgaaacatgagacagggcgaaactcgtgagagccctttctccagggacagttgctgaagcttcatcctttgctctcattctgtaagtcatagaaaagtttgaaacattctgtctgtggtagagctcgggccagctgtagttcattcgccagtgtgcttttcttaatatctaaggtaagtgctcagttttaacttagattttatatcagtacaaagtactacctaaaaaccaaacgcttaagaggtttcttaatattctttcttctttggtggcataataataaatttaaaataatgttgaataaattggtgtatcacaacataatgacatatcaagtatcaatgaaattctcatttcaactaagttattctgactacaaatatgctacatatttttagcataatcctatatttctaacatttttaatttgtagaatgccaaaggtagcatttctgtattattgggcattgaattggatcctgtagttaatttaaacaaagtattatctttaagatcacctacttctaattctgctcttaaactttagtggtagaattacatttgctttagattttcttgatagttttgttatagacactaagaaataaactaaaatgaatgacaacaaaagtccagtggttttataagttggaaataaacaaaacaagagcaaaatagcaacctgactccttcactatttttggagtgaaaagggaagaatgtttctttccctaaatctggaaaatataaaatactgctcaaaatatgtatgaaaaaataaacataagtggggtaaaagtacacatgtgctaatgcttcagcttactgaagttatgagttctttctttgcgttttctaaattaatacatgacaactagcaaacacaatttttttaaaggaaggattagaaaaaaataatacgggaaaatataactcagctgactgaaagatttgccagcagaccagtacaaaaacgaactacggaatacaccgtttgttttttgcttattttcttgcaaacattttgtaggtacaaaaaggcacctttgtggaatttaaaaagtaatgctacaagttggggttcgttttataggttctaggattcatttcagattgtctttcaaagacaaatgaaaagtagcatttcaatgtagttagatatagcattccaaagactaacaaattcaggtgtccaaaagatatcagctaagcttgcagttaaaatgcggaaaatgaaattgttccatattgtcctttaaaaaatgtacttgctagtcattaaactaagttgttattaaattgcattaaaaattaaatgataattgtaaattatagtgggttcccaatgtgttcagttttgcataacttatagggcctgaggatctccctccactccctaatctgtggctcatcacagcgcttgtgtcttctcagcttgaggcaccagggctgtggtttcccagtgggaggggagaaactacagcgtcctgaggatgactctgctactctcctgctccttcagaacccaccttgaccttcatgacaccttcctgtctctccctccctccctccccttctctcagccgctatagcacctgtctggctttattcttctccagacctactgcagggccagatagttctacgacgttctcatgaggattgcaggatccatcacttgctactttggccattttggattccagcttcatttttaattttatatgttatgctgtagatagttttatgggaacactggtacaggagtatttagtaatttgtgaatggtaaaggtctcaagacttttctcagaacctgtgaaaatctcactgcctgctcgacttcagtatgactggtgggtaggaccactgaggaatggggacaggagggcttgctgtgcccaaaggcgtttgtgcttcatcctaagcaccagtgagacctttgaacctctagaaaaggagagcagcccagtcacatgggtgctttggaaggatcactgcagttgacatggagaatggattaagggcagtggaggcggcagtgaagggtaccttaaaacctagcttcaccttcgtgacttctttaactctgtttttaaaatgctcaattaattttacttgagaaacatctctggaaagtctaacatcaatgaagaggctatgattaaaagtttaggctatggagccagactgccatttgaccttgtgtgaattacttaatttctatgtctcagtttcttcatttgtaaggtgagaggagttgcattgtagcagctaccattttaacaagtatcaaatttagtctatataaggcaattagaaagtttctgacttcttagtaaatagtagcttccatcggcatcacccatcaatgcaccctcttatcctgaccccacactgcggggaagtcaggaagacctcgggaaaatgacggtaactggtcaggaacttgaacctgcttctcacagtcccctaagaaggcgtaccagaaaggagccctaagcaggcaggagactccaggctgaggctatttctgctgtttctgtggagaacgttctctgcacgcagccatggctgctcagaaggggtgtgtgcattccaggatacaaatagccctcctggcattcccggtggctgcctgcctatccctagtggtaaggtctatgaaggaaagaaaggcaagtgactgtttacctttcccatgaaaatcttccttttcttcaacatttttgattgtaacgaaaactttatataaaatattctccctttatttttatttttttttgagacagagtctcgctctatcgcccaggctggagtgcagtggcatgatctcggctcactgcaacctcacctcccgggttcaagtgattcttctgcctcagcctccctagtagctgggattacaggcatatgccaccatgcccagctaatttttgtatttttagtagagacggagtttcaccatgttagtcaggatggtctcgatctgctgacctcgtgatccacccgcctcggcctcccaaagtgctgggattacaggcatgagccaccatgcccagcctacataaaatactctaaaatgttaatcttgctgaaacaatataagtgtgttgtctccatactggaatgcatttgaatgtttgtattttggcaacatttgaaagtcactttaaatcatcccattcatatctcagagcaaaggtgataataaggaagtgaataaatggccctgaggccatctgaaactttttaaatgaactgccaggccataggaaaaacacatatataccacgtttgataaaaaacttaagtgtacctcaagaatttctttacgcatttagaagcacagtatagttgatacattgaaataacttccttttcttaaaattttaatttaatattgtgtgaatgtttttcagagttagaatttagttatacacaatttttagggactaggcaaattgaaggtttttttttttctagagggggcagtgatagttgatttgcttaaaaattttaggcttagtataaaaatcaaaatacttataaaatagattacaggctactttatttgctgtttggttaaacacaaacttcatgtgtaattttaatttaagaatattctaaactctgttctcctttgtaaataacagcaaatttaagagtcatgtctatacaggataaatggtactgcaatgtaggctggtccccttcacagggctagtacataatgaactggtttctggatggccagtaagggggtctttttaattctctctctctccctgtctcacttctctaagaagtgtccttggcctcagcccacaccttgcccatcttcctctcctaacctagccggcttccctcattgcctggtgccttcctcttgagagcattcccttaatacaacacctgaacaagaatccgcatctcaggctgcttccagggaacctgatgtgagatagtgtcaacctaaataacaagcgagctcccaaagaaaagatgttcatttgtgaatagagcattgcagtgggactatgaggattacataattgttctgaaattattatccttggctacagagatcaataacaagagtaacaccagtatgagattgtaggcagatgtcctcgcagaagtgtttaaggttgtggtttttgcaatcttttgtgataatttttgttatcagcatacaagcataaaaaatttttctttatggccttccctggttctgtttgtcagagttttcttaacattagtgatcctgacaactttcacatagataaagttgaatggtattctgagaattccatcagcatacctgatcacaggctggagtgcaatggtgcgatcttggctcactacaccctccgccttctgggttcaagcagttctcctgcctcagtctccagagtagctgagactacaggcacctgccaccatgcctggcttatttttgtatttttagtagagacagggtttcgtcatgttggccagaatggtctcgatctcctgacctcgtgatctgctcgccttggcctcctaaagtgctgggattacaggcgtgagccactgcatccggtccccgatcacttttaaattccaatttttccaacagcaattgcttcgacaggttccctgggaaacagactccaagctggagatatgcgtgccatgtattggaacccatcttgaaaaaaagaaaaaaaatccctgtaggacagcaaaggcggcaaagtgggcagaaggagatgtcaaatagtactgtagctgccacagagctggaggcctgcagggctgttcccaaatccagagaggggccgggctttcacccagtgcactgataaaacgttggagtgtgcctctcatggggaaacacagccatgggcgaggcagcttagtgcattctgaagtcattctcgtcatcagccatcacttccacaactgaaggaaggagtgtcttggttctgaagggtgatgggcgtgacatagcacgagtccacccctcgcatcactcagatcctcttgctttgtttacctaatttgggaacagctcctccaagggtttgattgatctcttttcctgggggaacactgagggaatattaatggcaggaactagagcctccccttatgcagatggtctcatgactacagctgatacttacccatcctttttccctcccaccgccttcacctacccattcagcatttgcttcattctcatctaacaccctggctggtctgagtagccttggggtgaccctgacattcaactctgaagggtcttagccttggtcaccaacccctaaccagtcccaatgcacttgtggttcacacatggctgagcatttgctctcaaaatggccagaggaataccagcaaatgccttgctggtccgcctgggtgacaaacatattcttcccagacaattcttgtcagaatggtgcatcgtgtcctcaccagtggtatccagcctgaggaggtgaagcgattgcagcagcttgaagatgactgggactcacattgtgtcctctggtagaagcactccctgctgggagcagacttccagatccacagagcccatggtaatggggatgggaggcacatacttcccagctggcaaacatgaccacttctacgctcaccattggtttccagagggatatatcctatccactggggatggagcgccataatggtcattgattttggatgtacagaactgcattctgaagtatcccccatcctcacaggggatcgggggcctcaactgcagctttaaaagattgttctatcaccctgtcaggccagcagctgctgggaaatacagaaggtggcaagaacaggggatcccgggctcatgtacctagcgcccctctgcctttgccataaggtgggtcatttggcttgttggcatctcctatgggattccacatcagtggatcacacattctgtaagttcttggatagtgatgctggccaaggccctgcaggtagaaaagaaaaatccaccccagcctacctgttagttcccctcaagatgatgtaaccccctggccaccgagtggctgcttggtcttattgagggatgctgctgtatccaggttcagcatcagtgtctgctgtggacagtttagacattcagcaggggcagtggctggatcagccttgccaagaggaggcctagctactgggcccatgcatggcctccctccctgccaccattctgggctgctctgtatatgaccccattgtgggagccctggagtggatggtgatgggccagctgtgtcaactgggtgagccactctcgctatggtgccccttctacagtggacggcttggaggctgttaacgtggtaaaagatcttcctccttgatgcccaataggtccatccacaagcctcttcctcagacttctctgtcctccctattccaaactctccccttccacccaagccattcaccaccatccatgagaccatgtatagtctaacctcagcctcaggtgatttctgtttccacaggaagtggatacacaggtgcgctgcctgtagctttgtcagcgaggaggttttctctcaccacaatctttcagggccacccattgcagtgtggcagccggccttctgtggattgcacccacagaggcctaccaaatgtggcccgtttcctccctggaaggctggccataagggtcacccctgtgtggccaggagaggtgcattagtggtgggtgaccgggactctgggtccctcgcacatgttccctctgcctgcctcatccctggtgccccacttctgacttaacagtgattgctgctggctcctgacctgaggccttggtgcatctcacagagctcaggtcatgatgtgaaattctgtgcatgggattatgctgtcccatgaccaggtgctctgtcttccaccaacacccagtagcactcggagaagtgttttacaaatggcatatatttctctgctgcagatggcatggcctgattccaaactcctggaggcctatgctgtgattcttccactgcagcttgccataaatgccacattaccttctttccatcaaggatgcatctaaccccacaggggcaccagcaggtccagcctgcagtatgtgcagccctgatgcagagccctgttctggccacactaaagctgtcattctgtaaatgggttaatttttccaaggccagaacctgaagtggtctaagaggcatcatttttcctttacagtggtggtaagtgcaagatacaataattaattctttactttgcaggggatttccctgcatgccctagaacactagatcctaaaaaccactaagttggcaggttcagatcttggtaggatttctctctcaccgtctgaacacatcttttactaaggcttttttttttttttttttgagataagagtcttgctctgtcacccagtctggagtgcaatggagcgatctcggctcactgcaatctccacctcccgggttcaagctattctcctgcctcagtctctggagtagttgggattacaggcgcctgcctaattttttttttttttttttttttgggacaggtattcaccatgttggtcaggctggtcatgaattcctgacctcaagcaatccgcctgcctctgcctcccaaaatgctgggattataggtgtgagccaccatgcccagcctaagaaggcttttaacatatttgtcgcattcactcatctagtccggtccacatggtatcatgaagttagtggacaaatgctgttctgagaatgtccaaaatggcctagatcccttctgaggataggaatgtggcaagtaaatactgcagcctagctcatgggcctatgaagctctgcagttcctctatgtgagataaatgggaggaagatgcctgtgccagttcaatggcacacatgcctggtgccacgccaatctacaggagcaaggatgcctcccccggcacagcagctgtgcagctggctttgaggcagatcactttcattctttacgatacctctggttttctagaggccagattggtgaattaaatgggaatatggtggagaccactaaccttttgttcttcaagagaggcactaatctctgccattcttcctgggatgtggagagatgacgggcggtcatcccccgtcctctcactacacagggacaggaactccccatgtggcagttctgccagctatcaaatattccctttccacttacatatttgttgaccagggaaatgaccgtttggtggttccaaaccctctgtcgtccaggctggagtgcagtggcgcgatctcagctcactgcaacctccgcctcctgggttcaaacaattttctggcctcagcctcctgagtagctgggactataggtgcatgccaccacgcctggctattttttgtatttttagtagagatggggcttcactgtgttgcccaggctggtgtcgaactcctgagctcagggaatccacctgccttggcctccaaagtgctggaattacaggcgtgagccactgcgcctggcctttttcctgaaatttttttggaaaataattttctttccctacttgtgttatttctgtagatatgaccaacatgtagtcctgtagaataacaattaaaaatagttgaggtagagatttcattgttacattatattcatgcattcagtcaacagatattggtaggatttctggacatggggactggcctcaaaaagggcttaacagagaaaactatcaccttgctttcatggaggtggggcaaatagtatgagaagatagatgcaatttgggaggatgttgaataagataagagacaagagagaaagacttgaacttaagagtaattttcttggtttcagaattagagaaataggttaaagctatcagcagaactgaactcccctaccctactccttcacccccctgcccgctccttcaggctcagagctgcacaaagtctaccttaaatagtggttatgctcaaagggaagtgtcaaaggacaactaaataattacccctttagtctcaacatagacaacttagaggtcattgatagtgtgattaaatattctgctatcaaactattttaaaagaataaaaatataaaataaacgtttaagtgtttaatacatgaggggaatcaatactgaaaataattttagtataatggctctatttaaaatatttttgtatgagtatatgtggaaagtacatgaacattatagatcaattatataataattttagtaaattggtatttgagagtcttgattgattgataatattaataatatatggcattatagagttcttctgacttgatatgagtaatgtctgtagtagtaatctccagaactttgtcaagatggatgtagtatcatcatattctgtaaatatatcatctttgaaatattaagattgcctggattccaaaaccataaattttatacatgctatgcagtaatagcaagcataatgacttctctatgctaaacattattctgggagcattgtattttccatttggagctttggggataaattttaagaaaacataggcctccagacacatatgctacctgcatatattgggggtgcatcacaattacaaagttaactggattggttatgaaagttatatgtccggccgtaataaaatggctttgtttgaaataattatagtaagtgaggcatgataacctttatgaaacttataattctcatgacattaaattcttgtaattgacccactatatttacaatccacctgttgtgaggaagacagccagcaggtacaggagtcagataaaccttaagaagtcagattcacaattgcaagcctcattcacagcatcacaggactttgaagagaactattatatcactgacgatattaggaaaatgctaataaatggccctgtaaaatcctcgtgtgttaaagagttttttgaataattgaaaactatatttggtgaaacttttctgttgataataaccttcagaaaatactgtgcaatcaaacatgccacatgtttgcaggtactttctgagtaatttgcaaatattttctggataacagaacacaaaatcaacaacagaaactttaaaaaatacatctatatatatagtctactaaaaagttacatattaaatcaagacataaatcatcttcttcatttgacatcgaaatcaatttgtatattttaaaagcagagatcagccatagtaattccagttatattttatgagccaaaataatagcatgcctttaatctgccactttgtttggaagtcttattttcagaaactatgaataaatcttctacaccatcttcccgagagctttagtaagacctcagactggagtagagttgaaggagggaatgccagtctgaagaaggaaaggaagaggagagacagcaaggagaacttcagttgtcaaggtatcgggtgcaggggtcagaaagaaacatgactccatggaccactgcttggcccaagaccagatgtcaaaaccacagagccctgctgtagagcattacaaatgtattccaccaaatgttgggatgcatcctagacctgtgctggccagcagtccccagctgtgaggagaagcccgccattttgagttgatcacttggcagagttgatcatcataaaattatccttgtagagctaaataaggtttgtctttgacattcagtctggtttataggatagcaaaagggaagtggcctcagctagtagatttgaaaagcaaaagtaggaataatgcttttcagatactaatcttccttcccgatccaacacattcatcatatgaaggtagaattttatctgacgtcaagccctaaaatacactattcaaagacagtgcttacggattaacatatatgctagaaaacagagtagcgtactcggacactgagatgtaaaaagagggaagtgtcggccgggcgcggtggctcacgcctgtaatcccagcacttaggtgggcggatcacgaggtcaggagatcgagaccatcctggctaacacggcgaaaccccgtctctactgaaaatacaaaaaataagccgggcgtggtggcgggctcctgtagtcccagctactcgggaggctgaggctgcagaatgacgtgaacccgggaagcggagtttgcagtgagccgagatcgcgccattgcactccagcctgggcgacagagtgagactgcgtcccaaaaaaaaaaaaaaaaatgaaggaagtttcagcctatgaatcatggcatatgcatcaatcatactattacagaagttaaagggtctggaagtaataatatgtaactctatcattttctccttcattcgattcttttcccagctgttcatggagtttctgttgaagttggtaggatctttatttattttattttatttattttgttttgttttattttattttatttttgagacggagtctcagagtctcactcttgttgctcaggctggagtgcaatggtgcgatctcggctcactgcaacctccacctctggagtttaaatgattcccctgcctcagcctcccgagtagccgggattacaggcgcctgccaccacgcccagctaatttttttgtatttttagtagagacggggtttcaccatgttggccaggctggtctcaaactcctgacctcaggtgatccacctgcctcagcctcccagagtgctgggattacaggcgtgagccatggcgcccggctggtagggtctttattaaagaacagttatgagagatgtatgaagtatgagtaaagatagaataatttaggtctttaattgtaatgctatatcctaaacatggaaatctatttgaccaatacattgtggatgaggatatactttattctgccttcctttaacaaatacgtataactgagctgttactatgtgccagaccctactttaggtgccagttatataataagcaaacagacacccttcctgtcttcctggaggtgagtctaatgaggaccaggcaataaaaagtaaacaaataaatgcatcattatgtcctaaaaggaactttggaggaaatgaacaggacacagttgcagattgtacaggataaaagggacaagagcaggtgtttatggaaggctgaggtcaggaggacagagtggtggccacgtggtatggaccggttttcccggcagtgggaacaacgtgtccaaagactataagataggagaaagtttattccatttgagggatggaaaggctggtgctgttgggaagggcacagtgaggtgagatggagctggagaggctggctggaccagatggagtgaagcttcatctgacatgcagtgggaagccacgagtgactttaaacagggcagcaatggtcctcttgttgggtgccatgtggagattggattaagagaggcagagtgggtggaggagaccctgaagaggctgcaccgtcagtgttggagtggagcaggggcagtgcagatggggaagccaggatgagcacagctgtcctcaggatgtggcaggcagggcttgctgatgaagtagacgtgaggtggcagagagattgtgatggcactcatgcttctgagatgatcaactgggaatggccgatgccatggactgagatgggaatagagaagagaaggggggaaattcaggaggtgaggagaaagttattgaaaattacgttactttttaacaagtgcagttcgaaataccaagtggagatgtcaaacaggcaattatcagattagagtagagagttcagagatattttaggtagaaatataaatttgggaaccatcagcctgtaaatagtatttaaagacatgataatgaataggatcaccttgaaaaattgaaggaagagaagagatggtcccagaacagttcaggcaaaatccaccatttagaggtcagagaaaaagagaagattatgaaagggcctgagaattaaagtctagaaaggtagagggtaaaattaggagaatactgattttaagaaaacaagaaaaaagtgttttcaaggaggaaatagccaaccatttcaaataaaatgaagagtgaaataaattttaaaaagtgagggaaataaaataggaaagtgaatattggatttggaagcaaggaggttatgtgatccctctgattgatattagccaaagctaaatatggcaaaataacttctggaaatacatccttctatctaaagatttgcctgttctttagaaggacctgtttggtgcagaaggaaaataggtcaaaaatagttgcaagcattccttaccatgttggtagaaggtgttcttactccatggtttaccatcataagccatcctgcctttatgcctcttgctatgtgtattatccaggactgtttcgggtgcaagtgacggaaacccaagtcgaagaagttcaagtgaagatgaaacttactaatttataaaataaattagacagtgctgaatttaggatctcaaatgatgttgttaggatttcacccctactctcacactctctccctcttctttcattcttcctgatttcttctctggcaagctctctccaagtggtggagggatgaatgttggcagtgcagtgttaggtccattaacttctgatagcagaggccagcttctctcttggagcattcatattaattctgggacaactgacactggcttgcttgtgtcccatgacttcctaatggtattcaccatgtctggattgatgacataccctgattggtcagcatgtaccacatacacacctgtgttactggacatgtgtccacatgaccgatagctggaccacaaccgtggggagctgaggagtgttctagggacagacaagaaaacagtaggtgcccactataacagtatacagaagaaaaaagtagacatcgactgtaataggacacagaagaaaacagtaggtgcccactgtaataggatactgaagtagacacagggttgcagctgagcttccaacagttcctccatatagttctttgttaacattaactcagctttcattgcagccaactactaacttaacaattagctatgtgagcactaagtcagagattgagggtaggtataaatcatgccaagagctagaggaaatttggtaccaaataacaaccggtcttggttaagaggctaggtatccataaatgctggtcttgctctattgccattctgtgtcttgtttttgctaacttgttaatgtttctggatgttggtattattctttagtcaagtactaacctaatgacaccataaaagctttagatttctgatttctgagagcatctaataaaaaccaggacagagcaatgagaagagtttgtctgaattgcctacccgtgtaaatataaaactgtgttttaaaatgagcctgtagctgaagtaaaaatcaaaacaagaccagttttataagctaacatttgtaggcctgtgggtttgagcttgtttttattttttttttcccttttagtcacttgctcgtttaaataaaggtttttgtttgtttgtttgttttgtttttttctcttttcaggtctgttagatacttaaagggcatttattctgttggtttggtgtattttgtagggaactttttaaaatggcagagtttgccattttattttaaaagtcagtcctattgtaaagaagagagaatgatttgatgatcttttaatctagatgtgtgtgtgtgtgtataataagggtattattattcgagaattatgctgattataactttggatgaaattgataattatgatccatctattttgctatatttagtgtgctgtgctgagcaatttgactaaaagataaaggagaactattcttgaaattatttggtcatcctaaatacagtaatgaagttgggatgagtatggtaaatttattaaatttactatcacaaaagaaatatatatatcaattctgtaaattgaaaaaatacaaaagaaatttgggaaatactattttaaatgaaaaaaggtggattataggaggaaattattaataattttttagtttccttacagtatttttcctatgagtatatattttaatatgtatatattctaagttttcatttaacattatatcactagaatttccctaggttgttatatgtttttcaaacatatttcacatacccaaaatactaattttgtaatactatagtaatttgatggattaattactctaattttaatccttcttcatttaatgtccagttttgccccagtacagataatggtaaattaaagatctttaggcacaaattctagtttttgtttctagttgtttcctttgggtaagttactagaattggaattactattgtttgtttgatgttcttaatacttagtgcccaatatcttttgggggggttattgttaactttcactttcttcatcagaggagcagcatgtctctttttcaaacacctggccaatattatctattatcagtttttaaatttcccttaatctttgaaaactgctgcagtgatggtgtttattggcatttctttaattcagggtgaagctgaacatttttggtatgtttattcgtcacgtgtatttctttgatgtatacgtgtattcattgcttgagttttattggatttttttctgtttttgcttggttgagattatttatattttaaggatattaaccttgtcctatctttaaggcaaatacttctcccaatttatctgccatggtgttctttgtgccacacatctcctagggcaggcacctctccactcctcctttctgaaatgttggagctctttcagaatgatgtaagttatgatgcaaacagtaaggcagaaaacacactgagaattactgccactaattaacgtgagatgagatgtttcttggaagtttaaaggaaaatagaagtaaaacccatgcagtcattcccaatactagcataacataggcagcctgaatttaaccatcccactagcttgctccttccctgccagctcacctcctggaagagcaacttgtatagactggatgcctcttagttctcacttttcattgccttattatgatctgtgtgtatgggcttgtttctagactctccattttcttttacttgtgaattatctgtcactagctcatttttttttgttactgtagcacaaagctgtatcatcacaacctgtagggtaagtcccactccttatgcattcgtgtgttcaacaagcacttactgattgcctattatgtgcacataactgatactggtcacggtcacctagtcacatcgttgtaattgacttctcacgtgggttaccttgtcatttggagggacgatgcaccatgatggtgcttgttacctagtaagaaattatctatctggatattagagctaggtgacatggcttatgaaagacagtttttgaaactgtggaaagtaatttttcaggagttttcagattgacatcataagtgctataagaggtttgctaagccctcagtcagcaagccctgtgaacggaaaggaccttacccaaggcaggtagaatgccatcgctaacactcaggtgaatctcccatgaagattagaaagatggcttactctcttatctgacagattgcatacagctgcaaagagaattagtatattggaaggtagatcttagaaaacaccacagagtgataaagctgtggaaatataaagctaagtttaaaaaacatgactggtgaatgaggaggtctaaatatatcttattgaagccccagtggaagtaaccggagaaaatataggaaagacaatggttaaataagcaattgccaagagttttctataactgaagacaagttcaattgaaaacagacactgactcatgaacagaataaattaattcaaatttatgaaatgaaatcattctgaatctggaaaacactaaaagtaaagaaacttttaaaagtcccaatggaaaaaaaaagacgtaacactgaaaaaagctttgtagatacgtgttgaatgaactgttgaaagcaaagtggtggaaatttgtaccagaaaaacattgaaaccaaaagtggcataccaaagtcagtatcagacagataacttcgaactattataactcattctttgagttcttagatagaattaaatgtcatttctaaaaggtctgttttgttctttctcaaactcaccttttcaaaaatcatatgatattaactcattttgggcattatccttgcatttatcatctttgtgtctcagactcttgataatggcctacccaaactaggcatgacaataaatgttggttgaaatgaagaatatcatgaagacactatgttcgattcactatattatatgctatgacaataatcacataatgtagaagacagattatctgtccttaaggtcattttgttttaaataacaaactggggatcatgaattcagaagcatatgaaagcagatatttacaccaaaacaagtatagtgcttcacatctggagccctatccattaaaggattgaaaactatacctgagagatgcattgaaaagcaatcaaaattaaatatagcatggccgggcgcggtggctcatacctataatcccagcactttgggaggctgaggtaggcagatcacgagatcaggagatcaagagcatcctggctaacatggtgaaacccagtctctattaaaaatataaaaaattagctggatgtggtggcacacacctgtaatcccagctactcaggaggctgaggcaggagaatcgcttgaacccgggaggtggaggttgtagtgagtcgtgattgtgccactgcactccagcctgggcaacaaagcgagactccatctcaaaaaaaaaaaaaaaaaatttgggaggccgaggcaggcggatcacgaggtcaggagatcgagaccatcctggctaacatggtgaaaccccgtctctactaaaaatacaaaaaattagctgggcgtggtggcgggtgcctgtagtcccagctactcaggaggctgaggcaggagaatgacggggacctggaaagcagaggttgcagtgagccgagatcgtgccactgcacttcagcctgggcaacacagtgagactccgtctcaaaaaaaaaaaaaaaattaaatatagcaccaacatactttgaaggatggttagcaggagaaataatgtaaattttaatgacaaaatttgttttaatgaacaagtctatgaaaataaattttgttcatgatacattaaaaattagaattatttatcttggaatatagattttaagttctaatatacttatttcactaattatgttttgtaaagggtttataagaagaccacaaagtgctgtgtgttattccaatgcaatttcttgctgacatgaataccactaatgcagttgcctgacctccaagtgctgaagcattgatattcttctcaagcctaatttgagtaaatacctaaaggaagctggttaaaccagatagcctctgaaagtctctcctggcaaaaatttaatatagtgtctaataaaaatgaaagccacttgtgagttgtgagaaatataaacaaatcaactttttagagaaatatttaaattgagtgtttcacctagtgatttaactcatgcttatctagagtaaaaggacttttttatgcaatgcagtgaacactggtagatggcactttcaaaacattaaagaaggctgtcataaaacgatataaaaagaattacagctggcaaacttaaaaaaaacaaagattggtaaatacagctcaaatatgggaggactagaaagcaggtcaccagcttccgaaaagcagtgtgtggtcagtattttcttccagggatgtggggtccagcttcttactcaagctgtcagcagggcaggtgggcagatgtggggggactcaagagccaaagacagcacattccccaggctccccatttttgggcaagcctcaccagactgaaggagatcttgctgagtcttcttctgagtcctaaacaactaatcacactaaacgtactctgtttatgcacaggcttcaaattaactcattataaaaagttgaggaaattctgaagtaacactcaacctattttattgcttgttgtacgcttaaataaaaaatgtctgggttggccgggcgtggtggtgcatgcctgtaatcccagcactttgggaggccgaagcgagtggattacctgaggtcaggagttcaagaccagcctggccaacatggtgaaaccccgtctctactaaaaatacaaaaattagctgggtgtggtggcatgtgcctgtaatcccagctgcttgggagaccgaggcaggagactcacttgaaaccctggaggcggaggttgcagtgagctgagatcacgccactgcagtccagcctggcaacagagcaagaatctgtttcaaaaaacaaacaaacaaacaaaaaaactgggaatttttcctttcaacatttgtatgtagttaattcagcaaatgtttattaagcacatactacatgctggctgctgctctaggggccgagggtaaaacaaaataacaaaatagttgaaaacctcaccctctcagggcttataggtggagggtgagcatttacaataaaatatgtaggtaaaatatgtagtatgcctggggagttaagtgctacagaagaaaaaatgtcagaggagcatggggagctctgtggtggtgttggtggggcctgttactgaaataggaatgatcaggaagatcgttgataagcgatctttgcacagagagttgaggggagccatgcaggcatcgggagaccttccaggtagtgggaattataactgtggagtccctgaggtggggtcacacttgggggactcctggccgagtaagaccactgttcctggagcaggaggagtcagggcgagagggactggatgaaggcagagaaccatgtccgtcggggtgagaagtttggtttttactctgagtgaaatgggaagccacgggaaggtttgttgcagaggtggggcatgagccgatgcatgttttgaaaggaccactccagcctcgatgttagaaatggactgtaggagatttagagccacaggcagggggatagtcaggtggctgttgcagtgacccaggtgaaagacgatggcagaggtgctgattggggacctaagagctggcctcataacaggattgctgtcagctctccagcaaaccacgataaaattgtcttaaatggatactgaagttttctcagtgttatgtaagggtgaacaaaagcattatctagtagacagaataatggcccccagagacattcgtgttctaataacccctggaacctgtgaagaggtcaccttacgtggaagaggaggaggctctgcaggtgtggttatgcccaggctctcgaaagggaaagaccatcctgggtaatccgggcaagcccagtgttatcacgggggtccctgtgaggggcagacagaggcatcggagccagaggagggtgtgtgatgatggaagcagaggctcgagcaaggaacgtgggcagcttctagaagctggaaaaggcaagcaacgtctcccctccaccctccagaaaaacacagccttgcccacgctttcattaagacctattttttgacctccacaactataagataaaattgtgttaagccactaggtttctgataatttgctacagcaacaataggaaactatatatataggactgggaatatgtagaaatagaaatatactcacatgtgttcttagaaaactttgctagttgtattcacctgtagcaatattgtaagtctgtgcttgcttttggttcagactccctggccacccttccccatccaattgcactctcctagtctgtcctttataggaattctggagccattatttcaaatgataagcactttggaatcaatataatagagggaagaggttgagagtgactgcgtgtccagagagggaggctgctttgaggagatggcatgtgtgctgctactgaaagatgagcaggaccagcaggggcagaccaagtccaggacaaaggtcctggggtgagaattagcctggtctgttgaagagtatctactctttgcttcagtcttgtgagcaaaggacacagtggtagtagatgaagccaaagacatcagcgaagtccggctcatatagggtcttgtgggtgatagaggcgtttggacattgtcactgtggcgaaaagccatcagaaggtttggaaaaatagagtgacaggagcttactgacattttacacattgactgctgggtggggaatggttttcaagaagggaaagaatgaaagtggacttttcagcagtgtagttacgagcattcagagtaacctaaactagtgtggtagcaatggaaatgtagagatgtagacagatttcagatatatatggaaggtagaattgataggacttgctgatatggggcttgagggaagagagaaccatcaggaatacatctggtagtttggttcgagccactggctctaatataaggaagactagaggagttcaaagaaatgagtcaatgaataatgtgcttacgaaatcattaaacatttaggggttgaataatgttggctgtcagtcctggatatttgaaaatactgtgtgatgaatagcctcattgtagataatcagaatatgtgaaaacgcctattgttaaattggaaggagatttaaagatttgttttagaccataacttatttttaataaggacaactccaaatcacccctaaaaataaatgtgtgacttttgcacaaaaaatcccagagaagagtatttatattctgattcatctttttactacatttacaatcaggaaagtcataatctccaattttagcttcatagctaaaaagtacttctgttatttgtataaagggaaaaatgaataattttttaagttttctttttttctttttcttttttttgagatggagtctcactctgtcttccagactggagtgcagtggcgcgatctctgctcactgcaacctccatctactgggttcaagcgattctcctgcctcagtctcctgaatagttgggactacaggcgcctgccaccatgcctggctaattttttgtatttttagtagagacggggtgtcaccatgttagccaggatggtctcgatctcctgacctcgtgatccgcccacctcagcctcccaaagtgctggaattacaggcgtgagccactgcgcctggctgcggattcctttttaaatttacacataccagtttgattttcctcccaattaacctttgtagaactcggtaacttgattattttaggttaatgtttcaattccaagtttaaccctgaagaattctgatagatagatacagagaatttattaacatctgaatttattaacatttgaaaatatggtcactagatttcaaacgtttatcatatataaaatattttaaatggcagattaaatatctccctgtgattgaaacacagtgacatgtttcaaaataatatttaattatctttttaaaaatcattaattttggaaatctatgactgggatgaaaaatatgttttcaggctcatagtaaatcagtattaaacaagttgcctccctcattccctctctgtctctttctctctcctctcgtgaacacactccgtggcagatggtgcgtgagcagtacactacagccacagaaggcatctgcatagagaggccagagaatcagtatgtctacaaaattggcatttatggctggagaaagcgctgtctctacttgtttgttcttcttttactcatcatcctcgttgtgaatttagctcttacaatttggattcttaaagtgatgtggttttctccagtaagtatcattattttctggtaagcatgttcttgttttgttcactgtatcacttagtctgtattgtattgataggagtttccttttgtaattaacattcatttctttgctgtctggctctgaatttcaggagcaaaatatgtatgtagcatttacgtttttcccttttccttaaacctcattgtgaactatagtgtgttggttttgtgtttttgctgtaatttttttcattagtcatctcgaaatagtgggaatattgtaatagtctttagtttgtggttgattgagtcaggattatttgctgattatttaattcagtttgtaaaatggtataaatcattttcttaatttcattaattcataaatatttaaatgacactcatttaaaaacttttttatttacagtggtaatcaagttacactttcattttttaaaaaccctatgctgatgtacagtaaaaacatcaatcctgaggaattcatattctattttaaacattcttatgttttaaagacagctacataattttgtattctttgataatattttgtgtacttttgaaaaaatgctaaatgtagaatgtcttaattttacaagatagctgcagtgagataaaaatattgcagagaacattgcaggcaggtcagtctgttgcttacatgcatctgaaggtgtgatatatgcacaggctctttcttttctttcttttctttcttttctttcttttctttctttcctttctttcctttctttctcttctttcccttcattcccttctttcccttctttctcctctttctctctttctttctttcctttttttttttttttttgagacggagtctcactctgttgcccaggctggagtgcagtggtgcaatcttggctcactgcaacctccacctctgcacaggctctttctgagagcaatgcttgaagtcattcattctgaaacaccttctattattcttcttcttcactttctatgcaactgtttctatcccactatagttctagccagtagatacattatttattttattgacatcataaataaatatttatgtttttacatatgcaaagaggtaaaataccaatcaaatcaaaatatagtttgaaatggtgttagcatatttgatatattaatatgaatgtaatcaatatagatatatgatataagctgttaaattacatatattataaatacatgaacaattatataaatatattcaaattaatccaatttaaattgtgatttcttagttaaaattcataaaatcactatttctacagcatcacaatagtacttagttccactggacaatgttacttcatgaaagtagcacaactaacaggatgcatgtttttgcacatcatatacattttagtatctaaatgtaaaatactctaacattttttggagagtgaagcagtgttaaagtcctcaaattataaactatgggatttgccagagacaactgaatagagagccctgcatcagcctgctgtaggaccgtcagttatgcagaaggttaagagaggcagtgtcctgggtaggaggcccatggaagggcctgggagtgacgagaagcccagcacgtgctgaacaaggacagactttatctggaatgaatgatgtgcattatttatgaaatatgggtgaattaattttgtaaacggtttgactgtaaagtgacaatatgtctactttatactcttgtcatgtagcatgtaaaacaactttgaggtattataaatttggattaaattaagttgtgccagcagctgagtccatttcactgatggagaagggcttcccacagagatcagcacagcctttccggccatcactgcagctgcccatcccctgccctttctagtgagatatggtcattgagcatggcatttgcttcagttaggaacctgttgctaattggtagcgagtattcaggattctttagtgctgtctttaacaaaataagaaaaactaccactaacatttatggaatcaaaaggcaagatacccaaagtcactaagctacagaaaatgccaggccttaattggaagatgctggttagactttgggtcattattctcaatgtggaatgacataaatgacgtaattaccttaggtgcatgagtttgatttcttacttttgtaattatcctatatgttttgaaacagtaaattgtaaattaacgtatgctttaattcttactgatttgaaagattttaaaatacaagatttcatgttttatttattttaaattttatttcaagaacaattaacacaagatctgccctcttaacagattttaattgtacaatacgatatcattaacaataggtacaatgttgtacagcagctctctggaacttactcatcctgcttgattgaaatgtgaagtccattgtttaatagcacccattctcacttcctcagctcctggtaaccaccattccactctttgttcaatgagtttgcctactgtagatacctcatataaatggaagcatgcaatatttgtccttttgtgcttatttcactttgcataatgtcctcaaggtttatccatgttgtctcacattgcagaatttttttcttgtttaaggttgaataatattctacggtattgatatacattttctttattcatttgttgtctgtagacatttaggtttttttccacatcttgattgactactataaatagtgctacaatgaacatgaaagtgcagatatctcttccagttcctgatttccattcttttggataaacaacaaactatctgaaaaggaaattaggaaaacaatgccattttcaataacatcaaaaagaatgcaatatctagaaataaacttaactaagaagattaaagacttatacagtgacaactataaaataactgatgaaaaaattaaagacacaaacaaatgagaagacctcccatgttcatcaattgcaagacttagtattaataaaatgtacattgtaccaaaagtgatctgtagattcagtgcaattcccatcaaaattccaatgttatattttttacagaaatagaaaacacaatccaaaaattcatgtggaaccacaaaagacctgaaacagccaaatcagtcttgagaaagaaaaacaacgctagaggcgtcatgcttcctgattttgaaatatatttcaaagctatcgtaatttaaacagtatggtactggcataaagaaaggcatatagaccactggaacagaatagagatcccagaaaaaaatccatgcatgtgtgatcaactggtctttgacaagggtgctaagagtatcaaattaggaaaagatagtctgttcaacagatggtgctgggaaaactggattttcacatgcaaaagaatgaatttggacccttatcttaaaccatacataaaaatgaatgcaaaatggattaaagatttaaacataaggcctaaaactgtaaaacttctagaagaaaacatttggggaaaagcttcatgacatggatcttggcaatgatttcttgaatatcaaaagcacaggcaaccaaagcaaaaatagacaaatgggactacattatactaaaaagcctctctgcagcaaagaaaataatcagcagagtgaaaaggcaacccatgaaatgggagaagatatttgcaaactatataactgataaggggttaatttccaaaatatataaggaactcctataactcaagagcaaaaagacaaataacctgattaaaaatggacaaaacatcagaacagacatttctccaaagaagacatacaatggccaaagtgttcagcatcactaattatcagggaaacgcaaatcaaaaccactataagctactacctcacacctgtcaagatggctattatcaaaaaacaaaagacaacaaatactggcgagggtgtggtgaaattggaaccctcgtgcactgttgataagaatgcaaaatggtgcagccactatggaaaacagtatggaaattcctttaaaaattaaaaatcaaacttccttatgatccaacaattccacttttaggtatttatccaaaagaatggaaaccaatttctttttattattttcatatataaaccaatgtattttcttgaacattaacatcccaaagaagtaatacgtctataaaagaacttttttgagccctttgatgctgaaatggtaaagttaaatagggctttgagcatttgtagagatctgcatagttttgaacttgtaacaactaccatataattatttacccaaactcagtgtaattgcttttctatcatgcattcagttgttagtcagaatatagggaaaaccataatttttcaaattaacaaagtttggcatggctttctctgctcagatcctcaacagtgtagcaatggcatctttattattttacatgtactgtcattgcaacacctcatcatactttaatgtttcactgtagaaaacagtaaaactaactacaaatgatatattcaaaaatgcccagataacattagacgagaaagccagtaaaacatcacaagatgaacgcataaggacaccaaagaatattaaaaatttaaaagagagaagactagagcaaaatgttgacaaagagaataaatctgaattcagataaggctgagcctggttttatctgcccagctggggttagaaagagcccaaattactagtatctcacaaatccaattctactcttagaattaaaacttgatgtaagataaattttcacaatttccaggaaagacatctgttgaatataatatttaggacattgtaacaactgatgctgagtataaagattctaaaatattccgttagccatcataatagttaaatcagtcaggaacacggttattaaatcagtgtagtagagtaccttattatgctttttccttattatattttcattctataaaaatactatgcaatattagtttagttatagtgttcatgagtatagaataatatacatgggtcatatctgtatgttaaaataagacatctttaatttttaatgatattgattttttagaagacctttagagttatcaacctttgtttgcatataaaatattttagtgcatttagtgaatgtaactttaggttatcatgaaggtaagatgaatgattctaagctaactatattaactctagtagttaaatcttgggggcacttttatttgggaaaaaagatataagtgatcaaggaagaatcataatactaaatgttatcattaagcttataattctataaaatacttcgttgataagtattgtttgttttaatttattgtggtaataagttacattgccctttttaggaggtcaggaaaccctggtagatctatccttaacaaggatttaaaattaattcattttggaaactagcaattaggaattctccattaaggactttcccattaagaatctttcatttagcaagaaagtaaacccttgctagacagcctttgtagatatttccttagataaatgttttgtcattaaacaattagtgattattcataggaagctgggaaaatgttattagatggcattttagtgacatttatttcagccttatattaacataatcatttgaaaaggatttttaaaacttaggaaagaatgcagatatgcaagtgaccacaggctgtctgtgaatgcacagtggtcatggagggttattaaaatatcacccttgtagtggtattttctgaaatcccatttgcattttatagactctcaacactgtaaaataggctttgtgttagatgattttgcccaactgtaggttgatgtaagggttctgagcatatttaaggtgggctaaaccaagctatgcattagatgggtgaggtgtattaaatgcattttcagctctcttcataaatcaaaaagcatctatattgtttaactgctgtgttttgtcattaagcagttagtgatcattcattggaaatttgttacacagaaatagaaaactagtacaatgttactacactatgtgaagtgtttaatttctcttgctggatattgacaaaaacaaagcaaagagaaaaactctaaaattacctaaataaacgtacctgatgacccatactcttgaccatttattaacagagaaatggttagcttttaatcttttattactggatattgatatatattttaaataactagggaagcagcaataagataacatttagcctaatctaatcatgtatgttttaaccacttcctactgggaaattatttgtttatgaagtaaattattcttttttgaaatattttgaaatgaaattattttttcattttaacagcaaaaatgttctttgatgcattaatatgagtgatcattttagctcatcataattgaggaaatcagtgtatatattgatgtagtatttattgtgaaaaaagattgtgtttaaaagactgtcttttttatttttgtgacttaccatttagtatataatagatttcacggctgggcgcggtggctcattcctgtaatcccagcactttgggagactgaggcgggcaaatcacaaggtcaggagatcaagaccatcctggttaacacagtgaaaccctgtctctactaaaaatacaaaacattagccgggcgtggtggcgggcgcctgtagtcccagctactcgggaggctgaagcaagagaatgcggtgaacccgggaggcggagcttgcagtgagccgagatcatgccattgcactccagcctgggcgacagagcaagaccccgtctcaaaaaataaaaaataaatagatttcacaatccattcatgcctgctaactcagtttatcctcataatgatcccatgagtttgagattgacaggcatcagctttatgtatcgttatttcagtgatttcaaagctaagtgtatcttagcagatatcaggatccatgaagatcaggaaaaccaactcagaaggtggtacgatgaaggcagtacacagacttgttgtccttgaaccatgtccgaaaaaagtccttttggggtttcatgggacccaataaatacaaatttttccccatccaaattcaaacccaactgaaaggaacaaaaagaaatctggtagggatagcttaaaataccatctgtattactgataaaaagctgattggagggtactggcttggatttggccaaacgtcttgcaccccagaattagaaagatgacccatcaagtcacaggcagcatggaaaattgccgatgcctgctgcgaggcaaggacttgatattgtgacattcttcctggtgggattgcctatacccacagcagaccagaaatccgtgggtaagtagatccctggggaaggaggagaggagccagaagcctgtgcttctcctaactttccagccacacacatcactctcctgcggtgcagagaagggcagagtgtttctctcaggaaaggtccctcctgcatccaccacttaagtaatctcatgttgatttttcagtctgccagagtgaggatataagtcagaaaccggggagagggggtagaaaagtggagaggagagcttgaccccccctttcaccatagagaccaagtgattaatcattattcccacttacctgcacatcacttctggctgtttcaaagttctgcctgtgggaattgggaagacgaaatgccttcactgtatttatctgattttacttattattgaaaatccatgagtggatccattcctattgcactgaaaaacaaaagaaacaccagcttcttgaccgcaggctgggcacagttacctctgcagtcttgttctaaactgccctcctgttgctcattggctttcaatcctgcagacagttctctcttgcttcagtgttttggtatatgctcttctctctatctagagcatccactccaacccaggcacacacgtacagtcacatcattatggtttggatctgtgtccccacccaatctcctgttgaattgtaatacctagtgttgaggtgcagcctggtgggaggtgattggatcatgggggcaggtccttcatgaatggcttggcaccatccccttggtgctgttgtcctgatagagttatcatgagatctggttggttgagtgtgtagcatctcccctctctctcttgctcctgctcctaccatgtaagacgtgcttgctagggctttgccttccaccatgattataagtttcttgaggcctccccagaagccaagcagaaaccactatgcttcctgtgcagcctgtagaaccatgagccagttaaacctcttctttgtgattgacccagtctttggcatttcgttgtagcaatgcgagaatggactaatacagggtctcagctcaaaatgatactttcttgctgaggttatcttgatcacctctggtctaagacaggatcctcctacattctcttttgtaagactcggacttatttttcccagcatagcacaccacaattttctggttgttaaatgtctgctaaccccgtaggatcatgtcagttgagcctggtagcataaaacttatgctctgtaagtatttcttgagttgataaataagagattaaatgaccaagggatgtattctttttatttcaatatagttgttgttatatgattttagcaaatgagtatagaaagaggcaaagtaacctagaaaaagcacagatgcttaaaaattagtagaagaataactgaacccctcaaaggcaaattagacaggatgtgaaagcatgggcatgatatgagggagtgagaagagaggctccagttaacttgggaaggctcttagaaatggatactgctaagctgcttcccaagagaggctggtggattgggtctggggaggggctccagctaagtccgtgttgcagagcaggtttggtttgcagacactgcaaactttagggtcatctaaagtttaaattacactcagggaatacagcatgagtagcaggagtccttgactcggatttcacattctttcccatattatctcctttgtaatgttttttgctgacagtgttgatgtgatatagatagaggcattccatttcttaactggtgaaagggaagcaaaaggagtatgcctgaatgaaatcatacaacacacggaaactttctgtacggagctgtcagttttattaccctatctctgcagtggtctcactggcaaagtacccatatctttgcagtggtttcactggcaaataattagggttgcaatttataggattaattaatttaagaaaagacaacagggggcgtggtgactcatgcctgtaataccagctctttgggaggacaaggcaggcagattacttgaggccaagaattcagaccagcctggcctacatggcaaaaccccatctctactaaaaatataaaaatataaaaattagctgggcgtggtggcacgtgcctgtgatctcagctacttgggtggctgaggcaggagaatcacttgaacccagaaagtaggggttgcagtgagcccagatggctccacagcactccagcctgggtgacagagtgagactccgtttcaaaaataaataagaaaagatgacaatgtaaactactaaaattatattgtatctgtccttgatcatttactgaacttaaagagatcaaatttatccaaaaccaaaatgacttctactaaaatgctttctgggagcgtgttatgaacacactttacaaatatattttataaataacatcagattggacagattttatttttttaaaaaacttactgtgatagttatttgaacaaaagactgtctatcatatttttagtgactagtgctatagtgtatcttaagatatctttgttccccattccactttgcttgccttcattgagaggctggcaggtgcccctaaggcagctgcatgcagccacctgtaggctaccgaggctcagcctagcggtggttttgctctgctccctggggctggcttctgtgtgcttcctaaggaagggcagtgtggcctcagctgcaggaaggcctctaacaaacttggccatgaaaggaactctctgaaactgacccagttgttccatagatagttttttggataaacagaaattgacccttctggtcttaaagcttgaaacttacatttgttttatctgagttcctttctcaggaaagggccttcagacctctcaaagtatcaaagaactgaaacttaccaggtcaccacatccagacaataaaatgcctgaccccacgttcatcatggttgcttccttgtcccatcctagttcctgttttcctacacattgttaaatttcttccctgctataaaaacccctagttttagttgatcagagagattaatttgagactgagctcccatctcccagactgcagcacccaattaaagccttcttccttgtcacttcagtcattggctttctgtgcagcaaacagcaggacctaaaccaaacccctgctgtttcagtaacatctccccagggaaagcaatatgtgggaaggaagagcagtgcagtattatctggcacataaacaaaggaagacacatcaacttctttgctctgcctatttgacattcttggtggctccatttagaaacattttaccactggtcttccaactgcctttctctgcactgtgctggtggcagagatgtgtctggtgcccagaccaaccctatcccctgctgttctcctccatccctgccttaatgatgcccggctcacactgccatttgattttcagcagtgtgatattgatgccttaaaccacctgcatctccatcccatttgtttttcaaatgaatggaactatgattaaaagaaaaatacaacgctgtagcatttttaaccagtaccctggcattttctcaaattatttatgtctttctaaaaggtattatatcagtgctttccagtccaaaaatcattagaagacaagatattattaggactgagtttggaggaggaagataaacctaaagctattccaagtacagaggaatttcattatcatggacatcagtgatacaaatcccattattatcggtgtctaaagatacaaatagcactatagttttaatttttatcccagggatatgccttcaattttctcttttattataatttttatgagtgatttaaccatattacagcaattgggaaataaagaaggcaacagcacacttggtctcctaagcttcaggctcttgctgcaaggagggacgttcatcagcctgaactggaactgcagctcactttcctgtcacagggaatattcttataacaaaattaatgggctccagatgcagatctattcactttcttcccatttctaccaataatatgaaactgttaatgtcttctggtaacatagtttttttctcacaaatgctaataaagataatatcttgaaattacaaaccaactaatcttatttacttgattaggttttatttagaaaagcctactttgagatactgtaaaaatagtgaaaagaatattagcttaggattcagactgggtaagggtctcggttttaattaggattatgttcaatctgtgattctcccatagcacacacacactcagagaacaagaaccattagtgattacttattttaattaaatgctcagtttaagcctggcacaaaattatgaaatcctttggcgaaagttattctttatttctatttttagtataacatgaaaaagtacctgctaccctgttaaacttctcattataaaaataatgtgaaaagttacactcagacaaaaaccaccaccccattggtacaatatggaaatagggatcccagcatggatgatttagtaggtgttaatagagtaagctgagagttaaaaaaaaaaaaactaaaacaaagacatattttgtggatagtagccatcatcatatagcaataagatgtaggctatacataacggccaaatgtggaagaccaatttgagatgttcagtagcttacaagactatgtgcacaaaatgtgaaataacagaatttcaaagatgacagtactcagaaaacgagatatgtaaaagaggataattatctaccttttcttagcaatgaaacatattagaatcttgaacatgtttctccagagtaatctctccatgacagaattatcatggacattccactaaatacctaaaactctctcaagatgcacccttccagcttgacctagtgcaaatctcacgtcttctgagaggcattctccaaattctccaatactctttattcaagtcccattcagaacccctgaatttgtctatactacgggtgtatctatttatgtcagaggaattcaggggccaatagaacactatacttttttgaatcctgagccatatcacagtgccatatgtataatttggtacccaataaatattttatgattcaaaaaaagtgtaaatatgaaagataactttcacaggtgtatgtgtatatgaagttagcaatgaccaagaaggaatgacacaaatttattactagattgataacaaaaaattactgaagggtttgcagacaggttgatggatccaatataactgtaaaaatttattagtctattattttgttaacagaatatgatatttaatggaccatgatattccctcacaaatttttccatctctttgcaaatgcacttgagtaaactgttgtataaaatatgtattttcttaaagttgttgctttccaaaatttgctgagaggtatatatacattgttgtctaacattgacttttctttgtatgtaaaatgtccaggttagtagcaaaagcatcagtacagttgatgatacaactgtaatatagttctctgttgttaattacataaaatgatgtggactaattgattgattgtacacttacgccagtcatcctgacactcttaatttaatcttaaagtatattctgtttgattatctggtctgggttccaccacactgttcataatatattgagaagcacattcagctatgtggaaatgtgtttttaattcctgggtagtcataaatgacaattataatgatgagcatgatgataatgatgatgataacctttgtgtggtgtgttagaatgtgggaagtaccaccactccgggtatataaatactctttacaatgcctccttttccaaattaagagactactgttccaaatatttcatatgaggagaggttctaatttgatttttatcctcaaatagtttcctgaacacagtttattgaataactatgtttcctattagttattatgcatttgttatcatactataagctcttatgaatagagactgtttcagagctacatgttgtatctacctttctgttgcctcttttgctagtgttttagaacccaacatttccaattataataaatttatcattgttttcatatatatatgccagtcccccgattaatttttgcctttacagtctattatgaaaattttcaaatgcatattttaaaaacacgaattcttcatgaagttgtgtgtcatccttataaggcgccacgtcaatcttttctgattttccagttgtatcatctgtactgctaaatgaacataacatctgagaattcctgagtcttttctgtcccgtgattctcttcttgtgtctggagttgttgtcctatggtagctgctctcctgcatcttttaatcagctgtactttacaagacatgaaagtaggcttgtctatttttattatttttactagcatctagtatactgctaccatgtaataggtactcaacaaatacaggtacacttcaactgaaatgtcagaaattaaatgcttttactgagatcgcacaaccagaaaatgagagttaggatttatatccattccatttgattcaaaaatcaaccctactcaatggccctatatgagatgtcataaatggtggtagtgagaataagtagctgatgagtatacttccctaacatgatacaaaatatttacaacaaaccagcagccaagaacatactaccagaagcccacaggcattcccactgaagccaagaacaagaaaagtatgtctgatatcactactgtaatttggcatttttctgaaagtttgacaaatgcaacaacagagttaaataaggaatagaagtagattaatggaagatgatttgagaaaaaaacttgcaagtaattttagtgttaccttatgcaacccagagaattaaaggaaaactattgaaacaaataaaaagtttataatatatgtatttagtaagaaaacatgttagtgttcattatacatctatattttggtctcaactagctagaaaatgggctagaagaaaaatcacacatcatactggaagatatatgtaagttctttataaaactacaataattcaacccttatggcatataaacaccaaatataccactggaacataaagagatttcagaaagagttggtggggatataaactggtacattcagtagagttacaatttgttcacttttctgaagatgttatgcttcactaacataaatgtaaaataaactgtaacactaaaattatttaagttgtttattaaggtagtaatgataaatattaaattcataaacttaaaaaataaaatttgttgggaaagggtagtaaactcaacatattgttaatttaaaaatcaatatcagagagtgaccaatatttctgcacacactcaaatataactgctgattgaacagagattggacatgccatacttacttgtgttcatttccttccatgacaggtattgtgctgcttttattgtattaatacaaatagaccaaggcatttgaatgatggttgatagggacaaccttactttgttgaaataagtatatccatttgagtataggaaaaactcaggaaaattattgttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaaaaagcatagttttttttaacaaatactacatatataatatttatatgctatatatttttatgggttgtttttttttcttgagatggagtcttgatctgtcgcccaggctggagtgcagtggcacgatctcagctcactgcaagctctgcctcctgggttcacgccattctcttgcctcagcctcccgagtagctgggactacaggtgcctgccacctcgcctggctaactttttgtatttttagtagagatggggtttcatcgtgttagccaggatggtctcgatctcctgacctcctgatacgcctgccttggcctcccaaagtgctgggattacaggcgtgagccaccacgcccggccataggttttttattagctttttatcctaaatgatttgggatcatttctagaattacttttaatgtctaaatagaggtattcatatttatcagaaaacaagttttccagcaagtgggatttcaggggattttgtttatttatagctgcggtagtattaaaggaatttttcttcctctagaagaggaggatattttttaggtttattttattttgcatagcagggtgactatagtaataacatattgtatattttaaaatagctgagaggattttaaatgttctcacaacaaagaaataaatattttagataatggatatgttcattaatctgatttgatcattttataatgtatacatgatgtatcaccatatccctttaaaccccataaacatacacaattattattttttttttttgagatggagtctggctctgtctgataactaacttttactgaaactaggtttacatttcttttccttttttttttttttttttttttgagacggagtctcgctctgtcgcccaggctggatggagtgcagtggcgccatctcggctcactgcaagctccgccttctgggttcacgccattctcctgcctcagcctcccaagtagtgggactgcaaggtgcctgccaccacgcccggtcaattttttttttctgtatttttagtagagacatggtttcaccatgttagccaggatggtccggatctcctgacctcgtgatctgcccacctcggcctcccaaagtgctgcaattacagggctgagctaccgcgccaggccaatatttaccaattaaaaataaaagaatatggctgggcgcagtggctcacgtctgtaatcccagcactttgggaggccgaggcaggcagatcacctgaggtcgggagtttgagaccagcctgatcaacatggagaaacccgtctctactaaaaatacagaattagccgggcgtgtggtgcatgcctgtaatcccagctacttgagaggttaaggaaggagaattgcctgagccagggaggaggaggttgcgatgagccgaaatcgcaccattgcgctccagcctgggcaacgagcgaaactccatcccaaaataaataagtaaataaacaaaaaaataaacacaggaatatatttttgactttttctgagagtcaattagaagatatcattcagttgaaattaaattattctctatagtgacattctgggaaatagcaatttcattaaatgaaatataagctcaataaataaattgacaaatttatttctgtgcatatttctagagtcacaaattcccactcctcacaatttagatgatcaactccaccaatctttaccctttcttatgcttaaccaacaagaaaattcatgtccagtcttctgcatgattcagaataaacaaaaggtcaaaatctcacaaaatattgaaattgctatggaaaggggagtgagttagtctctttgtgagtattagaagatagataagccaaatcaatcactgactattttcagaatccatctttatagaaaatatgctttaaccttcccgctaaatcctaggaattccctgtctgcatatatgagcaaccaggatcactgtaacattgagaggaaattttataaaaatcgtatcattgaaggagaaaattatgttattcatctacagcaatgttttaggatgtagtcagatttaaaatgtgtaagcattcatgcatgcaatcattattccttttacaaggaaaagaattttataaactgcaacttaggtctgatgcctaaaattgttactaacatcctagcaagaaatgaaagtttagaaaactaccagaagtgactaaaaacacgaaaccctgaagtaagaaaagaatagttgttaggataattaaagataaagaaaatgggtttgatataattatatgttacctaggaattgttggtgtgaagttatgaaagcacaagttaaaagtttttttgaattagaactatataacacaaactaaaatgcagagtcacttactatacactatttatcatcttaggcctgtgaattctgaagcaatgccaattattaacctattaattttaaaaaatatatactgagcacctaatataagcactgtgctgtctatggtggatcttagagctgccagggccattcagtcattgaacacagttttcttaggttctatgatgtataaggcacagtgctaagcgctacaaatacaaatactatttacaaagcccattgtggaatagaagtttacatacatgtggcacaatgtggtgaggcttatatgagagataggctcaaacctttgtagggatcctatgagggactcaaaatggtttaaggaggttaggaaaggctgcacacaggacttagatgatttgaggatgctgtatacagaaaacaagaggttgctgagtgagaagtttcctgtggctaaaagagttcaacaaaggacaggggaacctgtggaaatagtcagggaccagatgtaagaactatgtatgccctagtacccattcatatattatcctgtgcactgactgaaagccatcggagacttttaaagagggaaataacttgttcgattagttttcagggaaatgatttagggagcactaaggagggatcgctgatgtggaaggtgataagtttgagtatctatcatgtattaagtgttgttaaattaagtttagcctaaatctgcctccttgtagttttggcctagatgtttccccatatatcagatttttggatactctttcttatgaagggccgtcgattgtctatctgttgtcttatatttttgaaggagtatgctatatattcagaatgctagtcttaggtacacgtattgcaacatcttcttccactctgtggattgtctcattactctattaaatgtgtcctttgacaaagtgatgttcttaaaatggttttctgtgccctctttaagaaatgtttgccttcttcacagacatgcagatgttctttgtccttttctaaaagtttatttttacatttctatgtgcaatccatattgaattaatttttatgtatgatgtgagattatgattcatttatttccatataggtatctaattcaatcagcacttttttttacaaaaatgttctttcccccttctgattaagaagagcattttttggccaggcgcagtggctcatgcctgtaattctagcacttagggaggctgaggtgggcagatcacttgagaccaggagtttgagaccaccctggccaacatggtgaaaccctgtctctactaaaaatacaaaaaattagccaggcgtagatggcgtgtgcctgtagtctcagctactcaggaagctgaggcataagactcgcttgaacccaggaggtggaggctgcagtgggctgagatcatgccactgcactccagcctgggtgacagagcaacagtctgtttctaaataaatagaaagaaaagcatttcttatactttgaaacttccatgggcattttttatattattatctcttttttaaaaggtatatgttcttcctattttttatgactaactccttattcagaatgggcttctcaacattttgggggcccagaataagagtacaaataggctgggcacagtggctcacgcctgtaatcccagcactttgggaggccaaggtgggcagatcacgaggtcaggagatcgagaccatcctggctaacacggtgaaaccctgtctctattaaaaatacaaaaaactagcggggtgtggtggcgggcgcctgtagttccagctactctggaggctgaggcaggagaatggcatgaacctggaaggcggagcttgcagtgagctgagatcatgccactgactccagcctgggcgacagagtcagactctgtcacaaaaaaaaaaaaaaaaaaaaaagagtacaaatagaggcccatattttatgcccctacattctccacctatagatgaaataatttaaagcattcagactaataatgactgataaattaggttgatatttgaaaaattaattttacattattacttttgttccctgccaatgactttaaattatcacaaatgcattaagttaaaaagaataaaattttaaagattagttcaacagtgaaaatgtatatattagattctattattttaaagaaattacttgttaatagaaaaatagtcacgtttcagataataggaaaaacatagaaatttccatttttggtctttagagcattgacatagcttatggttttgcctcacatattttgttgccacttaaagataggaggggctgggcgtggtggctcatgcctgtaatcccagccagcactttgggaggctgaggagggcagatcatgaggtcaggagttcgagaccagcctgaccaacatggtgaacccccgtctctactaaaaatacaaaaattagccaggtgtggtggtgcgtgcctgtaatcccagctactcaggaggctgaggcaagagaatcgcttgaacccgggaggtagaggttgcagtgagctgagatcacgccattgcatgccagcctgggcaacaaagcaagactccatctcaaaaaaaaagataagagggagattcaatcaaaggtgttgtggatctaacttttgtttaggtcaggcatgtatgtgtcatgctggtatctaataggacattttagtggtttccattttctatgtatgtgactggaacagtaggaagcctgcatgatggtaacagatcctgctgtttctgagtcagtctatacagattgaagtagcttcaatcaggtaattttcaattgtatttgattttgttgtaattacaaaacccgaaaatcccaatattttctgaggttttactccaacatatgtgttagttgaagagccactctaataaggtgaaactacaggctcctcccattccacactgttctctacattatagtatacacatctactacagttcttattattctttctttctcctgccgaagtatgaatgcctccagatggggatctagtctaatacagtagaattcaacaagcatttatgatgttccaggcacagcgctagacacgcataatacagagaggagggggcaagtgctggtggaatgggcccccagcacagagcacaatatgtgaaatgtttggaaaaattagatctcatttatctttacttctagcccagagtgagcctacactacatgggcaaatgcatcagaatggaaatctcccaccaaccccaaattccaaccccaaacagggcacacatacacacacacacacaccccacaccagtgcaagcactgctaactagcgagtacattttttcctactaagccaggcacaggccatagaaaattctcacacaacactcaaggttttcaaccctagctacacaatagaattacctggaagcttcataaattcccaatgcccagatcatacaatagagtaatttcatctcaacctccgagagtagggcccaggtgtctgattcttacagctctccaggtgcttccaacgtgcagtcaaggttctgaaccattgctatgctcttgccagtgagcacggtccctggagcagtagcagcacccactacgagctcatgagaaatgtacaatctcagttcccaccccagatccactgaatcagtgtctgcacttcaactagatcccagctggtgtaaatactcatggaagtttgacaagaacctcagcaccttccaccacctcatcctcagtgagtgagtgttggtaggttgaatggtgattccccaaggatgtccacatcctaacacccaaagtccacatcctaacacccaaatgttaccttccatggccgaagggactttgcagatgtgattacattaagggtcctgaaattgaaacattattttgtattattcatcactttcaccagctgattaaagggccaggcttcactgtaaaattatgagtttcccacttataattatttcgtgaggaggtagtttgaaactacttaagtgtcttgttcttcatgcacctttcaatttattcattaatttatgcacatccacttggactcataatttccaattttatccaatgggctctcatagtcttttactgacatttattttgatgctcaaactttctctgatttggcttgtgggagcccttctgagcaggcttttctgtcatttcactgtccataacactctttgagcccttcctttctgacacaagatcttccatgctcacctcgtcctttccttactccagccctggaattagctgtttctccaaggagctcttgctccttttagtggagaatgagtccagagccagatatgctcactgctcttgtgattctgctcccaggccctctgagaggacatgtcatacacacacacacacacacacacacacacccctacatacatcaacatttatttctgtgcctatctatatatgtatagaaaatggtgagttcagacaaatttcaatttctgttcaatatcacagggtttaacctggttttctccctttctatgtttgtacctcccttcccctacaatgaggagcttggctcccattgttcattcatttacttattcagtcaatcccattcatgtttccattctcctacctctgccacaccctctccttcaggcagatgcccttcctgttccacttgtgctccaacaccccgcactgggggatttcagtgctgggcagtgggggttctactcacccagtgattacagtgactataaacatcaaactattactacaagacattatcaatttgcatttttaaaaagatcgtctattatgctgcttataagagacagttaaaagaaaataactgaaacagtttgcaaataaaagaaaaagcatataccaaatcaatactgactaaatgaaagctgatatgaaaaaaaattaaaatcacttataatgtcaccaagagacataaaataattatgcaaaaaccaagaaaaatatatctgtatgtattataactgtataatatctgtaggctgagagcaaaaaaaaaacactgatgaaagacatcttaaattaaataaatggaaaaatagacagtgttcatgcactggaatacttgatattaagatgtcaattcttcccaagctgacacttgtgttcaacacaatgccaattgaaatcccagcacaaatgtttgtagaatcaacaagcttatttaaaaacttatatttaaaggcaaaggaactagaataaggtgaaataagtggaaaaggacaaatatttcagattccacttacacgaggtgcctagagtagtcaaattcatagagacagaaagtagaatgttggttaccaggggctgggggcaggaggaaatgcaaagtgttcagtgggtaccgagttgcagtttaggaagatgaaaagagttctggaaggggtgatggttgtacaacaaaaaagaaaactgagctgtcaacaaaaaggaaaacaaggagggttcagcaagtcaatttgaggatatttttccttttatatgtgggaagctgtcccggaatgaggcagctggcaaattttaggacaatgaatcatgtcagtttttctttttatcttcacagtgcattgtttttctacctgcttgtcttatttttagaataatgtagaaaaagaaaatggaggctctttttcctaattttggcatgaatcccccttgttccaaatgaagatggcatcatgaggcagctcaaagaggagagcttaggtaatgcacaatgtgttggctgcctgtccacatctgtcctgcattgatgtggtaggtgagcaatctttttgtgaaaatcatgtttgtgaccataatcatttggatgaattcttttaaagaaattaaaatcccagaaagaaaaaaattcattatacacctattaagaatgggaaaaaaaaaaaaaacaaaaacctggcagtaccaagtgctgacaagaatgcggaacaactataactctcctatattgcttatgggaatgcaaaatggtgtggcctctttggaaaacaacattttgacagttcttgttcttaaaaagttaaccttagacccgccatacaaactgtatgtaaaagtctgtagcagcttttctcataattgtcaacaaacaactcaaatgtccttgaatggacaaaccgtttggcacacaaccaatggaatacaactcacccatagaaagaaacaagctactgacatccacgtggatggacatcagatgtagtattttagtgaaagaagcctatctggaaaggctacatactgcatcaccatctatgttatgtcctggaataggcaaagcttcagggacagaaatgagatcagtggctaccaaggaatgggcatggtgaacaagaaaggagcctgcagaggggcacgggacattagtattgttatttattattattcgagacaaggtctcactccaatgccaaggctaaagtacagtggctcaatcacagctcacttcagcctcttcctcctgggctcaagggatcctcccggctcagcctccagagtacctgagactacaggcacccaccaacacacccaactaatttttgtattttttgtagagatgggattttgccatgttgcccaggctggtcttcaactcctgggctgaagctgtccgcccacctagacctcccaaaatgagccacagcacccggccacagggcattattttatggtggtagagctgtcctgtatcttgatgagttgtacaactatatgagcttgtgaaaattcacagaaatatttactttcagggacattttatttagtgaactttatttcatgaaattgtatttagggtaaatcttattgtttgtaaattacacctgaatttgtccgacttgtaaaaaactaaacaaaaagctaggcatcttctttttatttcaagcatttatttggtgatttgttgtttgcagaagtttatagatttattttttatttaaataacagaatcttgcaagtgaaaggaaacaggtcatcttatgtcaattcctacttttttttctttttaaaaaatattttaacttttattttaggttcaggaatacatgtgtaggtttgttatataggtaaactcatgacttgggcatttggtttacagattatttcgtcacccaggtactaagcacagtacctgatagttttttgtttgcttgtttgttttttgaacctctccctcctcccaccctccaccctcaattaggtcccagggtctgttgttcccctctatgtttccatgtgttctcattatttagctcccacttataagtgagagcatgcagtatttgttcttctgttcctgtgttagtatgctaaagataattggcctccagttccatccatgttcctgcaaaggacatgatctcattccttcttatggctgcatagtattccatagtgtatatgtaccacattttccttatccagtctactgtttctttatttgtttgtttgagacagggtcctgccctgtcacccaggctggagtgcagtggcacgatcttggctcactgcaacctccacctcccgagttcaagcgattctccagcctcagcccccgagtagctgggactacaggcatgcgccaccacacccaactaatttttgtatttttagtagagatgggttttcaccatgttggccaggctggtcttgaactcctaacctcagatgatccacctgcgttggcctcccaaagtgctgggattacaggaactgtaatcccagtgtgagccaccatgcccagcctatctagtctactgttgatggacatttaagttgattccatgtctttgctattgtgaatagtgctgcaatgaacacaacgcatgcatgtgtctttatagtagaacaatttttattctttgggtatatatccagtaatgggaggattgctgggctgaatgttagttctgtttttagttccttgtggagttgccacactgctttccacaatgcttgaactaatttacactctcaccagcagcatataagtgtttgctatttctctgcaacctcaccagcatctattatttttcactttttaataatacccattctgactggtgtgagattgtagctcattgtggttttgatttccatttagtaacactgaacattttttcatgtgctttttgaccacatgtgtgttttcttttgaaaagtgttcatgtcctttccccactttttaatgaggttgtttgttcttcatttgtatgtttaagttccttgtagattctggatattagactcttgtcagatgtaaagtttgcaaatattttctcccattctgtcagctgcctgtttactctgttgatagttccttctgctgctcaaaagctctttagtttaatgaggcctcatttgtcaattttggcttctgttgcagttgattttgctgttttcatcatgaaatttttgctggttcctatatcctaaatggtatttcctagcttatcctccaaggtttttatagttttaggttttacttttagttctttaatccatcttgagttgattttttttatatggtgtaaggaaggggtccagtttcactcttctgcatatggctagccagctctcagcaccatttattgaataggcagttatttcccctttgcttgttcttgtcagctttgtcaaagatcagatggctgcaggtgtgtggccttatttctgggctctctattctgttcttttggtctgtgtctgtttttgtaccagtactgtgctcttttggttactgtagccttgtagtacagtttgaagttgggcaatgtgataactccagccttgctccttttgcttaggattgtcttggctaattcgggctcttttctttttgttccatatgaaccttagaatagttttcctaattctgtgaagaatgtcattggtagtttgataggaataacatcgaatctgtaaattgctttgggcagtatggccattttaatgatattgattcttcctatccatgagcatggaatattttccatttgtttgtgtcatctctgatgtctttgagcagtgtttcgtaattctcattgtagggatctttcaccccttggttagctgtattcctaggtgttttattctttttgtggcaattgtgaatggcactgcacttctgatttggccctcagcttaggggtgctgttaatgtatagggatgctactgatttttgtacattgattttgtatcccaaaacttagttgaaattgcttatcatctcaaggagcttttgggcagagactatgggttattctcaatatagaatcatgtcatctgcatacaggattactttgacttcctctcctcctatttggataccttttctttctttctcttgcctgattgctctgaccaggacctctaacactgtgttgaataggagtggtaagagagggcctccttccttgtcttgtgccagttttcaaggggactgcttccagcttttaaccattcagtatgatattggctgtgggtttgtcatagaagtctcattattttaaagtatgttccttcaatacttagtttattgagagttttagcacgaaagggtgttgaattttattgaaagccttttctacatctattgagataatcatgtgctttttgtctttagttctgtttatgtaatgaatcatatttattgatgtgcatatgttaaagcaaccttgaattgcagggataaagcctacttcttcatggtggattagctttttgattttctgctggagtcgatttgctagtattttgttgaagatttttgcatctgtgttcatcaaggatatagaactgaagttttcttttttgttgtgtctctgccaggtttgagtgtcaggataatgctgcctgtttgaatgagctgggaatgagtccctctttctcttttttttttttttgagtagctttagtattttcctgcatgtttttcaaataaggaaagtaacagccagagaaagaaatgacaatgaacagtcagctttggcaatctgactatgtaaattagctaccacagaagctaggattaacattagggtttttttggtgatataacaaatagagtccagaaaactgccaccatatgtttacttgaacccagaaatttggcagcaaatttttggaacagaatttgtagtcttgaaattctgctttgtttaactctaggccataaaatctttaatggaaatgtttgctttaaaaagtggcttattatgcatacatgatcgatttttataatttactaatgttggtttaagtttataaactatattataaatgcctggctggatcccatgagaaaatcccaaacagcagttgtcaacctctttagactctgagccctttcttcaaacaaaatctcccagtgcatcacacgtataaaagagctcagaaggccaggcacggtggctcacacctgtaatcccaacattttgggaagctgaggtgggcagatcacctgaggtcaggagttcaggaccagcctggccaacatgacgaaaccccatctctactcaaaatacaaaaattagccaggcgaggtggcacactcctgtaatcccagctactctggaggctgaggtgggagaaacacttgagcccaggaggtggaggttgcagtgagccaagatttcactactgcactccagcctgggagacagagcgagattccataaagaaaaaaaaaaaaaaagctcagaaaagctcatctacccagtatgggaggtagctgcacctagcagtgtgtggggcttccacatgcacactgctaatgccaccactcccaaatgtcagttcgaatcgtagtttatggattgaaccacaaggcataatcacatatttaatttggttcttgttaatggagctttcaactgatgatgtctttgaaagtagaagtctattgcctagcaggtaatattcagttcagggtaacatatctctatcctagaaattcacctgtcacaacgtaaaatgtcccttattgctttgtttcatcctttggattgtcctgctttccttttttaaataatgctttctatttggggaagagcgggaagatcaaagctcaactggttgaattcagatgcttttaagacagtgggaggctgaagtgagcggatcatgaggtcaggagatcaagaccatcctggctaacacggtgaaaccctgtctctattaaaaatacaaaaaattagccaggcgtggtggcaggcacctgtagtcccagctactcgggaggctgaggcaggagaatggtgtgaacccaggaggcggagcttgcagtgagctgagatcacgtcactgcactccagcctgggcgacagtacaagactccatctcaaaaaaaagacagtcagaaggggaggacagttaggcaatcagatatatgggtatgaagctcagaacagactatttaaaataaaatacagataaaaatggattcttccatgtggatggctgctatcaaacagaaaataccaagtgttagggaggatgcagagaaattggaattcttgtgcactgttagaatataaaattgaataactaccatggtaaacagtatggcagttctcaaaaaattaacaatagaatttgcatatgatcgatcaattctgcttttggctctataccgaaagaattgaaaacagggcatcaaagagatattcgcacacccatgttcatagcagcagcatttacaatgcccaaaatgtggaagcaacccaagtatcaatcaatgggatgagtggatgagcaaaatatggtttgtacacacagtagaatattattcagccttaaaaaaacagaaatgtcatgatatgctataacgtgaaagatcctagaggacattatgctaagtgaaataagtcagccacaaaaagataaatatgatatgattccacttacataaggtacttagaataatcaaattcatagagacagaaacgctataagatttgaccttatagccatatacatatatttcaaattgtaccccaaaatgtgtacaattacaatgtctcaattacatattaaaactttaaaacaagaaagtagaacggtggttgccaggtggttgggtggaggggagaatggggagttagttgtttaatgggtatagtgtttaattgtgcaagatgaaagcagttctagagatgattggtggtgatggtcacacaacatcacaaaggtacttaatagcacagatctgtactcttaaaagtggttaagatggtaaaatgtatgtaacatattttaccatgatttttaaaatttggaaaaaaatggataagcctccaaactgaaatagtaatggaagccaattcatagcatgaacgcaggaaagggcctaagactgaacttgagggagccggtagtcaagggctgggtagggaggacgagcctgttaggagatgaagaatgtggttctgcaggtgggaggaaactaaacaagcacagcatcatggaaaccaaaggaggacagtgtttcaaggaggaaggggtccagtgccaaatgcccctgagaatgcaaagggcatgaattgggaaatgcccacaagttttaacagcacagcggtcattggtgacctccagaatcatgtcttccatccaatctggtaatctttcatgactgtaaactccttgagagcaggcaccttgaacagacctctatatcctcctgttttgcttttcacttaagaagtgttcaataaatatttactacagagtgaactcagatgatggtatttatggtattttggggcaggtgatggaactatactgtattctgattgtgttgatgattagacaaatctatatatgtgttaaaactcatagacctgtacacctcaaaacaattaattttattgtaccttaatttaattttttttaaaaaaatggattctttttcttacatggtgatgggctcttgagtattataaaatgactcttgaaattttatatatgttttctaaagagctctttgtatttatacaagatttaatgacattgaatattcaattaaagatgcaaagttttaaatacactaggagaaatgcagaaaaggtggtaggcaatatatggaaatacatgtgtgatttaagtcaatattaagaggaatgaaaaagcaagcaataaaaatatacgcattgtctcttttttttttttaacaggcaggaatgggccacttgtgtgtaacaaaagatggactgcgcttggaaggggaatcagaatttttattcccattgtatgccaaagaaatacactccagagtggtaagaaaatgttaagacaaataatttgtgctttatgaaaaataaatcatgtttaagcacaaaaattcagtacagtttagagaagatttttaaagcgcatacatgtgcacatattcatgatatgctctttataaaaagcttgactattgcagaatttatctctgatattaccttctaaaaatatttcaatttaatatgcttcagatctgaatttggtggcctcagtagtttagaccataataaactaaaggttttagaaatgaaaatttttaccaagaacaatttaaacttctttatgttagatcaactaacttaaatatatttattttagggtattcaaaattatctaagaagcttagaaagaaattcgtttcagctgggcgcggtggctcacgcctgtaatcccagcactttgggaggctgaggtgggcggatcacctgaggtggggccagcttggccaacatggataaaccccgtctctactaaaaatacaaaattagccaggcatggtggcgtatgcctgtaatcccagctactcgggaggctgaggtaggagaatcgcttgaacccaggaagcagaggttgtggtgagcccagatagcgccactgcattccagcctgggcaacaagagcaaaactccatctcaaaaaaagaagaaaaaacaaaaaaaaaaaagaaagaaatttgtttcattgtattatgttctgcacttattatactaattacagattatgatcctgtaagattctgaacaagtagattcagcattgttattaaatacttatgtgactttaaaagtaaatcaaggttttcttcatttacctccatggagcttataagaaggacagccaagaataaagtgcaaatacgttcaaacaatgttggcaatatgttctatttttacttaagtgatgctatgagcattatagtaggcacgaacattttgctagattattgataaatggcattacctccctgacgcacaaaaagttaaaacttcacccagctataactttctagttatgtgaagagcagagtcttcattttcctttcatatttctgaatatgaaagggtatttcagtatctcctaactgcagaggctgtaccagccactataggagaattagaaaagaaacaaaagacttactaagaaacatgaggtcttgttagagacataaaacacactcctgaaccagacattcgccaagctctgttaccaattgcaaaatgacatggcatgtgactaacacataaatatcacaaagagagatcccagtaagtgaaaagtacataagtagttttaggtgctgttatgttacttctggggctatcttattggcagtgggagccagaagatgacctgcagtataataggcaggtaagagcctgattctgtgaggcttacccttaccttatgtcatacacttaccttaattgtgatggcatttcagtgtgaaacaatcctgtcctacaggatttcccttttgtaaaaggggaagtcagacatgaatgaagcattcaagtgttagaacttggtcttcttttttccccagagttgtgttggctgatctcctgccatattttgggaagaatcagactggtagaatggtccggtgactgaaatcaggtgactaggtcacagcaaatttaatattctggaattaataataactctcagttggccaggcgtggtggctcacgcctgtaatcccagcactttgggaggccgaggcgggcagatcacaaggtcaggagatcaagaccatcctggctaacacagtgaaaccccgtctctactaaaaatacaaaaaaattagccgggcgtggtggcgggcgcctgtagtcccagctacttgggaggctgaggcaggagaatggcgtgaacctggaaggtggagcttgcagtgagccgagaccatgccactgcactccagcctgggccacagagtgagactccgtctccaaaaataataacaataataataataataactctcagttatattttatcaggctttttcatctccagtatgcttttaaaaaaagcaaaattatagcgaatatcttagataatcacatattaaagtcttagaatgtggcattaatgagtatgtcaatcaacacataaaattcagtaacaatttgaataatattatgtgataacagagctgtacagtgttttataactaacatggtttccaataagagccatcccagaacaaaactatgcttcctaacttctgtatggattgatatattagttataaatttccttttcaaagatgagtctaggaagcaattttccataaaattacagaaaagaaattactttatgaatttgcaaaatttgacacataactcacttatgtgtactgatgagctgagagaatttcttctttataaatataattcaacatgctactctggcctctaacatctgatcacccagtaacccctcaaaagtaatacatgagggcctgtattgaattcatactttgaattcatggcttaaacccatccaccatgcccattagttcaaacacataacaattatttcctttaaacaaaaagggttttaaaaaactacagagccatgatgaaaaactaaatgaaacaaatacgtggtaataaagccttacttgaaatgatcatctgtgaagttcccagccctgaaaagaagctttagcttacagccaaagcccacagtgtgacagggaccaaaagggcacctcactgggactccaggcaagcccattgcataagacagtgctgaagacagaaaacaactacaactatttgaataaagttgctacaactatttgaataaagcagcatataaaaaagtagctacaactatttgaataaagcagcatacctgaggggaggaggctacaaagatgccagtccagaacctgaatgtcatgaggacagaagccctaagccaccactgaaagactgggaggccctgtggaccaagtgaaaacaacaggacagactttagacagactggtaagagccaaaaggtagacacatccacacagtggaacataaaacttgaaatttcatatgatgaaatcttcatctaaaaaaaaaaaaagcccaataaactttacataaaggaagatcaatatccaactaaataaaaagtcaatctgaaaatgactagaaaaacacacttaagattctcaaagagataaagctatttttaaaggagttttccttaaaataacatgaaattataaaatcagaagagaaattacagggcagaaataacagggaataggtttaccctcctgcattaaacaactaaaaaatgaaaaaaaaaatatatgaaacagtggttttcaaatattggacaatgggcagctcaggagagttatccctgcaagaggaaaaacaagagtgactcctcaaattgccttaactcactgcatgaagagagtttccaggctgcaatgagggaggggagccaatgcagacacaggtggtctccctgagttgaagagacagggttgggaggccaaggaatccaaggcagctgcagtttgcaaggcggagtactgcagaggaggggcttgctgcacgtggacagcgctccagagatggcagagacttcacctcatcccacccccaccaagtctatggataaatatttaccagtgtgtgtgtgtgaggaagctaccttgagactagtgaaatacccactctaagggagcagaaggaacaatgcctggagctcacacagggtggggaacagttcatattcccaccagtcagagtggaaaacttcataaattatgggcatcaggtagaatacagaagggcatggctcagaagtggtacaagatcaacactaggaaaaaaatcctgctctggtccattctaacaaagcttaacaggaatccttgaaagtggcatgctttttccaagtgatttgctccatcccagaacagagttctaaaaaactacatttcatctgtgcacaaaagtcgaggaaagcataatcatgttaaggagagacataaaatatggaaagacagaaaaaacacaaaagaatcttctagagatgaaaagtataacaactgaaatttttaaaaagccaatggtgggactaacagattaataacaatttaaagtatagctatagatactctccaaaatggagcacagagaaaaatgactagaaaaagaaagcaacagcatatcagtaactttctttttctagaaaaagaaagcaacagagtatcagtaactagagggacaatgtcaaggggctttatgtatgtgtaactggcatctccaaagaagaagaaagaagagaggacaaatattatttaaaaagaataaagtgtactttttttccaagcatgataaaatctttaagcctacagataaaacatgttcaatgaaccccaaacaaaagaaacaaggaaaactacaaggtacattgtaattaaattgcttaaaaacaagagagaaaaatcttaaagagaaagccttagaagtagctagagaaaaaggatatataacatacaaaggagtgaaaaaaatatgacatcagccttctagtcagtaacatttaaagccagaagacactgaagcaccgactttaaagtactaaaagaaaaaaaggccaacctagaactctttacctagcaaaagtatctttaaaagacaaagtcaaaataaagacttttttggacttactaaagctgaaagcaagttacttcagcagactagcaccacaagaaatattaaaggaagcctttctggcaaaaagaatatgatgctagaagaaaaatctagatgttcaccagaaaaaaattttaaataccagaactcataagtatgtggttatacaaaaaataattttaaaaaatgttagaagacactttgctcaaagccaaaagaacaatgtatttgggatgttataacaggataggcataaaatgtatgacactaatgaaacaaagaccgtaacagaaaaagatagaagtactgctataatgttctcacatcacacgtgagtggcaaaaattattgaggatggaccttaataagttaaagatgcttagtatatctaaagtaaactcgtaaaacaaaaagtatagctaatacatcaactaaggagataaaaatgaaatgataaataattaatccaaaaggaggcaaaggaaacaaagagaaaattagttgaatatgaaaacaaatagcaatttggtatatttgaaccaattcatagtcacattaaaataatcacattaaatataaatggtcaaaacaccccaactgaaagacagactgtgaaactgaacacagaagcaaggtccaactatatgccatctagaagaaacctaccttaattataaaaacacaaataggttgaaagtaaaaggttataccatactgtactaacctatactatactaacactaattaaaagaaaattggagtgactatattaaaacagacaaagtagatttcacagcaaacagataaatattttagagatacagagggtcatttaagatgacataggaataaattcttcaatatttatggttctaaacactcatgaatccactatcagagcatcaatatacatgaagcaaaactgatagattgtaagaaaggaatagaaatattcacatttagactcagggatttcagcacccctctctcaataactgataggagaaatggatatagaaacagtaagcatatagacttgaacaatgctatcaaccaacttgatataattaaaattttcagagcatgctgctcaacaacagcagacagagttcttttcaagtgcacagggaacatttatcaagatagatcatattttgaaccataaaacaatctgaataaatttaaaaacattcaagtcttccaacatgttatctgaccatagtgggtttaataagacaactataacataaatatatctgaaaattttttgaataactggaaattatataaaaatttataaataaccatgggtcaaagaagaaatccaaagggaaattaaacagtattttgaactgaatgacaattaagaaaacaataacattaaatttgggaggatgtagctgaggcagtgcttagacggaaatttatggcattaaatgcctatattaaaaaagaagaaaattggccgggtgcggtggctcacgcctgtaatcccagcactttgggaggccgaggcaggcggatcacgaggtcaggagatcgagaccatcctaacacggtgaaaccctgtctctactaaaaatacaaaaaattaaccgggcgtggtggcgggtgcctgtagtcccagctacttgggaggctgaggcaggagaatggcatgaacccaggagtcagaacttgcaatgagccaagatcacaccactgcactccagcctgggcgacggagcgagactccatctcaaaaaaaaaaaaaaaaaaagaagaagaaaatcgatgacctcagtttcatccttaagaaactagaagaagaacatgttagaccaaaaatcaaagacagaagatccaaacaaataaaatcataaatgaaaaaggagacatcataatggataccacagaaatacaaaacatcatcattagaggctaccatgaacaagtatatgtcaataagtttgaaagcctagggaaaatggataaatatttggatacatacaaccttccaagattgaaacaagaagaaacaggaaatctaaacagaccaataatgagtaacaacatcgaattagtaataaaaagtctccccaataaaggaaagtccaggaccagaaggcttcaccgctgaattctaccaaacatttaaagaagaattaataccagtccttctcaaactttttcaaaaacttgaagcagaggagattcttcctaactcattacacaagaccagcatagccatgatatcaaaaccaaacaagaacaaaacaaaaaagaaaactacagaccaatatttctgatgaacacaaatgtaaaaatcctcaacaaaatactagcaaaccaaatacaacacatttatcccaagaatgccaggatgagtcaacatatgcaaaacaataaacaccatacatcacatcaatagaatgaaggacaaaaaccatttggtcatgtcgatagatgcagaaaaagcatttgataaaattcagcatctcttcatgataaaccaaaagtcaaagaagaaaagaaagatgagagaagaaatcaacaaaatagaaaacataaaacaatagaggaaattaatgaaaccaaaaatggattcttttagaagatcaataaaaattgataaaccttgaaccagactgaatattttaaaaagagagggcacaaattatcaatatcagtgatggtagaagggacactgctatgaatcccacagacattcaaagaatggtaaggaaatattacaaataactttatgccaataaatgtaatttttccacatactgtttgacagaattcttgatataggattgctgcttcaatgattaaattagtttctgccattcccatattaggttcaagttggaagtagttaattatgtatataaatgaagtggtgaattgtacttgccctctaatctacattttcaaaaagtatcttaaaacatcaatctcatagggtattgataactcctatagcagttttgatctatctttgggccataccaattaccccttacattattaatggtctttttatacacctctttctttcacagctccttctatatgtcatgcactgttgagaaaagtaataaaaagttctacgttctatgattctttcacctactccctaaggtgtagtgttgacacaacagctgtattcaaacaggtacattcagagttcaattgagatgaatagaaaaataaaatgttctccttataccttgctgtcattctctaaatggcgtaaaatttttctaaaaggcatcattagctaatgataaaaactgaaaatcccttatgtaaaattttagaaatgatatagtggtggttgtacaatactgtgaatgtacctaatgtcaatctactatacacttaaaaatggttgaaatggtaaattttgtgctatctataacttacatacatagtatatttatattttaatacaataaaaatagttttaaaaagtcaaaaaacaaaaacaaaaacctggaaatcacattcacaatctataaacttcagttttcttacctagaaaatggaaaataaagtctctggacttcacaaaaaacatcagtttttattaaaaatgtacacgttgattgttttaaggtacttcttaaaaatatagattaaagagcaagtataattcaatataagaggtttcattatagcagttatgaatacaattttgttggtaatatagatacagagtcaattctgctctgtcaattaaaagagctttaccgtgtgaacacagaatacccagctagccgtggcataaactaataggagcttttagtctcacataacaggaagctggagggggcagctgcagctttggttcagcactaaaccatgttaaggccagagtatctaccagccacccgcctgcccctcataatcactagacagttatgaggccacatccaagacacacagccgggaaatgtgcagtgctggtgcatgtgcctttttcacaaggaatgcaaaagcttgcctagaaaccctgagctccaccctctgcagatctcagcttatctcccattgaccagaattgtgtcccgtgggtacccctagcctcaagacagtctgagaaagcaggcaacccctgtcgtggaaagcagaaaaagaaaagggtttgaaagtgactgttggattagatgacaggaagtgaatcccagaacagcttactttctctgcgcttgggagtggatctcactgctctcaccagaaccctgtcctcccattccaggagaatggtggagagagcctggaagtgggcatctaaagattggctccaccacggaactgtcatctgcagctgtgtgtggctttgaggcagctataatttattccctgggatctcaatttcctcatccctatattagcaataatggtgcctactttataaaatacaggataaaatgaaaggatcaatgctcaatttaattgataaagtgttaactcattatcatgctaattattttctaacattgcagaaacaagtgttaaggtgacatcattggataccataagaagctgataggtccatctgcttccacaaagctagttggagaatttctgacatcctagatagagctcccaagggctcttaagactattttccttttgaaacatcacataattccctaccactctggaagatatttggtttcctctgagtgaaccgtaaacctacctgcatccaacagcaaaattagtgaattccttttgaagaaaattgtgtatataaaaacaagcaatcttctctaaaacaacaccaccgtatcaggattacatatcatatcaggattacgataacagagaaagtataaacaaaaccgccgtatcaggatcactgtatcgtatcaggattacgataacaaagaaagtataacacttttgtgctcataaagccactttatcttcaacaaaaagtgcaaaaaacagagccatccaaaaatgttgcttaattcatttgaaattatgagaagcctttgtgtttttaaagtaacatggtatttcttatagaaaagttaactatttctcggattcatcttcttaaagtatatcatgtcctggacataaataatccctaaaaatagaattttaattccttgaaaaagcaaaagcactggttaaaacgtggttgttttagatctttaccttgtgaactgccttgacacattgtaaccagtgcgcacaagcactgtaaacccatgggattctcacattttatgagaaaagttaatacatctacttccttaacaatatgattcaggtgaccatttggggcagccttaggagtatgttgtgggctcagacaccatacagggcctggatcgttacgacttctccaaggcgctttgaaatcatcatggaagggctttggcatctctagaacaccaagaactgtgataaagagttgaaaaaaggaggaaacattcctgaggcgccggagtggcgtgaaggccctccagctctggggcccatcagcacccggaaaagtaccactggagtggcacttaggtaggatcccccagcaaacacaggtgccccgggagctcagtaacgtggtttggaaggggacagaggccccaaaggcctgaaagcccaaaaggagtactttgtggcctgcacaccaaggtttttcctaaggttcatcctgccacagaaattctttctcctccttctcctcccattcctcagccactggcgtgattaggactggctacaaagactgcctaatttggagcatttggggttcctttcgtccttgtgatccccaatgcattctgccagcccctttctaaaagaaatggcttctctggaggagggcatctacagccttaaaattaattccaaacgtagctcctataatttcatgaaccctcaatttgcagctggaagtgagggtcaaaatgaaactgaggaaccaaacaagttccagaacaggtagggtagacctaaagatagcgacgcttaattgacttatgtgagggttctccaggagatcctgggagatgacatgccaaaaggaaaggaagaggctgtcactagttcacaatcaagcctaggagagtgtctctactacggagaaggacgagccaggaatgccactatctttgctcctcaaaaagagaaagagtcagccccagagatgagcagctcctgtgacaagagggtgattgttaatcctcctaagaaattcagtaaggggcgacctaataaccaaagtagagtcatttatgaaaaaagctctccgcctttaaattttctgggtgattataacccccattcaataatccaaaagcgacttagcaaccaaagtagtcatttgtgaaaaaactctccacctttaaattttcccggaagactagagctcccattcaatgttccaaaagcacaaagacaagatggtgattgagcgcccctctttagggtgtgactgatctgatgtaggtggaaccacagtcgtattctctgaagagaagccattctcactgtgtcttcctggagtgtcagagcctctgtactacgccactgactataccacttttccacctcattatagtccttggcatgactacaccagctcttggttcagcaataccaagtcttcttggtatccctccttgggcagcagcagtaacacattccaggctgggaagagcagcttcagcagcagcagcagcaacaacaacatattccagaatgagaggagcagccaccagagcttcctgagtgattattccaccaattttccagtgagtgtccaaaacatgtccagagacctgaagatgacagaggaaggcagatccaagaattcctccttatttcactactccagaaatgtggaagcagatgcgaaggaggagggagtgtatcaagaggagacattacaacgtccttatggaggacatgcatctagctttctgccaagtaccctctggcagccaaagcaacagggtttcattgttgatacccactgtcacttggacttgctgtattccaggctgcctttcaaaggcacctttaccaaattcagaaaaatgtatagcaacaccttccccaaggaatttcagggttgcatttcttgcttcgacaatcctcaaaacctaagggacaggctgtgggagcatccgttgaaagatgatcagcctttggctgatagcctttgactgttgccctcattttgcccattattataatgactatcaagaaagaagtattttaaaagccttacaacaccccaagtctgtggcatttggagaaatgggcttggattactccaacatgtgcaccacacatgtcccagagcagcagaaggtatttaaaagatagctgcagctggccgtctctcttaaagaagcccatgatgatccactgccgagaagccgatgaagacctactgggcatcttgaaaaaatatgtgccctctgaccacaagatgtaccagcattgcttcactggcagttacccagtcatcgagcccctgttgagccactttcccaacctgtatgtgggcttcatggcaattctgacttactcttctgctgagcaagcccgagaaactgtgaaaaagatcccattagagagaattattgtagaaaccaatgctcccttcttcctccctcactaggtttccaaaagccgttgccagtatgcccacccaggcctggccctgcatacggtgcgagagattgccagaatcaaagatctgttgctttcccacaccttggccatcttgcaggagaacacctgtcacctctaccatctttaaacagaaaaggcacagtcaggagtcttcctaagaaaggagaccagtagcctgacaaaacacatgaactagatttgaactctatgtcccgggtcaaggatgtgtttgaagaattcgttggcatggagtaaaccaggacaggatattttcctcaaaaccttttcgtaagacttctgcttctggctggtagggtggggtacaatgggatgggaggaaggctaaggtaaactgcccttgatgttattaaggtttttcttcccagcaaaaatgccttaaggtagccagtaaagaagagagtttgatagaatacaaagagtttcccaatctaaatccctgtcctctgcagcctgcttttgatcacttggtgaataaagtcacccttctacttgtctttaaaaaaatgtagaattttaaaagtgaggtaggtgatttgtatattatattcgtatattataggaattctatttaaaaatttaaaaatcggtcgggcatggtggctcacacctgtaattccagcactttgggacgctgaggcaggtggatcacttgagcccaggaattcaagaccagcctgggcaacatagttaaaactcatctctatttaaaaaaaaaaaaaaaaatcagctgggtgtggtggcacacacctgtaattccagctacttgggaggctgaggtgggaggatcacttgaatccacgagtctcaggctacagtgaactgtatactcacaccactggactccagcctggcaacagagtgaaactcccatctcttaaaaaaaaaaaaaaaaaaaagttttttaacaaaaaataggccagatgtagtggctcacgcctgtaatcccagcactttggaaggccaaagcgggtggatcacttgagcccaggagtttgagaccagcctaggcaacatagtgagaccctgcctctaaaaaacattttttaaataaaaaatgtaagtatacactcaaaaagataagcgagatctacacaccgagttttcctttccaaaaaaaatttctatcaaaaaaaaatttttttaattttagatggaaaaccaacctactcctctctccctgcatttttgtgtggcaaatttaagtgttacactctgcggtgtttataacatgcaggagagaaccttgctgtaatttatctttttttcttcaggaaaaggaatgagcattgtagttctgagtgtagtattatcaagagtagcctaaatcaaaaagcacaatctggccaggcgcggtggctcagcctgtaatcccagacctttgggaggtggaggcgggcggatcacgaggtcaggagatggagaccatcttggctaacgcagtgaaactcttctctacaacaaaaaaaattagccggcgtggcagcaggcgcctgtagtcccagctcttccggaggctgaggcaggagaatggcgggaacccgggaggcggagcttccggcgagcccagatggcgccactgcactccagcctgggcggcggaactagactccgtctcaaaaagaaaaaaaaaaaggccgggttcggtggctgatgcctgtaatcccagcactttgggaggccgaggagggcggatcacgaggtcaggaaatcgagaccatcttggctaacacggtgaaaccccgtctctactaaaactaccaaaaattagggggcgtggtggcgggcacctgtagtcccacctacttgggaggctgaggcaggagaatggcatgaacccgggaggcggagcttgcagtgagccgagatcgtgccagtgcactccagcctgggcgacagagccagactctgtcacagaaaagaaaaaaaaaaaaaaacaaacctcaattttcatttatttattccattagtgaggtaaagaacagttcacctactcatgttactagtaaaatcttgcaatgcaaatgtgcaaaatttgggacactttgtaaatagttttctacttaagtgatagatattccatttaacctcaaagaattattatttagcatttatttttatggcatttggtgtgactaccctcccatcctggagacatcagagttgtgaaggtagccagtaatctagaaattcagtttactcttagtggtccctgggatattagtctggagtcacagagcctctcaaggcccattaacaggctcccccaaccttagcagtcctttcagggcatgtcaacatttcgcttcacttaaattttagaaaggcagctatttctacctttaaagctcaaaagaagcaaactgcccattttgtcttgggagacagaggaatttgctttttcagttggtttttattcatatctaacttcaaaattcatacctgcttattataaaagttttgagacaagtaaagcgaaaaaaatgtgatttttaaaaaacccaaacaaaataaaagcaacagaaggaaaaacgtacatggtaaaattgattttttttaaatcaatagtagagtcaaatattggcaaaatctggatatacaaaatttgactcaggaaaattgatcttggtagaaatgtgatcaacaaagaaaactcagactgtcaaaagccacaatggacagcattcatatagacaaaaattaatgaaccaaatgtttttagtaaattttattgtagaaaaaatctgttgaaaatatttcttaataggaaaatatggtaatagtttacctgcatggaaaaattgttcaaagaattaaagtagcttgcagtggggaaaaaagtaaaaatttttttgtttaggtataattctgtttgttttaaataatcaactcagactgcatgtgctttttcaaaactattgtttactgatacataaaattgtgctttgaaatttatttttctttctgttctctgatgtcgattttattgtgtattttctaatgtcttaagctaaatgcttagtttattttttatctggagagcaagaacaaagcagtcaataccacaaatgtgtctgtaattataactctgctgtatacatagatttttttattttgataaagtttactttacacattataaaaacacaaatgtattacaaaaatatggaaatagagagtagcaggaaaaagtatatggcatttctattacctagaaccccactgttgtaggtgtctttccttgacatagctgtgaccatatagctctgttaaattgcatatttgtctaaataattcatatttttttctatccctatcttgcgtttggagctcattttatgattgttattcttttatctttcaataaatactcaaaatgttaaaaaaatatgattcaggaatttttaattgtcttagccacaaatttataggatttccaggatctgtaacaatggataaataattttataaaaatcctaaatttacacagaattataaagatataatcattttaaacagcacctattttgcaaattttataaatctctttctaggactcatctctgcttctacaatcaacccagaatgtgactgtaaatgcgcgcaactcagaaggggaggtcacaggcaggttaaaagtcggtgagtccagcttcatcatggtgctttgcatgcatgttgtccatgaatagtgctaaatgaatgcattgttttttcttctaaagaaatcaaagctacttatgaacaaaatatgaattttctaaatatcatgctgtgttgaccacagactagcaccacagagtggggtggggggtgaggggacagcctgaagtgctttgattagagttatttttgttccaagaaatagaggacaattaaagctagtacaagaaacaaaatgtttattgtgggttaccaaagactcttgcagcaaccaaagggaaggaacccaagtagctggcctcaaagagcacagagaccagtggctgagagccacgaatacattcagttccctccccgttctttcttctcttttctctcctccccatgtgctccattctcctcctttccagtttatctttgccaccattttcacttggctgtatcacttctcactgtacagaacctatagggcctccctgattcttacctgctcggctgtagttatcaacatcaaacagtttagtcttcaattacgcaaattctaaatccacaaagtactctaattagcccaattcatctgtcccaccacattcctttgggtcagtcagctatgtacacccatccaatcaactaaggccagaggataaggtcacatgggagtgaggtcacatggaatcctgcaaagggagaaaaatgtcagcaagaagaaatatagatgaaagcaatatcagaagagcaaaccagctggtaagaaggaatgcaggccaggcatggtggctcacccctgtaatcccagcactttgggaggccaggatggaaggattgcttgaatctaggtgatcaagatcagcctgggcaacatctctaaaaaaataattttaaaaattagccaggtgtggtggtgcacgtctgtagtcgcagctactggggagtctgagacagggaggatcactcgagcctaggaattcaattctgtggtggaagagaccctttgtttgaaaaaaagagaataagaataacgaagatatatatattcactatactattaacattggatagatttgctaagtctaggaaactggatggcccttgtcattatcagaaaataaatgagaggtgtactgccaacacaaacttccaatgtctctctttttaatggtacttttacaaaacagaataatgttacatgggaaactacagccttatgttaatctgatgattcctttttcttatactaatacaagatgttctgtactttatcctctgctttataacttattcttgatcataacttgtatctctctttggcctggaagttttgtttaataactaagtccagtgaaattctctgtggatcaggagatgaactccagtttttcctgcatatacgttcttaagatgtatttaaaacaaattatattttcttgataaattatacagtattatcatttatctttaccatcatttcttgaaaatcttcaactgcctatagctttcaagtgtttgaggaatttttgcccattttttctcattcattccaacaaatatttgttgaatgactatgggctaccttatatgctatcaagtaataataataaagactatgtaattatttcttagaagctataaaagtagaagaatcttcttatattcctataaaaattaattagcggccgggcacggtggctcacgcctgtaatcccagcactttgggaggccgaggtgggtggatcatgaggtcaggagatcaagaccatcctggctaacacagtgaaaccacgtctctactaaaaatactaaaaattagccgggcgtggtggcggtcgcctgtagtctcagctacttgggcggctgaggcaggagaatggcgtgaacccgggaggcggagcttgcagtgagccaagatcgcatcactgcactccagcctgggcgacagagtgagactgtgtctcaaaaaaaacaaaacaaaacaaacaaacaaaaaagttaattagtacaagtacacattcctctgtttatctttttgttgggtgtggattttcgtatattatgcaagggaatttagatataatataaacctgcctctcatttcatagatgaaaaaactgaaggactaaaaagcagatttgctcaagagcacatagctagttagtagagaagtcaaaacaggaaagactgagggcttacttctctcagccagctgtttccactggccctcctctctaatcagatttcttgaaattatggcatgctagtaactgttctagttgcttcaaatatagtttccatttcatttttgtcaccaagaaattaccaggggttttaaaggttttgttttgtttagtttttctttttttaaaaaggctgggtcagtggctcactcccgtaatcccagcactttgggaggctgcagcaggaagactgcttaagcctaggagttcagggcttcagtgagctatgatcacgccattacactccagcttgggtgagaaagtcagaccatctctaaaaataaaaataaaataagttacacatcaaaatctctttggtttgaactgttcgcctcaatctctagttttaaccttggtgtctcatgcctgagaaagtgatttaattagtgatttctagtaaatctttagttggaaagtctctgttatattgagaaccttgagctaggaaatagcaccaagctcaccaaatccaaggttttcttccgtacatgacttcccacagttgcaacccttctagtctcatatttcctggaagaagttaaattttgccaatttgggtattaaaatgtaatttatgtgaactagccatattaatctcatttaattaagtgaataagtgttttctacaaaaccactgaaaacaatttgcattcaatacagtcaaaaccaaaaatcccaattaaattctgacatgatttggatgtgcgtcccctccaaatgtcatggtgaaatgtgattcccaatgtggaaggtggggcctaatggatggtattgtatcatgagggtggatccctctcaaacggcttgcaccatacccttggtgaagagtgggttatcactccattagttcacatgacatctggttgtttaaaagagtctgggacctctctcttctctcttgctcctactcttaccacgtgatgcacctgctccttctttgccttctggaatgataggaagcttcctgaggccctcactagaagcatacgctgaagccatgtttgtacagcctgcagaattgtgagccaattaaacctcttttctttataaattacccatcctcagttatttctttatagcagtgtaagaatcgagtaacacagaaaattggtactgaggagtgagccattgctataaagatacctgaaggtgtggaagcagctttggaactgggtaacaggcagaagttagaagagtttggagggctcagacaggaagatgacagaaagtttgggacttcttagagacttagtaagtggctgtgaccaaaatgctgttagaaatgtgggcagtgaagatcaggctgaggaggtctcagatggaaatgaggacgttattgggacctggaataaacatcacctgtgtaatgccctaggaaagagcttagctgcattgtgtccacaacctaggaacctatggaagtttgaatttaagagtgatgacttcgtgtactgcagaagaaatttctaagcagcaaagtattcaagaagcagtctggctgcttctaataacctacaatcagatataagagcaaaaaaaaaaactttaaaatttgaatttatatttaaaagggaagcagagtggaaaagtttggaaaatttgctgattggcactgtggtagagaaagaattcaagcaggctacagagcaatcacttactagagagctcagcatggctaaaagggagccaagtgctaatatccaagacaatgggggaaaggccctgaagacatttcagagatcttcgtgacagcccattccatcacgggcacagaggcctaagaggaaaccatggtttcagggacactgcttcccacatcacagctgctctagctccagctgtgcctcaaagggccccagatactactcaggccatcgctgtggaaggcgcaagccataagccttggtagcttccacatggtgttaagtctccaggcccgcagaatgcaagaggaagcttggcagcttgcacctaggtttcagaagacgtgtagaaaagcctggatgtccagtctgaaacatgctgcagggacacaggccccacaaagatactgtactagaacagggctgagaggaaatgtgggggtgaaagccccaaagtccctactggggcattgcctagtggagctatgggaagggagccactgccctccagaccccagaatcgtcgagctaccagaaacttgcatcttgagcctggaaaagccaccggcactcaactccaacccatgagagaagccactgggactgcaccctgtaaagccacaggagtggtgctggtcaccttgaggtgccatcttattgcccctttcctttgactgatttctcccttttggaatggcaacatttacccaatgcttctactaccatcatatcttggaagtaaataacttgtttgtattttataaactcaaagtggaaagagatgaatctcagatgagacttaggacgttggacttcatgctggaatgagttaagactttgggggacttttgggaagggatgattgtattttacaatgtgagaagaatgtgagatttgggggagcaagggaagagtgatatggtttgaatatttgtcccctacaagttgcatgttgaaacgtaacctccaatgtaggagttggggcctgatgggaggtgtttgggtcatacaggtagatccctcatgattggtttagtgccatccccttggtcatgagtaagttttcactcagttagttcacaaaagacctggttgtttaagagtcggggttttaagggtttttttccaagatggaagattagaggcattattagcatgcctttcctacttggaaagacataacagtttgtagagaattatgctgtgaacttgcttccaagaaacaacacaggaacttaatttaaaaagctgaaagaaagcacactttgaaagaagcagtgggcagcagcttacaccatgaaccaaatgggaagctccccacaggagacagtgaacctgctcacacacccagcatgtcactactacaaccaacatcttagaaagccatcacacagattctctataaccaaggaactcatacagactcttcaccactgaaagtacccatagccaaagctagttgacaataacctataaatattaaagtcatatcctcaaggtgcaaaaaagaattttaaaaatcccagcagaatcaaaaaataaatgcaaaattaattagaagaaatagttacccaaatgagaaggaaccagagaaataattctggccatatgaaaaaacagggttttataaaacttgcaaaagctcacattgagtctccagcagtggatctaaaccaatgaaatctttgaaataccagataaataattcaaagtgtttattattaagttactcaaggaaatacaagaaaaaagtgaaaactaacatgaaaaacttttttttatatactttaatttctagggtacatgtgcaaaacatgcaggtttgttacgtatgtatacatgtgccatgttgctttgctgcacccattaactcgtcatgtacattaggtatctcccctaatgctgtccctcccccattcccccaccccacgacaggccccagtgtgtgatgttccccttcctgtgtccaagggttctcattgttcaattcacacctatgagtgacaacatgcagtgtttggttttctgtccttgcaatagtttgctcagaatgatggtttccagcttcatccatgtctctacaaaggacatgaactcatccttttttatggctgcatagtattccatggtgtatatgtgccacattttcttaatccagtctatcattgatggacatttgggttagttccaagtctttgctattgtgaacagtgccacaataaacataggtgtgcatgtgtctttatagtagcatgacttacaatcttttgggtatatacccagtaatgggatcgctgggtcaaatggaatttctagttctagatccctgaggaatcgccacactctcttccacaatggttgaactagtttacactcccaccaacggtgtaaaagcattcctatttctccacatcctctccagtacctgttgtttcctgacttgttagtgatcgccattccaactggtgtgaaatggtatctctttgtggttttgatttgcatttctctgatgaccagtgatgatgagcattttttcatgtgtctgttagctgcaaaaatgtcttcttttgagaagtgtttgttcatatcctttgcccacgtttttgattcgcttcttataaatttgtttaagttctttgtagattctggatattagccctttatatactttaatttctagggtacacatgcaaaacatgcaagtttgttatgtatgtatacacgtgccatgttgctttgctgcacccattaactagtcatttacattaggtatctcccctaatgctatccctaccccattcccccaccccatggacaggggtgggcatttagtgctgtaaatcagatgagtagactgcaaaaattttctcccattctgtaggttgcctgttcactctgatggtagtttcttttgctgtgcagaagctcattagtttaattagatcccttttgtcaattttgactttggttgccattgcttttggtgttttagtcatgaagtccttgcccatgcctatgtcctgaatgttattgcctaggttttcttctagggtttttatggttttaggtctaacatttaagtctttaacccatcttgaattaattttcatataaagtgtaaggaagagatccagtttcagctttctacatatggctagccagttttcctagcaccatttattaaatagggaatcgtttccccattgcttgtttttgtcaggtttgtcaaagatcagatggttgtagataagcggcgttatttctgaggcctctgttctgttccattggtctatatatctgttttggtaccagtaccatgctgttttggttactgtagccttgtagtatagtttgaagtcaggtagggtggttcctccagctttgttctttttgcataggattgtcttggcaatgcaggctcttttttggtttgacatgaactttaaagtagttttttccaattctgtgaagaaagtcattggtagcttgatggggatggcattgaatctataaattatcttgagcagtatggccgttttcacgatattgattcttcctatccatgagcatggaatgttcttccatttgtttgtgtcctcttttatttcgttgagcagtggtttgtagttctccttgaagaggtccttcacatcccttgtaagttgtattcctaggtattttattctctttgtagcaattgtgaatgggaggtcactcatgatttggctctctgtttgtgtgttattggtgtatagggatgctcgtgattttggcacattgattttgtatcctgagacattgctgaagttgcttatcagcttaagaagattttggactgagacgatgaggttttctaaatatacaatcatgtcatctgcaaatagggacaatttgacctcctcttttcctcactgaataccctttatttcttcctcttgcctgattaccctggccagaacttccaacactatgttgaataggagtggtgagagagggcatccctgtcttttgccagttttcaaagggaatgcttccagtttttgcccattcagtatgatattggctgtgggtttgtcataaatagctcttattattttgagatacatcccatcaatatctagtttattgagagtttttagcatgaaggctgttgaattttgtcgaaggccttttctgcatctattgagataatcatgtggtttttgtctttggttctgtttatgtgatggattacgtttaatgatttgcatatgttgaaccaatcttgcatcccagggatgaaaccaactagatcttggtggctaagctttttgatgtgctgctggatttggtttgccagtattttattgaggatttttgcatcgatgttcatcagggatattggtctaaaattctgttttgttgtgtctctgccaggctttggtatcaggatgatgttggcctcataaaatgagttaggagaattccctctttatctattgattggaatagtttcagaaggaatggtaccagctcctctttgtacctctggtagaatttggctgtaaatccgtctgctcttggactttttttggttggtaggctattaattattgcctcaatttcagcgcctgttattggtctattcagggattcaacttcttcctggtttagtcttgggagggtgtatgtgtccaggaaatatccatttcttctagattttctggtttatttgcgtagaggtgtttatagtattctctgatgatagtttgtatttctgtgggatcggtggagatatcccctttatcattttttattgcgtctatttgattcttctctcttttcttctttattagtgttcctagcggtctatcaattttgttgatcttttcaaaaaaaccagctcctagattcattgattttttgaagggttttttatgtttctatctccctcagttctgctctgatcttagttatttcttgtcttctgctagcttttgaatttgtttgctcttgcttctctagttcttttaattgtgatgttagggtgttaattttagatctttcctgctttctcttgtgggcatttagtgctataaatttccctctacacactgctttaaatgcatcccagagattctggtacattgtgtctttgttctcattggtttcaaagaacatctttatttctgccttcatttcattatttacccagtagtcattcaggagcaggttgttcagtttccatgtagttgagcagttttgagtgagtttcttagtcctgagttctaatttgattgcactgtggtctgagagacagtttgttgtgatttctgttcttttacatttgctgaggagagctttacttcccagtatgtggtcaattttggaataagtgtgatgtggtgctgagaagaatgtatattctgttgatttggggtggagagttctgtagatgtctattaggtcaggttgctacagagctgagttcaagtcctggatatccttgttaaccttctgtctcattgatctgtctaatattgacagtggggtgttaaagtctcccattattattgtgtgggagtctaagtctctttatgtatctctaaggacttgctttatgaatctgggtgctcctgtattgggtgcatatatatttaggatagtcagctcttcttgttgaatttatccctttaccattatgtaatggccttctttgtctcttttgatctttgttggtctaaagtctattttatcagagactaggattgcaacccctgcttttattttgctttccatttgcttggtagatcttcctctatccctttattttgagcctgtgtatgtctctgcacatgagatgtgtctcctgaatacagcacactgatgggtcttgactctttatccaatttgccagtctgtgtcttttaattggggcatttagcccatttacatttaagattaatattgttatgtgtcaatttgatcctgtcattatgatgttagctggttattttgcccattagttgatgcagtttcttgctagcatcgatggtctttacaatttggcatgtttttgcagtggctggtactggtttttcctttccatgtttagtgcttccttcaggagctcttgtaaggcaggctttgtggtgacaaaatctctcagcatttgcttatctgtacaggattttatttctccttcgcttatgaagcttagtttgaaattctgggttgaaaattcttttctttaagaatgttgaatattggcccccacactcttctggcttgtagactttctgccaagagatctgctcttagtcttatgggattccctttgtggataacctgacctttctctctggctgccgttaacattttttccttcatttcaaccttggtgaatctgacaattatgtgtcttgggattgctcttctcaaggagtatctttgtggtgttctttgtatttcctgaatttgaatgttggcctcccttgctaggctggggaagttctgctggataatatcctgaagaaatttttccagcatgattccattctccccatcactttcaggtacaccaatcaaacgtagatttgatcttttcacgtagtcccatatttcttgctttgttcatttctttttattctgaaaaattttttttttaatttcagttatgagtaaaaaaaaatctctaaagagatagatcaaaaaacaaaaaccagtcagaacttttggaaatgaaagacacatttagggaactataaaatgcagtggaaagttttaaaaatagactagtccaaatagaagaaagaatttcagagctcgaagacaagtcttttgaattaactgaatcagacacaaataaagaaaaacaaatttaaagaaatgaacaaaatctctacaaaatatggaattatgtaaaacaaccaaactaacaatcttaggtgtcctgagagaaaagaaaaaacaaaatgtttggaaaatgtatttaagggaataatttaggaaaactttcctggctttgttagagatttagacatccaagtacaagaagttcaaataacttttgggagactcattgcaaaaaggacatcaccaaggcatatagtcatcaagctatctgaagtcaatgtgaaggaaaacattctaagtgcagtgagacaaaaggatcaggtaacctataaaggaaaacctatcagactaacagcaaatttcttagcagaaaccttacaagtcagaaaggattggggtactatctttagtatcattaaagagaacaactgtcagccaagaattttgtatccagacaaagtaagtttcataaatgaaggaaaaataaagtctttatcagacaagcaaatgctgatggaatttgtcagcactagactaaccctaaaagaaatgctgaaaggaattctaaatgttgaacaaaaggtcaatacacaccagaatagaaactcctgaaagcacaaaattcacaggggttataaaacaataacacaatgaaggaaaaacagtcactaggtaacaatcaacatgataactcgaacagtacctcacatctcaatattcacattgaatgtaagtggtctaaatgctccacttaaaagatacagattagcaaaatggattaaaaaatcacaaaccaaatatctgctgttttcagcagacaacatggaaggattctcatagactcaaggttaaggggtcgaaaacaatatttcatgcaaatggaaaccacaagtgagaatgagtagctattcttacatcaaataaaacagacttgaaagcaacaatgtaaaaacaaaaccaaaaaatgtagttatataatgatgagaggatcagtacaccaagaagctataacaatcctcaatatatacgtacttaagtccagagctcttagatagataataaaaaattactactatacctaagaaaagagatagacagcaaaacaataacagtggaggacttcaatactccactgacggcattagacaaatcattgaggcagaaagtcaacaaagaaaactggacttaaactgtactctagaacaaatacacaaaatatatttaaataacattatactcaacaagtgcagaatatccattcttcccatcagcacatgaaacattctccatggtagatcatatgataggccacaaaccaagtctcaataaattttttaagagcaaaataatatcaagtatcttctcagaccacagcaaaataaaactggagataaattccaaaagaaaccctcaaaattatacaaatgtatggaaattacagaatctgctcctgaatgattttggggttaacaatgacattaaaatggaaatttaaaaatgtttcaaagtgaataagagtgagtcaacttatcagaacctctgggatatagcaaaagcagtactaagaggaaagtttatagcccaaattcctacatcaaagtttgaaatatcacaaattgcaaacctgacatcacacctcaaggaactagagaaacaagaataaaccaaacccaaagctaccataggaaaagaaataacaaagatcagagcagaaacaaaaaaaaaatacaaaagatcaatgaaacaaaatctgactttttgaaaatattttttaaaatcattagctatattaatcaagaaaagaagagagaagattcaaataagctcgattagaaatgaaaatggagacagtgcaactgacatcacagaaatactaaggatcatttgagtttcctgtagacacttctgtgcacacaaactagaaaatctagaggaagtggataaattcctggaaacaaacaactcctttagtttgaatcagaaagaaatagaattcctgaacagaccaataacaagcaatgagattgaatcagtaatagaaaaaactgctgaaaacaacaaaaaagctcagggctagacagattcacatctgaattcaaaagactgaggagaaagaaatcctccctaactcattatacgaacccagtattaccctgatatcaaagccaggaaagaaaatattagtaaatgaaaactacagactaatatccccaaagaatatagatgcaaaaatcctcaacaaaatactagctgactgaatccaacagcactccaagaaaatcattcaccatgagcaagttggtttcattctagggatggttcaacatatgcgagtcaagaaatttgattcgtcacctaaacagaattaaaaacaaaaaccatatgatcatctcagtagatgcagaaaaagcattaaacaaaatctagcattcttttctgataaaaaccctcaaccaactaggcatagaagaaatatatctcaaaataatagaagccatatatgacaaactcatggccaacattatactggaaggaaaaaagttgaaagcattccccctaagaactattacagaacaagacgaggatgcccattttcaccacttgtattcaacatcgtactgaaagtgctagccagagtaatcattgcaagataaaaaaacaaagggcatccaaattggaaaagaaatcaaagtatctctgtttgccaatgatgcgatcttatagctagaaaaccctacacactcctccagaagactcctagatttgatgaatgaattcagtaaagtctcaggttacaaaaataaatgtacacaaattagtagcactgctatacaccaacagcaaccaagccgagaatccaatcaagaagtcaattcattttacaatggttacaaaaaaaaaataccgagaaatatacttaaccaaggagatgaaagatctctgcaaggataactacaaaacattgctgaaagaaatcatagatgatgcaagcaaattgaaatacatctcatattcatgtattagaagaatcaatattgcaaaatgaccatactgaccaaagcagtctacaaattcaatgcaatttctattaaaataccagcatcattcttacagaattaggaaatataatcctaaaattcatacggaaccaaaaaagtgcctgaatagccaaatacatcctaagcaaaaagaataaatctaaaaatatcacattaccggacttcaaattatactacaaggctgtagtaacccaaacagcatggtagtggtataaaagtagatacatagatcaatggatcagaatagagaacccagaaataaagtgaagtacttacaactaattgatctttgacaaaccatacaaaaacataaactggggaaaacacatcctattcaataaatggtgctgggaaaattggattgcctaggtcgtgtagaagaatgaaactggatttctactctcaccatatacaaaaattagctctagatgggtttaagacttaaatctaagacttgaaatcataaaaattctagaagaaaatctatagaaaactcttctggacaatgatttaggtgactaaaacctcaatagtaaatgcaacaaaagcaaaaataaatggaacctaattaaactaaaaaacttctgcacagcaaaataaatactcatcagagtaaacagacagcctatagaatgggagaaaatatgtactaattatgcatctgacaaaggactaatatctaacttgggaaaaaagatttttaaaaaagttaatatctggaatctacgaggaaataaaacagatcagcaagaaaaaaaaaatgaataatatcattaaaaagtaggcaaaggggccgggcacagtggctcatgcctgtaatcccagcactttgggaatccgaagcaggaggatcacgaggtcaaaacatcaagaccatcctggccaacatggtgaaaccctgtttctactaaaaatacaaaagttagctgggtgcagttgcacgcacctgtagtcccagctactcaggaggctgaggcaggagaattcgcttgaacctgggaggtggaggttgcagtgagccaagattgtgccactgcactccagcctggagacagagtgagactccgtctcaaaaaaaataaataaataaaataagtaggcaaaagacattaatagacatttctcaaaagaagatacaaaaatagccaacaaatatgaaaatacactccataccactagtcatcagggaaatgcaaattaagaccacaatgagataccaccttatgccagccggaatggccattatgaaaaagtcaaaaaacaatagatgttgatacgaatgtggtgaaaaaggaatgcttagacactgctgatgggaatgtaaaattagtagaacctctatggaaaacagtatggagatttctcaaagaactaaaagtagatttaacctagcaatcccactgctgggtatctacccaaaggaaaagaagtcattatatcaaaaagacacctgcacacacatgtttatcacagcacaattcaaaatcacaaagatataaaatcaacctaaatgcccatcaaacaatgtgtggataaagaatatgtgatatacctgaggtcaggagttcgagaccagcctggacaacatgttgaaaccccatctctaccaaaaatacaaaaattaggtatggtggcaggcgcctgtaatcccagctactcaagaggctgaggcaggagaattgcttgaacctgggaggtggaggttgcagtgagccgagatcacgccactgcactccagcctgggcaacagagcaagactctgtctcaaaaaaaaaaaaagtgctatatcacatatatatatatgatatatgtaattgtggtgtgtggatatatacaccatggaaatatattcagccatgaaaaagagtgatataatgtcttttgcagtgacttggatggaattggaggccattattttatgtgaagtaacactcaggaatcaaaaatcgaatgccacatgttctcacttataagtgggaattaagctatgggtatgcgaaggcatacagagtggtaaaatgagcgttggaggctcagaagaggggaaagtggagggtgagaagtgggtgagagatgaaaaactacctattgggtactatgtacactacttgggtgatgagtgcactaaaatcctagacatcacaactatacacacataaccaaaaaccatttgtacacctaaagctattgaaataaaagaatagtaaataaataaatttaaattctctcttctctcttctctctctcttgcttctgttcttgccataagatatacctgctccctcttttccttacaccatgattggaagcttcctgaggccgtcaccagaagtagatgctggcatcatgcttgtacaccctgcagaaccatgagccagttaaataccttttctttgtaaattacccagcctcaggaatttctttgtagcaatgcaataatgaactaacacaaattccaaagaaagtcaaacattgaaaagcaagcactagtaactagcatttcaaatctgtgaaataaaagataccaaattataaacaacagtggaatcttaccactgataaatacagctctggttactgttgttcactttctttctatttccaataagaaaaatcaattttgttaaacttaaatatgagacacacccagaaagatgcaagttgtgcccacacaagttgatgaagtttggcagttgggttttctgagacccactgagccaggctgcagctaatttgtcccaactgcctagcagcctgatgcacgaacagaatctgatccaccaggaccactggcctctactctgaggagtgtctacaggagcatggtcactacagacctgatgtggagattgacaaattacaacgaaatcaacccctgggggagctggtgatgtttgtagcacacattggtcactgccacccagataatccaagtcacttttttcaattgctgaacgatctgctgtgctacagccacaccgtcttggatccagaacttcaatgacattttgcaaatctttgatcttcctttgaaataagaatcacagcattcaaagagttgcagttacaagcttctcagaaggcttgtacactcagagtgtggctgatatcaagaatataaatgtaaaatacaagaacaataaagtgaatataggatttcagaattccacgcacacctaagagacagcaatgccatcacagctaaaatatccttgtgtgtaatgattgaactcaatggaagaaacatttggaatgctgcccaaactgtcagtgttatcttaagtgtgtgtttcactaaagtcaccaagatacaggctgctgctttgaaattcttctaaggaaacggggtggcaactcaggatctgagtatgaaggaccttccagcgtagatgccacagggaggagaagcttcaaacgcaaggctggaacaggctttggaagtgctgatactagaagaagaagaagaaataaaagaacagtagcagagatatttaaatttccagccattacttgattaatgatcctcaaagttctgcagaaaaatgactaaagcagctggagagctgtaaggagaggtatgaagtgaggctgatgcccaggaacctaatctccagattggtggaaatttatgggctttttctcttttgtgttgatcctctcgtgcggagatttctgcagcctaatcgaagagaagtaatcagatccttctgtctgctccacaagtaggtggccaacaattctgtaagggagaggagccctggggtgtcatgacagtaggaatcaatgctataaaaaaagtaacaacttgataccctcacattgtgactaaagaaccccccagttttggcccagtgaggaatacacaaacataaagatgtgatcatttctgctaggattttgattctgttcttctgagtgccaaattctcagatactacagaagagattctgagacaagcctacagaggcctcaaaagaagcaagagtgcaagaatatggataactaaatgctacagattacatttcaggagggggaattctgaagtcaagaaagagaatgttgtgaacagtaaagaagggtggggaagtaccagtcctgaggaggagggagatgcccatggtgggtgggttgacgtgtgtcactcttctgtgaaaaacagcagggactttccaaggaggtgcccagcatgcctgtggaggaggagggagccaaatctgctgccctcagcaccagttgccttctaagccaggaagacttccagaaaatctacatggcccaactgtataatgaacccagggctgccctgggaaagccacaaactgaaagatactgaaataaacagcattgatgggccaagagacaagttactgtcagttgaggatattgaacgctttaaaaaaaaaaaaaacactcatcttcaggaagactagccgctgcagtggctggaaagactgactgaaaagaatatgttagaaagaaaaccaatatgagtgcagtttccagtgccccaaataaagagaagaaaactaactttatatgataatgtattatagccagaatgtccagtcaaaaaatagatgttccttcagaaaaaaagcaactggcaccatgagatgtacttttggaaaaaagggaaatagaataaattatcttccaaaccagtttttcattccaaggataatgctgaatttgtgtaattgctctgaatattagtcaatagtcaatccaaaaatatttgcttatgtttaaaagtacagagataagatatttttgaaaaccacagtttgtaaaaagataaagggaattttatttgaaggacaggataacacagtggctattttggagggtgtgtgctgcagtggggtgcatgcatcgttactattggttgcagactcagatctgaacaaaaagatatagtcaagaaagtgtgacttcttcatcccgtctgcctcagtccccagccccttcctacctcttgctcacccacaccctctcagtagccagtcttttccattttaggtttatccatcctccatttcatttgcaaaaaatgaccacatatatgttttcttaggctcccatcatacttacatgaggatagcatacggtaggtagtcttttgaactttactttttcactgaatagtatggccctcaaaattactccatattaattcataaacatcttccttattatttttcacagctgcatagtaccctattatgtggagttgccgtgattattcagctattcacccatatatatgaacatttaagttgttctcactgttgtgcagttatgtcacaaagagtaacaattgcatatgtattttgtttttttttttggtttgcttttttttgttttttttgttttttttgtttttttttgaggcggagtctccctctgtcgcccaggctggagtgcagtggcgcagtcttagctcactgcaagctccgcctcccaggttcacgccattctcctgcctcagcctcccgagtagctgggactacaggcgcccgccaccatgccgggctaattttatgtatttttagtagagacggggtttcaccgtgttagccaggatggtctccatctcttgacctcgtgatccacccgcctcggcctcccaaagtgctgggattacaggcgtgagccacgtgcccggctgtattttgttttcttggaggtatatcctcagggtagattcctagaagtgggattgtggatatgtacatacttagttttgttcagttttatcaaattgtgctctagaagatggtaacaatttagattcccagcggcggtgtaggagagtatattttctgacagcctcagacaacacaatgtgtctaaattatttccagtctcacaggtgagaaatggcatgtcagtgttgctttaatttgcatttctgtaatgatgagtgtgtttgaacatttttttcataagtttgagggccatttttgtatctttgttgtgaattatctcatgactctttttccatttttctatcagaattgtcattttttattcctcagtagttaagaattctttaccaattaggcattttaactttctgcccagggtatatgttgctaagatttttctatccaatttttaagttgtcgtctaacttaatcaggtattttaaatcatgtaacacttttatttttacttgttattgttatgtattcaaacatagaatctttttttcattgcctctagatgttgagtcattgcttgaaagacttccttgtaccaaggttataaaggaattcacctatgttttcctgtagtgtttgtatgatttcactttttaacacttagttccctaatttatgtgaagtttattcttgtgtggtatgagatatgaatctaaatttatcttttctaagttgttatctgaacatcatttacttaaaagtccatccttaggccaggtgcagcggctcacacctgtaatcccagcactttcagaggctgaggcaggtagatcacctgaggtcaggagttcaagaccatatggagaaaccccgtctctattaaaaatacaaaaattagccaggcgtggtggcacgcgcccgtaatcccagctatttgggaggctgaggcaggagaattgcttgaacctgagaggcagaggttgcagtgagccgagatcacgccactacactccaacctgtgtgatagagtgagactctgtctccaaaaaagaaaaaaaagtccatctttaaacttgaaatgccgtcattatcatatactagatttccatgtctatcagagtctaattattactttatcccactagtccagtggtgtccagtcttttgccttccctgggccacactggaagaagaataattgtcttaggccccatataaaatacactaatgatagctgatgagctaaaaaaaaaattgcaaattaatctcataatgcttaaagacagtttacaaatttatgttgagctgaattcaaagctgtcctgggctgcatgcagccggcgggctacaggttggacaagcttgcactagtctgttcgtgtttccatgcctagataccacattcttttaattatagagacttcatggtatgttttaatgtctagtggggctggcctttcttgtgttttctttttccaagctattcttgtatgtttgtttttacatatgaacttttgcatcaatttgctcattctataacatagtttattggcattattactgtattgcattgaatttataaattaactctggaagaaatgacatcctataatgttgggtcaccctatccaagaatgcggaatgtcttttcatttattcaagtgtctttcagaagtattacaaatttttcctcatatatttttcacacacatcttattaaatgaatttctaaatttttaatcatctttgttgttattgtaaatggcactttctccactattatttattttaacttttgtttgtatgtattcaagttattggttattgtatgttaattttatatcctgccagtttgctgaattttttattagttgagttacttttatcagagactttggggtttgtcagatacactattatatcatctgcaaatatacaatgttactttactcaatcacacacctctaactgattttactttataaataagtttcattgactaaaacctctgctccacaatgttgagtagcagtggacaaagtggatatccttgccttgtttccaatcttagtggaaatgcttctagtctttctgtattaagtaaaatacttgccttagggttaaaatacatcattttaccatgttaagacagcatccctcaatgcctattttctagaatgttcattgatcataaatgtgtgctgaattttgccaaatactttttcagcatctatgaagataatatgatttatttttattagattaattagtatgatgttaatcattcctcacttaaagtcaatcttgcattcctggaataaatctcactttatcaaggtatattattttcttaatgtggtgttgcgctgtgcttctttctggtacttctatttagaattttttgcattcatgagtaatactagcttatagtatttttttccttatgcttgcttttctcatttaagtatcagtgctaagcttacttactttcaatactctggaataatttacagagcattgtgactatccagcttttgaaagtttgttagaattcgcttgtgacaccatctgtgcttggttcttttatgtggggtagttttttaacttccccatttcttgtataaacacaggtctgatcaaactttctcatttaatgagatcaattttagcaatcactatttccctgtggaactgcctgtttcatcatggttttcaagcttatttgcagagttctgcatagttgtctctccttttttatttcttctaattcaatggttacttttcacttgtcattccatgtgttgtgtatttgtgttttctcatttttatcaacttagctagtgttttatttattttgctaattttctcaaaaaacagaattttgatttattagatctcttttatactgttttcttccttgttaatttctgcttctatctttattatttccttccttgtgctttcttttgactcactttgttgttctatttctaggcttttgaattacgaacttagttcttttttttttttttctaaacagaattttcgctgtgttgcccaggcttcagtacaatggcacggtctcagctcactgcaacctccgcctcctgggttcaagcaattctcctgcctcagcctcccagatagctgggattacaggcatgtaccatcatgcccagctaatttttgtatttttagtagagatagggtttcaccacgttggccagtctggtctcaaactcctgacctcaggtgatctgcccacctcagcctcccaaagcgctgggattacagatgtgagctaccacgcccagccagttgatatttttattgacagagatgtttagtacaatgaaatttcctcttgtcactgctttacatgcatgccacagattctaaaatatagtgttttcaagtcataattttccttaattctgtaatttctgtttgtatttcacccaaaagttatttaaagagagacttttaaatttctgggtgaatgggtctttttgctttttatttgtgtcagcaaattctagatttattgtattgtgtttagggagtattatgtgtggtctttctacgttatgaaagtcattgatgtttgtttaccttgtgccctgatgtgtgatcagtttcagtgaatgtgccccgggcacttgaggagagtgtgcatcctccattatcaggacttcaccgtcagtatatgtcataagacttgccttgttgagttctttttaggtcatctcctcacttgttattccacttgacctgtcttgtactgaaagttgtgtattaaatctagcattattagtgtgttctgtgggtcctcacatcttttatttttgtttcataaaggtggtgtctgtgatatttgcgggataggtatttgtaaatattatgtctgtgttgtgggttgtaattttagcattaaaaatcttttttgtcatatttaacgcttttgacttgaattccactttgtctgatatcaggatttttatcccagctcatttagtattcatttcctgcattacttttgtccattccttaagtggcttctcactaagtctcctcatctgtcctctccgtggccttcactcaccataattcctgtgatggagcaggtgtgtgagaagttgtagtcctggcacttgttaatttttctccctcaactcacagttctgcctttaagtaatgcaagggtgtgtttttctttctttctttctctttttttttttttttttttttttttgagatggggtcttgctctgtctcccaggctggagtgcagtggtgcgatcttggctcgctgcaagctccaccccccaggtgcaagctccaccccccaggttgacgccattctcctgcctcagcctcctgagtagctgagactacaggagcccaccaccatgctcggctaattttttgtatttttagtagagacggggtttcaccgtgttagccaggatggtctcgatctcctgacctcgtgatccaccggcctcggccttccaaagtgctgggattatgggcgtgagccactgtgcccggtctgtgtggaatttttatggctgtgaaactattccttagagtatggggatgaccttttgggaaactgattactatatagccagcgtggtcatcagccacccagaagtccatccttttccaatttaataatgctatgaaattttaaaaattcatagcattattttaatggctatgtaatatttcaaggaatacatgtataataatttgattcactaattgaaattagattttttcagttcagttaatgccacaattcataattcaggctacccttttatatttaataggttatacaataaatttttgttaaataaatgaagagaggaatgaataaaagattgtgtaggatgggatgggctgagaaaccagttggcaggtaggatagtgttctaatggatggaatatatatatatatatatatatagaaatgaggacgttgtttaacctttacaatgattgattattacagtcagggtttccagatggcagaagattggttaaaagtgatcatctggctgggtgcagtggctcatgcctgtaatcccagcactttgggaggcagaggtgggcggatcacttgaggccaggagttcaagactagcctgggcaacatggcaaaactccatctctactaaaaatacaaaagtcagccgggtgcctatagtctcagctattcaggaagctgaggcaggagaatcgcttgaacccgggaggcggaggttgcagtgagctgagatcatgccactgcactccagcctgggcgacagagcgagaccctgtctttaaaaaaaaaaaaaaagtgatcatcttacagcatttttggaaggctgtgtaagttttgcatatgattatcagggacatttactagaaataacctaagtttcactggcatagcataactagctttgtctgctcaggaaattctcaagcctggtctcttattttatttcattttattttatttaacacaagtaaaggtcattagtgccaggcttatgaagtagaactgtataatacaagattttgccacaaaagtagtagagctaacaagcacagctttgtgcttccagcccagtcctttctctgtgataccacatttgcaacagcagaatatacgtttccttttttttaaaggactttgcaatatttgtttctaaatgattttattttaaattaaagatatcctgaggaacaaaagaagtttgctaatgagacacattgtatataaggaagaatttgatggtattttcaccagaaaaacccttaagctaatttcccaaacttaattaatcagatcacaaaaccattaactttttctctttgtaccaaagcctttcattaaaaatggtgctgtacagatagctcttttcttatcaacaaggtagaatttaaattttatttcttaaagacctctactgcaaaagacgattacatcctcagctctaatcaatgtccaactaggttaaaaaaaaaaccgctagaatattaataaaagttagaagattaattacaaactccataactattgaagaaagtgcagttgcctctgaagtggaaagcgtatttaaatttaaacatgcagggtctatttttaataaaatggaggtgggattttattcaccgctatgcctttgctcaagtagtttcctttacctggagatccctgttcttccttcatcagggaagcatgaacgctttcttttttagttttctttttttttttttttttttgagacagagtctcgctctgttgcccaagctggagtgcagtggcctgatctcagctcattgcaacctccacctcccgggttcaagcaattctcctgcctcagcctccccagtagctgggactacaggcgcacgccgccacacccagctaatttttatattttcagcagaaacggggtttcaccgtgttgcccaggttgtcgcgaactcctgatgagctcaggcaatctgcccgcctcggcttcccaaagtgctgggattacaggcgtaagccaccgcgcccagcaggaagcatgaactctttcttccaaatcagttgcaggcatcgcgtctccggacgctgctcttagcctcgatggatggaccatggattcctagtcaagactctctcatgcttgcatcccaatgcttagcaaattgtcctgaaaccaggcttacatgcttttctttttagtgaaccacagaattctttaagctgtgagctatatctcactcatttgcacattgtcaatgcttagcacagaaccttgtacataaaaagcatgcaatagatttgtattgaatggaaccattcactttcctgcattttctttgatttgaggaacagtttatgtggatttgctgctcagacttactatgaaaataaacttatttgttgactattttattgatataataactatagaaaaaaaattgtcacagttcaaccccttatacttaataaggcctcctagaattgtaagatgaacctctagtgagcaaaacagtgaactcttactggattaattattccaattatttctcaattttaaagtcagataacttgatagtcaccattaaatgcaaatcagtgtttatataataaatacataggcatatcagtgacccagaagagataaacaggaactctgagtctcagatggggaaaataacattacaaataccaaaaaataaagtgaagcttttaaaaaaaaaaaggagatgtaacatagagaaaaaagtcaactttataactggcactcttgccaaaaatatttatttatttaaatgaagactcactggagggttttaaatacaaattaataaaattaagaacacttggatgaccatgtccaaaacggatcaatgcattaatagaaaggctttacttaatgtctaccaggtatccaaaaatttttatgagaactgttagggtcagaggggacacacacaaaaaaaattataacatatgacttattttctcaacttccttttttttttttttttttggagaggtagtctcactctgtcgcccaggctggagtgcagtggcgtgatctcggctcactgcaagctccgcctcccaggttcatgccattctcccgcctcagcctcccgagtagttgggactacagatgcctgccagcacacccagctaattttttgtatttttagtagagactgggtttcaccgtgttagccaggatggtctcgatctcctgacctcatgatccgcctgcctcggcctcccaaagtgctgggattacaggcgtgagccaccgcgcccagcctaatttttgtatttttagtagagatggggtttctccatgttggccaggctggtgtcaaactcctggctctcaggtgattggctcgccttggcctggcaaactgctaggactactggtgtgagccactgtgcccagcctcaacttacttttacagataagaatataggccagacatggtggctcacacctgtcatcctagcactttgggaggccaaggctggcggatcacctgaggttaggagttcgagacaaacctggccaatatagtaaaaccccgtctctactaaaaatacaaaattagccgagcgtggtggcgcatgcctgtaatcccagctactctggaaggctgaggcaggggaatcacttgaacttgggaggcggacattgcagcaagcggagatcgcaccattgcactccagcctgggcgacatgagcgaaactctgtctcaaaaaaaaaaaaaaaaagaatataaagctaacataaacaaattggggaactcctaatttcttaagtagatgatgaaggctgtgctctaggaagattaatccatgaggcctgggttagaaagtgtggaagcatcaaagaggaattggggaacacataattatgagtgcctgaggtgcgtgtgtagctgagtgagtgggaggtgtgacctcaccctcacatgtctggatggcacagggtgagtgagcacccacaaaacacctgctgaatagatgaaagagctggaaggcaatgggtctagagctcaggtgaagggcataaccttggatacaaaagtgaaacagaaggcatggcaaagacaaaaatgtcttaggggaagggcaaaaacaggaaggtgttcttccacagtgatgcctgttttccccgtggggtaaggggtgagcagcccttctgagaataatggcagagaaaagtttcaggatatgatttatcttctaggttaactttgaccattaaagtgagccattcgtaagatggtctttcacaaatctcacatttcagaatgcaagattcttaggtggttaataaccaaaagaatacaagtttaaccatgaataggaaaactatattattttgggcaagtatttaaaatcttaaagaagaaactcttaaataatgtatttgtacatatattgatataggttaacatatgtttgacacaattaattttaataatacaatagatttagacttaaaagttgcaaagtttaatcacagaatcaatcaataccactaatggtaacaaataccaagtctttagatacttggtattgtagggttgacgtggcatgtgtaaaaatagagatttggacactgcttgtagtgaacagtttataataaactgttttaattcttcaggtcccaaaatggtagaagtccagaatcaacagtttcagatcaactccaacgacggcaagccactatttactgtagatgagaaggaagttgtggttggtacagataaacttcgagtaactggtatgtactaactcgagaaaaacacaacattccatggagtacacatctgcaaaaacacattgtactattgacaagtttatgtggaatctttcaagcagataagagagtttgaatgtgttgcattttctccattgcatttctgttgaactccctcgatgctctcctagaagaacaaaatcctccccacagatcttggcccacccttcttccatcacagttttaccctttgtcccttccttcctcccttccttcttttttttttctttttagacagagtctcgctctgttgcccaggctggagtgcagtagcacaatctcggctcactgcaacctttgcctcctgggttcaagcaattctcctgcctcagcctcccgagtagctgagactacaggcacccgccaccatgcctggctaatttttgtatttttcgtagaggcagggtttctccatgttggccaggctggtctcaaactcctgacctcaaatgattcacccaccttggcctcccaaagtgctgggattacaggtgtgagccacaacaccctgccaccctttgtctttttctaattggagtaacccacagactcatcaaatgtcactattatctgtgcagttcaagtacctgtttcccaagtttcttttattctcatcacatcatgtacttgaattactcatatttctacaaaaaaaagttctctttttgaactaaaagttgaataggggtctcatagcactcatttttaagactgagaagagaaaattttatgaaaaaaatgtttcagaacatattctaaattcacttgccaaagactagaagacacaggcagatacttgttaaatctatcccagtgcctttctgtactactgtgaaaaccaatagcaatgttattgtctcacacaatactaccaatactcccaaatgaaaaagaaataatatttcctggccaaggaagtagactccaccctattacaggccctaacaaactataaagatcataacctaatgttgcatactctaagacagtaatgtatctggttttgttactaaaatgaaggacactagcgcatttaattaacggaaattggtaattgtccaacaaagcaccttaagcatcagaaatgcactgttgtgtaggataaagaatatgggctgggtagacttggattccattcctacctctgcaattactagctgcgtaatttcaagcaagttaatttttattttctgtttcctaacttctaaaagtgagttgataatatcaactgtactatcattgctgggttaagtggattaaatgtgcaaaggacagcagagttcttggtagagtatcattgtactgcagggcagtgaaatctgcagggaaaatagtctaacagcttagttcacttcaaacccaagccctcctactcagagaatcaataagatgaacttttccttagcccagggctccttccgggccatgacatcaattagaggaacaggtgagaaaaattgataagcaactgtattatttattacctgtatgcatgcatcagagccatccggagggtttgtttaaaatatactgctgggggccaggcagagtggttcacacctgtaatcccagcactttgggaggctgaggtggatggatcgcttgagctcatgagtttaagaccagcctggacaacatggcgaaaccccatctctacaaaagaaaaagtacaaaaattatccaggcgtagtggtgcgtgcctgtggtcccagctacttgggaggctgaggtgggaggatcacctgagcctgggaggcagaggttgcagtgagcagagattgagccactgcactccagcctgggcaacagagtgagaccgtgtctcagtaataataataataataataataataataataataataataatagtgctgggcctcatccccagagcttctgattcagcaggtctgaaatgtgacttgagaatctgtgtttctagagagtccccagttgctgctgatgccacagctctggggaccacactttgagaaccactgctgtggactaacatgaatcagcaggagaaacaacaggtcagcaacatgttgacgctctctgtagaagagcagtccccaaccattttggcaccagggactggtttcatggaagaaaatgttttcacagtgtgggagatggttttgggatgaaactactccacctcagatcatcaggtattagattctcatcaggagcacgcaacctagatcccttacacatacagttcacagtagggttcgcactcctatgagaatctaatgcctctactgatctgataggaggcggggctcaggcagtaacgctcgctggcccactgctcacctcctgctgtgaggcccagttcctaacaggccacaggccagtatccgtctatggcccagggatccagagtccctgctctagaacatgctttcaagttatccttttaaaggacaagttataatcttctctttcataatttttttgcctgaggcacaattttctcccaaactcctcctctgaggtgcagctaactagagcaaaatataccccacctctaatgactatatgctttccttgttattttggtgttgcaaacatttctagttcttattgccagagacaccatgaactgtgagtgtacagacagtacaattttgagcagaccataactcttctcaattttccagtatgttaatggcttccttacattttgtgattaaagaaaccaagagattccacggttttgatggttcgcttcttgttttgtctctatccaaggtctgactctctaaacattgtgtagtgcaggctttgtcgatcttaacactgtttttttgttttaaacttttactttaagttcaggggtacaagtgcaggtttgttatataggtaacttgtgtcatgggggtttgttgtacagattatttcatcacccaggtattaacccaggttattagttatttttactgatcctctccctcctcccatcctccacccttcagtaagcctcagtgtgtgttgttctcctctatgtgtccacatgttctcatcgtttagctcccacttataggtaagagcatgcagtatttggttttctattactgtgctagtttgctaaggataatagtctccagctccatccatgtccctagaagggcatgcatgatcacattctttttaatgactgcatagtattccacattttctttatccagtctgttactgatgagcatttacggtgattctatgtctttgctattgaacctcagcattgttaacattttgggctggataatgtttttggtggaggttgggggagactgtcctgtgcattgcaggacatttagcggcattcttagccatttagtggcatccttagccagtagtcattcaggagcaggttgttcagtttccatgtagttgtgtgcttttgagtgagtttcttaatcctgagtcctaacttgattgcactgtggtctgagagatagtttgttatgatctccattcttttgcatttgctgagaagtgttttacttccaattatgtggtcaattttggaattagtgtgatgtggtgctgagaagaatgtacattctgttgacttggggtggagacttctgtagatgtctattaggtctgcttggtccagagctgagttcaagtcctgaatatccttgttaattttctgtctcattaatgtgtctaatattgacagtgggatgttaaagtctcctactattattgtgtgggagtctgagtctctttgtaggtctctaagaacttgctttatgagtctgggtgctcctgtattgggtgcatatatatttaggatagttagctcttcttgttgaattgattcctttaccattatgtaatgcccttctttgtctttttttatctttgttggtttaaagtctattttatcagagactaggaatgtaatccctgctttatcttttttccatttgcttggcagctcttcctccatccctttattttgagcctatgtgtgtttctgtacatgagatgtgtctcctgaacatagcccatcaatgggttttgactctatccagtttgccagtctgtgtcttttaattggggcatttagcccatttacatctaaggttaatactgttatgtgtgaatttgatcctgtcattatgatgctagctgatcattttacccattagttgatgcagtttcttcgtagtgtcaatggtctttacaatttggtatgcttttgcagtggctggtaccggtttttcctttccacatttagtgcttccttcaggagctcttgtaaggcaggcctggtggtgacaaaatctctcagcatttgcttatctgtacaggattttatttctcctttgcttatgaagcttagtttgaaattctgggttgaaaattcttttctttaagaatgttgaatgttggctcccactcttttctggattatagggtttctgcagagacatccactgttagtctgatgggcttccctttataggtaacccgacctttctctctggctgcccttaacatgttttcctttatttcaaccttggtgaatctgacaattatgtgtcttggggttgctcttcttgaggagtacctttgttgtgttctctctatttcctgaatttgaatgttggcctgtcttgctagtttggggaagttctcctggataatatcctgaagagtgttttccaacttggttccattttccccatcactttcaggtacaccaatcaaatgtaagtttggtcttttcacatagtcccatatttcttgatggctttgttcattccttttcattcttttttctctaatcttgtcttcatgctttatttgattaagttgatcttcaatctctgatatcctttcttctgattgatcaattcggctattgatacttgtgtatgcttcacaaagttctcatgctgtgttttcagctccatcaggtcatttatgttcttctctaaactggttattctagtagcaactcctctaaccttttttcaaggttcttagcttccttgcattgggttataacatgctcctttagctcagacaagcttgttattactcaccttccgaagcctacttctgttcaattcatcaaactcattctctgtccagttttgttcccttgctggcaaggagttgtgatcctttggaggagaagaggcattctggtttttggaattttcagcctttttatgctggtttttccttatcttcctggatttatctacctttgctctttgatgttggtgacctttggatggggtttcatgtagacgtcctttttgttgatgttgatgctattcctttctgtttgttagttttccttctaacagtcaggcccctctgctgcaggtctgctagagtttgctggacgtccactccagcccctgtttgcctggatatcaccagtggaggctgcagaacagcaaagactgctacttgttccttcctctggaagtttcgtcccagaggggaacctgccagatgccaggcggagctctcctgtatgaggtgtctgtcgacccctgctgggaggtgtctcccagtcaggaggcacaggggtcagggacccacttgaggaggcagtctgtaccttagaatagctcaagcgctgtgctgggagatccgctgctctcttcagagctggcaggcaggaacatttaagtctgctgaagctgcacccacagccgccccttcccccaggtgctgtcccagggagatgggagttttatctataactccctgactggggctactgcctttctttcagagatgccctgcccagagaggaggaatctagagaggctgtctggctacagcagctttgtcgaggctcggtggggatccacctaggtcaaccttctcagcggctttgtttgcactgtgaggggaaaactgctaactcaaacctcagtaatggtggacgcccctcccctcaccaagcccaagtgtcccaggtcaactttagactgctgtgttggcagcaagaatttcaagccaatggatcttagcttactaggctccatggggatgggatccgctaagctagaccaattggctccctggcttcagccccctttccaggagaatgaatggttctgtcttgctggcattccaggtgccactgtggtatgaaaaaaaactcctgcagctagctcagtgtctgtccaaatgaccacccagttttgtgcttgaaatccagggccctggtggtgtaggcacctgagggaatctcctggtctgcaggttgcgaagaccatgggaaaagcatagtgtctgggctgaatagcaccatccttcatggcacagtccttcacggcttcccttggctaggcgagggagttctccaaccccttgcacttcccaagtgaggcaacaccccaccctgctttggctcaccctccgtgggctgcacccactgtctaaccagtcccaatgagatgagccaggtacctcagttggaaatgcagaaatcacccatcttctgcattaatctcgctgggagctgcagaccggagctgttcctgtttggccatcttgccagacaccaccaaccaacaatgggtaactttttgagaattagactgagttccaatcccagctgttccattaagtaagcacatgacctcaaatgaatatttcacctctcagtgctttatactacaaagatctgtagccactggtctctcaccattacaggacagtatacagaattcaacaaagcagatgcaaattgatcgtgaaattaaattgcatgtcttgcaaaagatgtagggtttaggaagtcagaaatgatgagaaatactggaattgctggcaaagccactaacaaaagaccaggaaagttagacttgccagcaactaaagaagtgaaaatcagccatgatgatgacatgatagtcatttcaaagatcggtaaccttaacttcacaagattaatattcactcttgtgatgactgacaatgccctcaatttaactattacagttgttcctcattatcttcaggggatacgttcaaagagccccaggggatacctcaagctgcagatagtactaaaccctatatatgctgcactgtgttttttcttatacatacatactgtgataaagttcggtttataaatgagacccagtaagagattaacaacaatagctcataataaaataaagcaattataaaaatatactgtaataaaagttgtgtgaatgtcatctctctctctgtctcagaatatcttatttgactgtcctcacccttcttgtgatgatgtgagatgagaaaatgcctacatgataagatgacccgaggtgaatgatacaggattgtgtatagtgcttaacacttatgaattgtttatttctggaattttccatttaatattttaggacggtgggtaactgaaacctcagagagcaaaattgcagaaagtaaaactgtgataaggggggactattgaattatagctttatcgccaatggtaaacatttagtgaacaatgtcctattgtgccactagggtaggcagaattctaaggatgcccccactgagccctgtatatttccttctcctttcagtgtggatggaatctgtaaatatgagatgtctctcctgtgattatgtcacttatatggtaagaggaaggtaatctgggtagcccaatctatcccatgagccctttataaccagagaggttaatctggctggtagtagagggggaagtcagataaattggaaaagcaagaaaaattcactgctgtgttgctgaaggaagaaagagggaccatgtgacaagaagtggtggcctctagaaagggaaagaggcccttggctggcagcaggaaacaagaaatgagcctcagtcttgcaagcacaaagaactgaatgaattctgccaacacctgcatgacacagaaggtagagtctggccctgggcttccagacgagagccctgccttgctgacacctgtgagaccctgagcacagaacctggtcagacactctgggtaggacctgaaaccaacagagctgtgagctaacacatgaggatcgttttaagtagctaagtttgccataattcctaacagaaatagaagactaaatagagccatcctacaactccaactatgtttgaaaaagtgacaccaaaaaacttgacttattcttttttatttcatataatttcacagttttttgttaccattatgaccagggttttttgtttgtttgtttgtttgttttgttttgttttgagacagcgtcttgctctgtggccaggctgggtgtagtggcacgatctcagctcactgcaacctttgcctcctgggttcaagcaattcccctgcctcatcctcccgagtagctgagaatacaggctcatgtcaccacgcccagctaatttttgaattttcagaagagatggggtttcaccatgttagccaggatggtcttgatctcttgacctcgtgatctgcccgcctcagcctcctaaagtgctgggattacaggcgtgagccactgcgcccagccaataagaatgtttttataagctttaatgcttccacacaaattcccattaaaacttttctccactacctgtgataacagttgggtccctatttcaagtggattgactccaggtagcctttggagtttctcaggtcagcaaacgcaacagtagttgacagccaaggaaagagaagtgataggaaaagagacgggcagcctcactctgaggactggaaagaaaattcaattctttgcttcttttctccgcccttgtcacttgcacagcagcccatagctctggtgaaaggggaagataaggtggctctctccttaagatggtgcactcgaaactcctgactgcaccaagtcctaatcctgactcaaattgccattctttgagcaattaagacaattgctgttgctattatcttaattactcaaataagctaaaacctctctttaattcttaaacagcttccatttagattttagtcaactaggatactgaataatagtttttaagcgaaatttatggaagcgattaaacaatttcagcagttcagtctgaaaccaatttaggcctttaagcaggctcatcttcctcccccacaaaattagacaccaagtggccaaagttaacatttcttttattaactcaagttacagaacatactattggaataacatcaaaatgttgtcttcaaaaaactattctacaccattgccagaactgacttctggcagatgacaaattgttagtttggctgccctaagtgtattttagctccctggcaacaatttgctaggctcagtccatttcccaatattatctttaaaaacagagttctataatagtatccatttcccaccactaataagaaaaaataagatctagcaatagtcccaattccatttctttatgccttctgtgcagctaagcaagatcacataaagtcaaaagtgatagtgtagaaatgccagagtcacccataaagccagtgacaaaaatggacctggagaacaaagtgttcagcaactgaagaagtgaaaataaacaaggatgttaagtcgaaaaagacgtgaagacagatatctggaaggtgcttttaggagtaccatatccttcaaacacatacccaagggcacagaacactgtctgatgcagcactgcacgcagcgatcaacgccgtgctgcagtccatggtatttcagctgaaaggaacaagagtcccaattaaaacaggcttaaactggaaggacatgtattatctcacataggaaggctggggaaagggtaactccaggttgttgattaatttagtagccaagtaatattttacgctacctttcttctctgcaagtatgttgatatttcccttttgggttgcaaaatgattccatcaattgcaaacatcacttgcctctgcaaagacttctctaaacatctatctataagagggcctcagtgatttggcatcttaagttactctcccagctgaaatttttctcagattaaattatttgaatttcttttgtatgtggcgtttggctggatttattgtttataacataatttattttgagttttaatgtggaatttaaaactcacattcattgtgataagttctctatttgtcttatctgtgccatattatttcatgatttttattttttaatcttaccaggtttgaatctgaaaaaagcctggtataaagggagatagagtgggaccagattatgcagggatttgctggccattttaagaatttaggatttgttttagttcaatggggaggcattgaattgttttgaacagggtactccttgattcattatacatcttaagatcaatccaaccattacaaaggaggttggaggaaagaatggaggcagtaagaccagttaggaggatgtcaattgtagtacacgtaatcagcgaaggtgacctggattgggtggtagcaatggtcagagagggaagtgaattactccagtttaagatctgacagctacagacttgcctatgaatcgggtgtatggcaggcagccaggaggagactcaaagatgatatttgttttggttgatggcattactctctgggtaacggagaggcctgaggaggaggagaattcatttgcagggcagacagcatcaacagttaatattttagacacgtaaattgaagataatctgggaaaactgccaagtgcatgtcatgtcagctattgggcatgtgagttagctactgctcagagcagaagtctagactagagataaatgtgggtgtcatcaaccaactgagctccaaaaaatgccaacagtagaggccaagtaaaggcagagcagccaccaaaggagaataagggacagacaatgcggtgggagggatattacgataatcgtttttctggtgtcaagagagactattttctcagaatttggacccaggagagatgacagaaattgtcattggatttattattacggaagttattgctatcttaaggagagcatttttcattggagtaataaaggcaaaaggcaggttgaagtggttacaaagtgaataggacgggaggcagtagaggcattatgtggtgacattaagcggaagtttggctgaacgagagaaatggaatttttttggcatcacttgaaaagaccgtatcagtccataaatgctcaatgaaggtgtagaatgaatcttaacaaatagttatcagtgttgatacaaaaatgaatgcatgtctgagatatatattactgtctgaacagaagtattaatattgaattcaatgtatttctataattgaaggaacctagaaacagcagtatgttgcaaagaatggaacaacttagagttatttgccgttcagttgctgagctctgtccaagagcaccctgattgctgggctctgtaccatgatcttttcaactgccttcatgaccgtctcaatccatcttgcaccacagtcttattacagatcttcatgtgagcatcattcatcatataatgctctaggatccagaagggaagaatggtgttgtttgagtactactccttcacagtagaattggacaaaccatttaccatgtctaatctcaatgacatattctaaaaataaaaaagttaacattattagactaggctttcttttattttcctttttatttatactttcctgtataaataatgcatattatacagggtcattttaatgcatgatttatataatgatagtttatagtagaacttttttcctgtctaaaattttagattatatgacttcaaataatatgtttcattttccacaaagaagaggtattataccaattatatttcttatatcatcttgattgtgaatatttaaatgaatgcaaacataaagaaaatgcaattaaattgaagatcaacaaccatttcctgagaatcattttatgaaatcatttaggaaaattcattttattatacgcaaataggttctgaggagcatttaactttgaggctgaatagtgatgatataatcaagagcatataatttggacatttatcatttcaatgtagagaaactgctgctcttatttaaagataatacatatcagtttatagattttatatctccctgtaagtacattaccataatcatatgtcaatataatatcactaattatagttacattagaaggtaagtaattggcatgcatttaaaaactaattactgagttttattgccactgaaactctttgaataaattcagctattgggggaaaagaattgacgctgctgtgaaagttgattatatgaaatgggtcattttgtcatacccaagtaaatcgaggggctggggaaaaagcactcagggcatgtagcacctttttcaagaactgaattttcctcaagcctagctgctgaaatggcctgctgtcaccctaagaccagtgttacctagtaaatgctgaaacaacctgctgtgacaccaagagttctacctgctgccctcactcaccaatcagagcttgccagctcccaaaagcttctctagtgccaatgagccttctttcaaaacaatacataacatttctttcttttttttgagatagagtcttactttgttgtccaggctagagtgcaatggtacgatcttggctcactgcaacctctgcctcccaggttcaaatgattctcatgcctcagcctccagaatagctgggattacaggcgtgcgccaccacacctggctaatttttgtatttttagtagagacgggatttgatcatgttggccaggctggtctcgaaatcctggcctcaagtgatctgcctgccttggcctcccaaagtgctgggattaccggcgtgagccactgcgcccaccgacgtttctctttctaataaaactcccaactttctctttgttctttggagatatgccccaaattgcaattctgtgattgccccaaaaaccatttaatttagagattcatctctgtatttattttgacccaacactgtgctcaaataaaaattgcctatggaagtggaatagattgcagtctccagttttgttttacaagggtatgtgttatagaaagttaaatgtgttgacttttttctcagtcataatatcatcttgtttatataaaaatagagaaaataattacagaaaactttatgcccacattccttttgtttttatatcttagttatggaaagaaatcattgttttttgatgattcataaagctcactctagtttcgtgataacaaagcattacttgggtttcaaacaatgctacataaaccacagtaaatatacttatataaaattaagcatagctctgcttgtcttcttgggaattgacttgaggtgtattaaaatttacattttctattttgcaaatcagaagaagcaaggaggaaagaaaaggataaaatgaatacatatcattatacaaattagtatgttaaattattttcctctctatgccaagcaggaaatgttgtcaacacatcagcaaaccagacattgtactctaaaatttgactggcaacatttattgtggaaactccagtggttggtatagcctaactttacgtaatgatctccattatcgtttaggtttgcttaagtggtattttaagaaaatgtgacttgttacagcatacacgaagatctgtttcttatctgagtataatttacataaattataattttcatgaaacattaaccttcacttttgtgtgttcctttatttcagttgattatagtttttatgtaaatcatcctactaaatctgtttgtaattttaaaatttcactttgttctgatttaagtctgttttgcttttgtgccacaagctattatttcttggataagggcttttttccagcgtgggtttttatcatatcttcatatttaaataaaattactaaggaagtagtaattataataacaaagctaatatagccagtaatactgtggagaaaatgtgaaggtactgtgaactgtagggctggctgggcgcggtggctcacgcctataatcccagcactttaggaaggccaaggaagacagatcaccggaggtcaggtgtttgagaccagactggccaacatgttgaaaccctgtctctactaaaaatacaaaatattagccgggtgtggtggtgggcacctgtagtcccagctactcaggaggctgaggcaggagaattgcttgaactgggaggcggagattgcagtgagcggagatcttgccactgcccttcagcctgggtgacagagtgagattccgtcttaaaaaaaaaaaaaaaattagtaagggctgctcaaaagatcttttgcccaggatgaggatttctcaacacagaggctgggaaacctttacccaggcaatttttcttcagtgtccaatattgaaactagtacaagggttgatttaaaaataaaccttgtaattgtttcattatagaagctcctcaacttgcaatggcttgccttctacaaagccatggcaagtcggggaccctctgtatttcctaaagaggaaagtgcacagtgtgaggatgaatcctgagattcctgtggaaccacaagagagagaaaaactctttgcaagtggcagccacagcctcttaagccaagggtaggacctgagccagaggtgggaccctaggcagggcagggcctaagataggcatgagcaacctggggaaatcatgatgcacatatataagcaatgtggtgctgcttgtatctgtgaatatgcccataaaattcaagaggatatagatttaaatataatgtgaaatatacgtttgtattccatgtagaatttgttgcttccagtgaattggattatttgtttattcctggacactcagcacattttcctgctcctggactgctgctctttttgaaattcttgctctcaatctccatatgttcataaaagtttatttattttaaggttcagacccacttcattttcctatatgaaaataggaaatagtccctgatgccttaaagtaattcttccccattgatgaccctccaaataattttgttgcactttgctactggcacattactttctatcacatattgttatttatgtatgaaaacccctatagcatatagattaaacgtgtgggctctgaattcaaattacagccttgccacttctcagctgtggaactctaggcacgttaattaacctttctcttcctcagcttcctcatgggtaaataggaaaatactacctgcgttgcaggggtctgagtattaaacaagttaggatacatcaaagagcatgtcactttcacctgtgtttttctgcaccccagctgacacagggccttgcatataattaggttctcagactcatgaaacaactgggaacatactgatttctaggaattagaaggttcattttaaatatttaaagcttttaatttttctgtaaatatcctgactaccttagaaacaaataatacaagatacaatttttatacataaaatctagagaattagttaaattactattacttaaaatatatgggtgtatgcaattttcagaaggactttttttcttttttgatttgaagactaatattgctttctagttttaaaataagcctgctaatttgtaattgctttgaaaaacatattttgtttataggaacataatgaaattgtgatagcctcagaaaagtagggaaagagttgggcctatttttctacctgtaactcaaacatctgcaaaaattctgcaagaaagaacaaaatccatatgttctttaatatctaggctaaatgtttattttgtttggtgtcacttattttacttctgctcctgatacatctttgttttttgtttagggcctgaaggggctctttttgaacattcagtggagacaccccttgtcagagccgacccgtttcaagaccttaggtaagaatttttgttcaaatattaacaacctctcctgtagaagacaagagggtatgtgctggaataatgttagcagtgactacttcctgactgtttcttatttcatcagttgcctttattttcaagactttccgcttataactagatagtatttattaaaatccaaaggaggtcaaaaagtcctactgactccacacttggtgcctgttcacagcctcctccttcctcctccttcttcctctccaatctgcctctcacactggtatcaaaatgactttgctaaatgcaagctggttaaaatgcttcatcgctcccacatcacatcagccataggaaaatcctaagtgctccactgggcacccacagcccttcatagtctgggctgtgactggcgggacctcctcccctaccctgtcacccagacatgagtgactgccatatcctcgcccacccatcccacaccatcccctctgtgcttttgcactgactgttgcatctccctggggtgcccccctccccgaggagacctcatgaatgtctgctcatccctcaagtgttaattgagatgctacaggtttatgattcatatattttacaaacctattattttctcctgaaaagtgtcagcatacgtttcctgaagttttttacaattcttaacacaaagcatgtgcatatatatattacattatccatctctacactatctgcaaacaaggcaaaacctttgcactttttagtggaagacaaaggtgccttatgtggccgtgaaatgtgcaaaaggcactcttgaaaatgtcagtttactttaaatttttaaaagatatatgcactattagtagtgaaaataacattataaaaaccaagtgcacaataaatccatatttgcaaaatagttggaaacatttggtgtatctcttttttaatttgtagtaacatgcacataacataaaattcaccatcttaaccatttttagtgtacagttcagtagtcttaagtacattcatattacttcgtggtcattaccaccatccatctccagaactctttttatctcgcaaaactgaaaccctgtatccatttaacaagtcctcattctctgctcccggtcacccctggcactcaccattctactttctgtctctgtggatttgactaatctgggtgcctctcatatgagcgaaataatacagttttttccttttgtgcctagtttatccgacttagcatactttcctcaccctttggtatatctgtacataataccctgaatatataaaaatcacccagttccatacataaatttattattttttacagaatctttgtgtctatgtgtattttaccttaccactaggctactgaatgtcatttacacctataactattcattccaataatatatttgtattttataacaaaaccaaataatattttaaatggtcttaaagttcatgctatcacttaaaatcacatttagaatttaaacttgaagtgaatgcaggacaattaatatattttaataaattatgtataatagggaatacaaggtacagtaggaatcccagctttacacagacaagccggctgaccatggccaaactaacctttccagactattttttctcatattaaacattactgatagtaatccttacctcagagtattctaggaaagatttaataagatattatgttaaaagcattttgtaaactgaaaagtcaaacacagacaatcttttattttttttttttttgagatggaattttgctcttgtttgccgagaccagctcggtcagggagaccctaacccagcagtgttagaggaattaaagacacatacacagaaatatagaggtgtgaagtgggaaatcaggggtctcacagccttcagagctgacagccccgaacagagatttacccacatatttattaacagcaagcgagtcattagcatggtttctatagatattagattaacaaaaagtatcccttacgggaaacaaagggataggctgaaataaagggatggttgggctagttatctgcagcaggagcatgtccttaaggcacagattgctcatgctattgtttgtggtttaagaacgcctttaagcggttttctgccctgggtgggccaggttttccttgacctcattctggtaaacccacaaccttccagcgtgggcattatggccatcatgaacatgtcacagtgttgcagagattttgcttatggccagttttggggccagtttaaggccagattttggggggcctgttcccaacattgttgcctaggctggagtgcaatggcacactctcggcttactgcaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaggcatgagaattgcttgaacctgggaggcagagtttgcagtgagccaagaccatgccactgcacttcagcctgggcgacagagccagactccgtctttttatcaaggggaaaaaaaattgttattatactacatagatattctccctaaataataaaggattaggaaaagcagcattttttatatatttaatgtccaattaaatattcatcaaaagcaaataggagttcaatttatcttacccacaaagtgaacatgtgtaacataaaaatagattgtgactataattaaattataacaaggtttaattttgaaaatggataaaaagattaacattaaagaatttttatagagaagaaaaacattttattttcctaggttagaaaaatcattcaaatctgtggaaataatcccattaaagccaatttaaaattataaaataatatagattgtagaaatgccaaaacacttttaaagtaaatgtcaatttaaaaaatatatagatctcaattaaataattcatctcatgttatcccattaaatcttctcactgtatatacggcaggctcttactgaaaaagaaacggcacaagagtattcttttgctttctaaaaggcggtactgaggaaggattgagcaacttgagtgttaaaaccaaggcaattgaaaaaaataacaaaactgcaaggaaatgctcgaggagtgtggtgaggatgggaggtgggaactaacattcactgaatgcttttgactgccaggaactgtgctcggtgctgtcacagaatttgtttcatttaattatgaagtgattggcaattttatccccattttataaaggcagaaactcagatctagatagttccatgttgtaagtcacaaaactaaaaaggtagccactcataatcgaatccagctttgactccagagcccatgtacatccagtttgctgtctccaccacccagcggatccttgagagattgattctttgatttacactgagatgcctctgactgattatatgatggtcatatcttcttcttctgcaacttcttgccatcaactatgttccactttttatttctggttccagcagcattactattcctggcctgattacagtaaaaagattctggaatatcttagttggcatatatatatatatatatatatatatatatatatatatatatatatatattttttttttttttttagtcggagtctcactctgtccccaggctggggtgcagtggcgcgatctcggctcactgcaagctccacctcccaggttcacaccattctcctgcctcagcctcctgagtagctgagatgacaggtgcctgccaccatgcctggctaattttttgtatttttagcagagatggggtttcactgtgttagccaggatggtcttgacctcctgacctcgtgatccgcccgcctcggcctcccaaagtgctgggattacaggcgttagccactgtgcccggccttagatttacatttcttatggcaaaatcatttgcaaggaaagtatgaatgctgacaaactaccttaaagcaaccttgcattcacacatgatgtaattcattcttttttaaaaagtcagcaaaagtgtattaaagtgtttatgtgccagatataaaaggcatggtcgttgacctcaatgagtttacagtctattgagaaaagaaacttgcaaacaagttagaaaagtatatttaactgctatgataaaagtacaacttctgttggaggcataggcaaataaatataaaatcttcccagggtaatctgggatgataccccagaaaagggaggagttgaattctgtgtaacaccataaggatgtgatgtcaattaagtaagttattatttccacgtctgttcatttacttatctaaggaagatacacatatactactgtgtggatggaaacatttgcacctgttgcaagcacttgcaaatatgaaagtttacctagtaagtgtttataaatactaagctcagttagaaaccaagaaagggtaattcccaggtcccaacaataaagaggcagctcatggtcagagtagaggaagagttaagctaagctactcatagagaaatcaggatacatagagactagctgctgagacattaatgctgatgtgggagtgagattccaagtgattgttcagtgtgcatgaaacaccctggctgagaaacctccgaaatcctgacctcccatgaatcaggtatttcacacaatatgcccatcagcccaacgatgtcacaagaaagattgctattttaggccatgggttgaaaaattacccacaagaaatcatgacctgcaagccgttgcctggccgaggtagaagcaaacgcatactacttcacggtataggaactccgaggtggcaaattaacagtaaaaactgcaccaaagtctgtgaaactcatagaaccatttaaaaacagagagaaacgacattgaagaagttatcccatcacacatgacataaagacacttaaggaaaacaatacctgctaatgactagtttactaaaaaaaaaaaaaaaaaaaaaaagggccgggcgcggtggctcacgcctgtaatcccagcactttgggaggccgaggcgggcagatcatgaggtcaggagatcaagaccatcctggctaacacggtgaaaccccatctctacgaaaaatacaaaagaattagccgggtgtggtggcaggcacctgtagttccagctactcaggaggctgaggcaggagaatggcgtgaacccaggaggcagagcttgcagtgagccgagaccacgccactgcactccagcctgggcgacagagcgagactccatctcaaaaaaaaggaattgaactaccatggagaagaattagaattagcagctgctacaaataatctcctggaactgttatgtcatagagcaaagcaaagagatttttagaacaagtataaataaaatgctcaaatgaggaaaaaaatgaatagaaatgagggaaaaaatgaatagaaatgtaagacaaagacaagatattttgaaaaatggcagatttgggaaataacaaaatagaaattatagaaatgagacatgaagtaattaaaataaaatcactggcccccagaactttgtttctcataccattctccaaggaaccgggacttcttagagaagtggctgatcccagggctgggccagggaatggtgaagatggggcttggagcagcctaaagttcagggaaatgctaaccaaaagaaagtaggcatcgcgatattaatagcagacagaatcaaaattaggaaagaaatagcattaataagaatcaatggggtccggcgcggtggctcacgcctgtaatcccagcactttgggaggccgaggcgggtggattacctgaggtcgggagtttgagaccagcctggccaacatggagaaaccctgtctctactaaaaatagaaaaattagccaggcatacatagtggtgcacacttgtaatcccagctacttgggaggctgaggtagaagaattcgcttgaacccgggaggcagaggttgcagtgagctgaaatcacaccactgcactccagcctgggcaacagagcaagactccatctcaaaaagaaaaaaaatcaatgggaacactacttgatgataaaaggaaatatttaccaagtcagtttagcaatgatgaccttttatggtttaaataacataaataattttgaaataaaattattttcattactttttaaaatgtatggatggaatctaagaagcatggatatttgatacccaccatcaaagaactgaaaaacatacaaacaagctcttcttatggagtcagaaaagttttctttttgtccttgacctaatacttacagttcacttacccaaaattttttcctaatatacactacttagtgattgacagtatttcattgatcactctatcctatttctccacaagaaatatatttatataattatatatataattacttctagtgactatagaatttttaaaatttcttttggatagagtcataatttaaggagaaaacaattgatcaaaacagtatagctgtagtcaccctacagtgctatagcacactagaacttattcttcctatgtaagttgtaattttgtatctattagccagcccctccctatcctctcctcctcccattattgtatattttcaaataactaaaggagagaatttcagatgttcccaacataaagaaatcataaatgcttgaagtgataaatatgccaattactctgatttgattattacatattgtgtatatgtatcaaaatatcactctgtactccataaatatgttcatttattacatatcaattaaaaataatttttaaaagaaaaaatcaatatattaagatttttgatagtaacaaaaagtaaaattgtataaaactacatcttttaatgaatggttggaactttttaaaaactatttgatagatctgctaataaatatagcttattaatagaaggagtcaagatcaggcatcaatatctttcctgttttttaagtagatgtcccaaggagcctgttcacataagtaagtaggtatgaatcaaaaagttttattttttaaaaagtcactctacgttctgaactcttccctaaatacacaccattaaaagttatttgtaatgactatcggcgacaattcattaggtctttcttcaatttttgttgaaagtaaagaattagaaactgtgtaacttgccaaatgattacctcgtaatcactgtagtcattcaatttgtcaattctgtcaccaattttttaattttcccttgcacattacccctggaagtatttctaccccagtgtaatacattataatcgattcagaatgaatgagcatgtcttttctttataaagtgggagaaggagattgttaaaaaggatctgggaaggggaacccctgcaagctcccagcctggcagttcggggcaacagtcctcttctgcccctgatgaagtaactgggactggatgcaccatctctggtaaccaggagaacacttgacaaatatatgaaacaaccactttcagacactgggtagcacgaagtgcaaaacaagacagaaactaatgaggtgagccctacacttgcccgagctctctgcccacaggcatgttcagaatcagggcacagggaaggggaatccagtcagtgcacgggaacctctgggagtggaggagaaagagatccgagagtggggagttgaggctaatggagtctgtggggcacaggatcagagaagagggcatatgccaggaaagagctccggaaatcgcatacaagttcccaggtatgcacgtatcagaggtttttcaactgctcccctatatatgggcacctgatttatttacaatgcgcttgtgcaggtaaattttcatattgttggagatatagctccatgataaattcctggaagaggaatccatgggtgaaaaagataaatgcacatattgtttactcagataatgccaaattcccctttcggtgactttcccctccattgaggtataccaatttgcacactagcattgttacaataaattctattttcctttccccatggctcccaacacaatgtgttttaaatattttaaattttgccaatctgatagattagaaattacatctcattatagtttacatttctcttaatatgagtgaggtggagcaacttttcatatgtttaaaggccatttttgtattcctttctgtgaattgtttgtctttttctactttttaaaaatacttttcctctcaatttttaagacttctttaaatattgggaatattagcccttcatcccttatacatgttttaaataatttttcccagcttcagttggtttttgacttattgtactttatgctgtgcaaactttttaatgcttacatactcatgtttattaatcttttttattgtatctggattttaagtttgaatttaacatgtttcttgcatggctttatcttttacaattagacctctgatccacttagagttgattattgtgtgaggtatgaggtataaggtgtgaggtctaattctaattttatcttttccaattggccaaccagatgtgccagcaactagattatttattacaaactctactttttcccctgtgatttgaaatacaacctttaccaccaaatgtctctatacacttggggctgttcctgcaattgtaattctattgcaccagtctctccattcatgagccagtaaggagtctgttaactaaataggctttttttttttggcggcggggaggggagcggatggagtcttgctctgttgcccaggctggagtgcagtggcaggatcccagctcactgcagcctctgcctcctgggttcaagcgattctcctgcctcagcctcctgagtagctggtattacaggagcctgccatcatgcatggctaattattgtattttgtttgtttgtttgtttgtttgtttttggtagagaccgggttttgccatgttggccaggctggtctcgatctcctggcctcagatgatccactcgccttggcctgccaaagtgctgggattacagagaagatattttaatgtctggtaggactagttgtgcacacatgcgtgcacgtgctcacaggcttgcacgtgctcacaggcgtgcacgtgctcacacacacacacacaagactttgtacatcattgaacattagtctgcctattcttggttatgtatttttgcacatgaacttgagtattaacttgtcgacttccagaaaacttattttgtattaggattatattaagtttttaaattaccttagggaaaactgacaacttactgtgttgagtcatctacccaagaacagggggtgtctttccatttgttcaaagctacttctatacctctcaggagcattgaaaagttttcttcatatgtgttttccacatttatttgttgctattaaaaggaggtttattacatcatcattattccctgttactgttttagatatgaaggctattgattcctgtgtgttaattttatatctcactaccttactaaaccttttatggtttggatccatttgatgattgattcactgggattttccaagtatactatcagatcatttgcaaataggtatagttttacaccttattttccaagtataatatctctaatcaatttctcttggctaattggatttcccaatgtcctcaatgcaatgtgagaaagaaatggagatagtaagcatcactgcctttttccagtcaaagtggaaatgcctctggtatttctccattaaccaaaatgatgtgaatgtgtgttttataaagaaagcacatatcaatttctattttgtgttgaatgggtattgaatttagtaagacagtctttagtaattacagagatagtcatgtatgtctcttagatatattaatatggggtattacattaatggattttctaatactgaaccaatcttgcattctgagaataaatcctactttggccatgaaatatcatacacataactcatattagtctgcatttctttttgttcttgctctgctgcctgcccaggctaaagtgcaagaacacgatctcagcttactgcagcctccagctgcagggttcaagcgattctcccacctcagcctccaagtagctaggactacaggaatgcactacaattattattattattattattgtgagacagggtcttgctgtgttgcccagtctggtcttgaactcccggcctcaagtgatcctcccacctcacctcccaaagtgctgggattactggtgtcagccactgtgcctggctatgctatgattataaagtttaagtaaccctgttactcttggttcaataattaggaagtttttcctcattttcaatgttctggaataatttgtggagtattgggatgttctggtctctaaaggtttgatagaattttctctggaaccatatgggcctgatgaaatttttaaagacagtgttttaatattaatagtgtatttcttcttttatggaaaattgtgtttaagctttctaactttaatgggagttgattttggccaactgtatttccctaggaaattattcacttaatctaagtttttaactgtatttgtgtagtggtctgaaagtagtctcataggaatttttaaattcctgttgttttcatggttttatacagctcattgataaaaatcaatgtctataaatacaagtgatcactgaagtgatctaacactgttcgcataatcacatccttagttccaagtatgtatattttatttgtcacaagttaatatcttaagtcttcttaacttgaacaatgaaaacaatttattccttctggtaactgacaacttatggtgtggcttattttccttaattctagcaattccaagaaaaaggaaaaaaatacaaaatgtcagaaaaaaaagtacatatcatcaattcaacaactggaaacagtttcaggattgaaagtttcatccagtaacagaagagcacagtcagtgctcatacaagaattcactgatgacatcttgggctcctgagctataaagtgctgttaaatccagaatgtgaaatacattatgtgaaaagtaatactccaaatgtaaatgtataagttgcccttttcaagaaggacttacaaatatattagatttaattttcttttagctaaacagaactttttaagatttagtattttttcttaacaaacagaagcttctaattccttttaagattaacaagtaagatgcaaaatactaaacaaagttactgaaacagaggtcttaaggacaaactgaacttttatagttcactgacttctgcagtaattaaaagtctgagactcccctgaagactgaattgggtatgtcatagatgtttaatcatagccatcttatctgagtgacattagttactctatagtgcaacataatctttcacaaatttctgttcattgcagtgtcattccattcccttgtagacctcagatattagtagtctttttttctgtgaagtacagtcttgatgagcttagaagtgtattttatatttttcgtgagttaaaaaaagttatcttttttcaagacagaagtacactttacagaaataatgaaatcccaggagtgatttggattactgtgggatggtgccagcactggctgtgggcagtacttagaactatgccctgttatgcatcttttaggagataggttctacagaactgtatgggtttttttcaaggttctaatgaaaggtgattcaattcaaagaaaatattagaagtcagtacagatgcatgggagaagaaatatagggcaataatattaatatcaatgtatcaaattatatctgtatttaaaagcatggattccataaattcaagtgaaatactttaatttcaaggctcatcattgtcataaatcataaagaatatcataaatacataactattaaaatgcaggcatttattgtgtaaatacaactacatatagacagtagtatctttgcatagttcattattaaaccaaaacacaagtttttatgtacaaaaacattccgtatagaagtgagaaaataaaaataaaaacccacatacggatctctataaatgtcaacattacacctatgtgtaatgttacattatgttgtggtcaagtctaacaagaagtggattgctgaagatcgtgaatgcttcactggttaatcatgaatttatagacactgatctttctctggagagtatttggccagtatgaaagttaatttatccttgtagtattctatgaaaataaactttcaggaacttgggtgttttagaaaccactgcttgggcactaaggagggaatgagttctttcaaaaacatttttgtttttgtattcagttctttaatcagacaagaagttatttttcatgtggatgtgaagtaggcaaataattttattttgctttctgagtgggaatacccagttgtctcaaaagtcagtccattccttctttatccgtaatgctatttttgtcatatataaagctatttttaatgggtgccctattctcgtctgttgttctggcttttttcttcttaaaccagtatctccctaatagctgtacaatgcatctggtacctgctagggcaagtgtccccaccatgtcttcttcagagttgtattggctgtttttagacatttatttttcatgtaatttttttttttgagacagagtctcactctgtcatccaggctggagtgcaatggcatgatctcagctcactgcagcctccacctcctgggtttaagtgattctcccaccttagcgccctgagtagctggaattgcaggtgcatgccaccatgtccagctaattttcgtatttttgtagagacgcggtttcatcatgttggccaggctggtttcaaactcctgacctcaagtgattcactcacgtcggcctcccagagtgctgggattgcaggtgtgaactaccatgcctggactgtttttcatgtaaattttaaaatcaatttttcaggttttttgaaaaac

SEQ ID NO: 14685 - DNA, 21526 bp, Human
ccttccttataccatatacaaagctcaactcaagatggataaaatacttatgtctaaaaccccaaaatataaaaaaccctggaagataacctaggaattaccatcctggacacaggaatgggcaaatatttcatgacaaagatgccaaaagcaattgcaacaaaagtgaaacaaaacaaaacaaacaaacaaaataattaactgtaagagcttctgcacagcaagagaaactatcaacagagtgaacagataatctacagaatgggagaaaatttttgcagactatgcatttgacaaaggtctaatatccagcatctgtaagaaacttaaaccaatcaacaagcaaaaaataaacaaccccattaaaaagtggactaaggacatgaacagatacttttcgtgttttatttatcaatcttaatttacttcttatccatttggagtgtcaaataatggccaaagaaattgtaattataaattaaagaacaaaatttagcaagtaaaaataaacaaaaataacacaaaaatgtattatccttttacttttgtcattaagcaacaaatatatttctgataatttgtcaaatattttctccttgaattaatagtttatcttatttaaaagggtatattgtgtttttaaaattttattttaaatttgggagtacatgtgcaaatttgttacataggtaaacttgtgtaatgggggtttgctgtaaagattatttcttcacccaggtattaaccctagtacccattagttatttttcctgatcctttccctcttcccaccctctatcctccagtaggcactaatcattagggaaatgcaaattaaaaccacagtaagataccatctcataccagtcgaatggctattattaaaaagtcaaaaaataacagatgctgatgaggtagtggagaaaagggttcacttatacacctttgatgggagtgtaaattagttcaaccattatgaaagatagcatggtgattccttaaagacctaaaaccagaaatttgacccagcaatcccattactggtatatacccaaaggaatataaatctatcataaagacacatgcatgcatctgttcatggcagcactgttgacaatagcaaagacatgcaatcaacctaaatgcccatcaatggtagactggataaagaaaatgtgatacacatatacaaaggaatactatgcagctataaaaaagaatgagatgatgtccattgcaggaacatagatgaagctagaggccgttacccttaacaaactaatggaggaacagaaaaccaaataccacatgttctcactaataattgggatctaaatgatgagaacacatgtacacatagaggagaatgacagacaccggagcctacttgaaggtggagggtgagaggaggggcaggatcagaaaaacataactatgtagtactagtctgaatacctgggtgatgaaataatatgtacaacaaacccctgtgacatgattttacctatataacaaacctacacatgtagccctgaacctaaaagttaaaaaaaatcaaattatactgttaaattattagcatgatttataaacaatattgttttaggataaagaatttaattgcttggcaattgcaaattattaaattaaatatcaatatgttagggaggctaattcaaatgatataaatatttaggctataacaaaaggcagctatatattattaacctcacctcaaaaaggggcataatttccattcccttgactttaagggtaaattaagagaaatttgtaaagcactcaaaagaatattcaattcaatatgtggtggacagttgagaaattatgtgttatctatgtcatgggaaagcaacttttaaaaagaaaacatttcctctgaggttttcacaaataagtgaaactgtgaaccctcatatgtactgtgaaaggacaatttgaggagcatctctgattagcagcagatttattattctttcctcatttcatgttatacttaataaaacaaaacatacctgtatacacacacattcactcacattgaagatgcaagatgaagaaagatacatgacattgaatgtacagtcaaagaaaaggagttctgcccaaacatctcaacttacatttaaaggtatggaatttaatttcgttttttcaattggtgtgaattaacatggtagtttcccgtatcctgttccattgtgttattggactgtttcagtatttgggtgcttttctttctccgtctctgtatctctctcacctgtcctctctttcaatattaataatgatttaaaaataacaacctctcttaccatttaagaaacaccagtttccggcactatacagaatgttttatctatgttccttcatttaatcttacaaatttactatgagataatctctctctctcccatttatcaatgtggaactaacacttacttgtaatattttgtctgatataatttcttaaggacattctctgaggaaatatgcatactcaattaaaattaataatttcaaattagtgaatatttgctgccattcacctccttatcattcatagaatatggtgttttaatgctattttttttttttgagacggagtttcactgttgttgcccaggctggagtgcaatggcatgatctcggctcactgcaacctctgcctcccaggttcaagcaattctcctgcctcagcctcctgagtagctgagattataggtgcccgccaccatgcctggctaattttttgcgtttttagtagagatggggttttaccatgttggccaggctggtcttgaactcctgacctcaggtgatccacccacctgagtcttccaaagtgttgggattataggcatgagccaccgcgcccagcctttaatactaatttttaattcaacttctcaaaaactttatgcttttcaccaagttgactcaaaataaagtttatacaccagcaatcaacattttaatttgctacttcaagcataccctccatacacaatgcaattccatcatgccaccttaatgtgatttggcaaaagagataagcagaaattaaagacacaaataatcacagttatagagactgtctgttctgttctgttgctttctaaatatttctcttttaataacttcacccatgaaaattttacttatctcttgagtccttccacaagtatcatccatcagtgattcatcttagagttacatacgtgctatgtataagaaatttattgcctcttccatgtgaatttttagattcccatattttcaagtctttacttcctacactcaatttttatttcatttttggaaattagagatattaaacctgaaagactacaacatgtagtgacttctctgcagacttttttccacactctgttcataaatgtctctctgaagcaaaaatgtgcagattttcggctcccagatatttaagtgacacatactaatatttatgtcttgtacctttagctaatatttattaaagcttgaggtaagacgtattttatgtgaattagattgacaatgtgagccttggggttatgatgttcattcatttaacttaattttgtgatgacatatttgtaaatcttttctcatatattgaaaaacctttgttgccagtgatagtaagaaattacataattgctctatcccactatacatatgtagtagtttcagaatcactatagaaataatattataataatagttacttaaaacagattaaaatgttttgcggttttaaaaaatccttaagatatattccattgagcatgcacagttaaatgttttaaaatcactttaagtaattcctctctctatagtgaagacactaacaatacctagttagattccttttcttcattttttatggattttttttcatttttgtttaacttactttatagtagcataaaacatttacatattttcagtcaaacttatataatgaggggccaagtgtggtggctcatgccattaatcccagcactttggaaggccgaggcaggatgatcgcttgaggccaggagttcaagacctgcctgggcaacaaatcaagacccccatctctacaaacaatagagataaaaaaattaatcagtcatggtggcacatgcctgtagtcctagctacacagggtgctcaggagggaggatctctgagcccaggagctcaaggttacaaagagctctaatggtgccactgcactccaacctgagcaacagagcgagaccctgtctcaaataaataaataagaatttaaaaagtttaaaaaattactttcagagaaatccaccttgcataaatccagcacccttcataaaatttaccattttgtatttctatatttccagtgtttacttagctattctcactcttttgttctttcagataactttataaaaaattattcaggctcactcaccacaaacaacaacaaataaaacaacccgatgtagcttttacgtctaaattacttcctagtctgtcattaagcttagggagaatttatatttttgacacatagttttcttatccaagcacatgatcaaattaatgttactcagttttcggttagttttgttttgttttgtttgtattgggttgggacacttgtcgagtttctgtctagttttctttttgtttgttttttttggttaactatccgtgagtaatgaatttctttcatctatgttttcacagtggttactggattatacagggcactgattttagtatgttatttttataaatgcagctactattttttgtttctggaattaacggtagtttttcaattgattcttttattttaccaaatctgcactcacattaccttcaaataattttaccttctttttctaatatttctacctgtaattagaatatttttcttcattgaattatatattacctcttcgtattaaaaagtagtggagatttgagctatctttctttttctggacttaagcagaaaaccttctttcagttttctcaattgaataagatgttagcttcattagacataaaactattatgttgaacaagtatctattaatttctgttttttaacataaagatataagattttatcaatttcattttttacatctattgagatgatgatagatttttttccttagctttattaatataatattaatatggatttcctcctattgaataatctttatattcctagaataaaccaatcatggttataatatattttggttgctgataatgtatttaccatttttgtacagacattcataagactgattttggttttccattttattatttctggttttgggtggttaaaaggcttgtgttttaacctttataagttaaattaaaccatttccttataggagaaaacacaggataatgaaagttttactttctccattattcagcatcttttaaaatttttttttacttttatttttattttattattatttttttgagatggagtctcgctctgtcgcccaggctggagtgcagtggcgcgatctcagctcactacaacctgtagtgcttaggagaaataattcagtctgagttgaatttcaaccaccttccacaactttttttcctaatgttttctgataattattttttaagttttaaaataaatatatgacttttttaagacacatgcttgatttcttggaatttattgcttatcaatattaatatatcaaaaattcaaaaataatctcagaaatgtggagtattcattaaatgaattctgataaaattattttaatatctttgacaatgttatgataagagaaaccctgcgaactatttatctaaaatatcattctatagggttcatcatgtgctttcttgacagggcttgacagcgtcaaatgtagtttctctattttctcaggtttaaagagtatttagaatataaatttcagcattaataattcaatttattgactgaacaataagaataatttcggttacaatagaggattcttatcaattattatgatagatttacataaattatctttgataaggacaaaatgtttcacaaagtatagatattcacttattcagtataacataattattcatgtaatttcgtaagtcagtgcccagcagacctaaatcctctggatgagactctctactgtctgtccaatgatagcagtttcttgaataataatcattgaacaagcactcttatcttaaacctgacagtgtaagtctatgaaaaataaaacagttcttaaaagtttagcatttaataagaagatgaaatattattcatgacttacaaaggattttagggtttttttgattaaaatagcaggatacctaaagccatatttagttctgattcatccttagtaaataaaaaaggctcaaaggacttgtaaatgttatattaatgattaatcagaaagtgtttatgtggatacacatgtattatctgtaaatgcatgtgcatgttcatgagtgcatgtgtctccgcaatggttggaaaattattcagtgcatagagtaaaattctttctacaaattaataatgttaaatattagcaatttcttcagatttgatatgacacgtatcatagcttctgaccatccagagtgttatcattgttaaataaatgtatatatttttctatttacttagccttcatgcttttgattgcctaatatcttttgaaaccaaaactaatattttatacaatcctattattacaattgctattgtattacttcctggaagcatacttttctaaactaattcatgtgattaatgtctcagattattcagtgacgttgcactggtataaaatcttactgggaatatctggaaccgtgaatggtattctcactttgactttgatctccttgatcctgttgggtaagtttagaagatcttaattaaataaaaatatgaaagatgtttacttgtctcttataaatctttttataattattcattcattcttcactacattaaccaagattgaattagaagctactgcatgtaaagctctattagtacactccacagtgctatatttaatatgcagtcaaatcaggtaagtatcttgccctcaagtggcatacagtctaatacggagaaaggagtgtatgtgtagagtgtgtgtgtgtgtgtgtgtgtgtgtgtgtatgtgtgtgtatgtgtggtatttgaaacagtttttctgtgtttcttggatactttaatagataaaattttactgttttgcttaaatattttaatacattttatctaaggttgcatttagtttgcttttccttttgtccagcaaatattcaccgagcagctacaatactccaaatattacaaattccccaaaatttttaagaaaagaatagtcagggtgaggaatgtgatattctagtgggagaagcaggtactaagtaattatggtacaatgttctgactacagtgttggaggctgcagaaaaacattaagaaaggatgaaaagagcctatatacttcccagagcagaaacttggctttatttattattgtattaccagttcgtaggaatgcctggcatagaatagattctcaccaaatatgtgttgtataaatgaattgattgtataatattttgaattctttccatcagtagacatgaaaattttaaaaagatcctagtgaccgtttcaattatttcttgttccaatcatcggaatcattccattgaatgtgtccctgaaacattccatagagaagatatttacctaaccttaaaatagtcctgtattcaagtttctcagggagtattgctaaaatgccaaaaaggaagttgttcaaatgccactcagtatgaggacactggagatctaaaagtgaataatggcacaagaagaaatataagtaataaggacctttgtgcttcgagatctgcagaccagacaggtatgtctcaaggctttggcttatcctagttttaatcttttggactctctaaatgtgaagtatttttgaacaggtatgcaatagattaaagtaacaagtaaaagtttggtataagtctacttttcattcaaaactcgatttaggtatctttaaacttgttgcagtgggagaaaatggtaaaacaacacaagaaataggctctgccctccaggaatttaaaatccagttgatacatataaatatggaaagttagttgttattaaaaagcagtatgtaaatagccattcttgtttgtcacttatttattcttctttttctgaaatacagactggataaaagtcaatattttaaaaattattcattatgattttaagcttagacttttaagcttagaaattccagtcatacagaattttgaaaacattaccttctatttttaaatgtttaactttttttttttttttttttttttttgagcaacaaggctgtttatttcacctgggtgcaggcgggctgagtccgaaaagaagagtcagcgaaggggagataggggtgaggccgttttataggatttgggtaggtaaaggaaaattacagtcgaagagggtaattctctggcaggcaggagtgggggtcacaaggtgctcagtgggggagctttttgagccacgatgagccaggagaaggactttcacaaggtaatgccatcagttaaggcaaggactggccattttcacttcttttatggtggaatgtcatcagttaagacaggaacaagccattttcacttcttttgtgattcttcagttacttcaggccatctgggcgtatatacgttcaggtcacaggggatgcgatggcttagcttgggctcagaggcctgacagtcctgccttcttacagtaataagaaaaataacataaaatagtattgaagtgttggggcagcgaaaaaaaaatttgggtgcggggggtagcatggagagataatgggcgatgtttctcagggcttcttcgagcgggattaggtgtggcgtgggaacctagagtgggagaggtcaacttgcaggaggattttgtggtaaggggtgatattgtggggttgttggaaggagcatttgttgtatagaatgattggtgatggcctggatacggttttggatgaattgagaaactaaacggcagatacaaggtccgaataaaagaaggagaaaaataggtattaaaggactaagaattgggaggacccagtacatccaattagagagtgtccaagggcgttcagcataattacttgcttggttggcaagtttttggaccctatccttgagttttcttatgttgtcatacaccaggccagattgatttaggtaaaaacaacactcttcatttaagaatatacagagtcctcctttttcagcagtgagtaagtcaaggcctcggtggttttggaggataactgcagctaaagagtcaacttgggcctggaggactgataaagtttgtgatatgtctgtgatgctagcagagaagacactagagaggctatggaaggtcgtgacagaggttgaaatgcctcctattccagtaccgagagcaatagtggaggcagaaagtcctaaaccaacaagcaagggaattagtggaataactcttttttgtcgtgttggtgtcatgaggggaacagggagctcttcggtcctatttgcaaattgaattttgggagtaaggaaaactagtgtgcatgtacctgtccaattagcaggtagacacatggaggtagaggatccacagaggaagaagagaccttgtgcgaggcaaaactggagatgcaaagtaaaaagatgaggagtgctgaaaggggtgtcttgtacccagactcctggggatccagctagggcggcagccaccagaggttgtaatggggactggtggggtaactgcgtagagggggaggttcgattttcatggtatatgagaaaatgttgagtgtctatgagctacctttcactgttattttcggggctgggtataagtaaacaagaagagggcctgggaggagggtctgatgagcaaggggaaggtagccgaggatggagtgaaatacagggtaagtgtcttcctaagcaataattactgctaatatttttaagtttgccagtattgatagagggcttttctgtaatacggagctggaaggctccaattgtttcggtgacatgcatagctggactttggagatgaagagtaaaggaacatggagaaggtgaagggttactaggggaattccagtgggtctttgccgagagatacataaaggagtggccacaggaataggaatagtagtttgtgttgtgagaggtccaaatatggggggagtagagttgatataaggagaaaggttttttaagtaagtgtggaggagggcggcagcttgctgatatgaaatgtctggggaggtcttgctggacctgtctagaaagtaaatgagttcttcaggagggtaaaggtgagggctgttaaaggaagttcagaggtatagggagacagatgttgcccagtctacatgtaaggtgggggcagctgtgtaggcgctggaagaaagggaaatgcaaagccagcagttgttcaataaggagagattagaaatggctaggagagaataagtaacgttggtagtgtggtggagatagctggggagaggtagagggtgacataagaatgggaatgatcccttcattctattaggtctgtttgtccttaccctactttttgcaacagggctttacgaagttacccccactacttggaccgagccccaaaaactagtcatccctactatcttctgtctagtcatactcctattcaccattctcaactacttataaatgccctactcttgtttacactgccggtttacactgtttttccaagccatcacagctgatatctcttggtgctatccccaaaccgccagtcttaactccctcttagagtggataggtgatctttgctggcaggggaccctccaatacttccaccctgatgaagttctattctttacttttaagtttaactttttgatacttaactgatcattttgacatttgttttattgtatgagatgatatattatgactttccagataaatgtataattattataaaaggatttttttctaatctactagttcgtatttcctcctttatcatacgtgaaaattttatatattttatgttctacttattgacactgtcttcatttggcttatctgtctgttttacaggtatatttcccaaactaatagatattgtagctttacctcatattttattgtctccctatctgtaatgtctgtcactgtgttgggtatcattgcaatgacaccttagaaaaattaaggcggctttggtaggtaaacatggaatcatgtacatggcagtaaacattaattaaagtaggtataaatactgtatattgagctacaatatatttatttcctattccttttcttagctgaggtacaattcaaaatttgaacctttaaaagtaaacaatttcatgatgtttagaaccttcaaacgttgtgaactaccatgtttatctagttgaaaaacttttcccaaaaataaatcccttacatacccaacaagcaaatcactctccattctctctccccttagcctctgacaactacaaatcttctttcggtctatatggatttacctattctggattttcatggaatagaatcacacaatatttggccttgggcttctttcacttagcataatgtttttaaagttcatccacattttattcctttttatgggtgaataatagtccattgtgcatgtatatctataaatatagatacatatatacttatatgtatctctatatctataaatacatatatatttatatgtatctctatatctataaatatttatagttttatgtatatctgtaaatatagatatgcacaatgtttgtgtgtgcagagcttaaaggtcagccaaaggtgagatcttaggaccttttcaggtaatttctgagcatgcatccagctcagggcttgtgcctggccttccagattttcaggattatgtgggagctttccaaagtccttattcatgaaacagctcattccccggcttttcctctcaagcttttcagtcagtcctattgtttgttccaactgttataccttgcctcatgtgacaaaagctaacacattcaacttaacttttacaaacatcgtttggtagcctcaaggcagatatctaagtcttctttactggcagtgatatctactgctaaaacaattcaagagtccataggtgctctggatttcatagaaactcatgaaaaacaaactcagttacatgttgtctgctaattctacaaataacacctcacctgacttgaatcaaaattactactgatagcaaggccacctctttgctaggccaaacaaaccacctacagccaggcccctgcttcagggtgagccctgagaacaagagagtttatatcggaccccaaaagacaagtgggtcccaggttggataatctccggtaaattggtgaaacaattacaatacttactagggttacatgacaacagtgccagtctactccttagcttctggaggcaatctttccttctgcacctccctctgtatccatgaacggcaggatcctgctcccacatagggatatggtgagcatgcaagcaggcctcttctagtagacatccactcttttaccatattaattgaggttgagtcttcaaaaaataaacaactttgactggctctgactgacttttagacatgaatgcccaaattcctcttattccaggaagcactcataagttaaagtgatttttctgggggggtgaatagctttgaggaagggtaaattaaagaggcaattccctgctcaactattaaaattggccccattttgctaaaagatgctttcatcccggttgtcccccaagactattcctttgttcatccttgaaatggaccttctcagtcagcacgtgatctcatggaaagcttttacactattggcgggcaccacgtagtggaaaacagtcaatcttccctgccagtgtgagtggtaaatgctccaagataccaaccaaggcaaagaactgcaggattgtggtctgttatagctgactttgtcaaaggaattctattctttaccatgttgccttttaacttcctggtgtggcctatgtttaaagccactactagagagtgaaggctaactatagactacagggagttaagaaaaattattccttttattagagcacctctattggataattgctttaatgaatgaccttcaaaacatgggtaaatagtttgggtacagacttagctaacatgttttatttagtacacatttttcaggagaatcaatcacaatttgccttcacatttacttggttgctgctatgaactgaattgtgccctccccctaatttatatattaaaactttaattcccaaatgtgatgggatttggagacggggtctttagaaagtaattagatttagatgaggccatgtggatgggccttactcagtttggggtgccacagctaattaccataaactaggttgcttatgaacaacagatatttattcctcacagttctaaagactggaagactgagatcatggtgccagcgtggttgggttctggtgagggccctcttctctgttgcagactgccagcttctcattgtaatctctcatggcagatcgcagaatgactcaagttatctcaggactcttacgagtactaatcccattctgatcatctgttcttagctcccaaatgcccacctcctaataccatcatattgggaggcaggatttcagcatatgtattttggggtatgcaaacattcagttcataaagttttacctctgaattcccaaaattcatgtcgttctaacatgtcaaatggaaaagacaacacaccaaaagagaaagatatcagataggagtattatattcagaacatagaaagaacacttataactcaaaaacacaacccagtttaaaaatgaacatttaaaaatggatagacatttctccaaaaaacactatacaaaaggccaataagcacttgaagagatgtttaatatgatcattcattagggaaatatgaaatcaaaaccagggtggaaagccactgcacaccctccaggatggctataatcacacaaaaagagcaagtgttggtgaggatgtggagaaattgctcacatatttctggtagaaatgtaaaattttatagtactgtggaaaacagtttgacagttcctcaaattatcacatgacccaacattcaacttttaggtatatatttaataaaatggaagacatatgtccttacaaaaatttgtacatgaatgttcattgtaacaatattcataatagccaaagaatggaagcagctcagatgtccatcagctgatgaagagataaacaaaatgcactacatacatgttatgaaatattcttacaaccataaaatagaatgtagtactgatacatgctacaacttttatgaaccttgaaaacattgtgctgaatgaatgaaaaagccagatacaaaaggccacatattgtatgattccatttatatgaaaggtccatcatagttaaatccacagtgacataaagcaggctagtggttgccagcgctgggggagtagaagatgaatagtgactacttagtgtttatatgtaatgaaaatgttctagaatgagatagtagtgatagttgtacaacattgtgggtgtattaaaagccacagcacttgcactttaaaatggctaaaatggtgaattttatgttacgtgaagaaaaataatcacgataaaaaataaataaaaagagacagattgtaatgggccataagttaaaatagttatattggcctttacatatatttttatatatatctcactttttctcaatactatgccaaaaatctcgatattttccatttaatttaatttaccttaatattaagctaggaaaatcaaagaacttcataatatttcagttattaagaggttgaaaataaagaagttgaaaataaattgttattcttgacataatttaatcatttaatcattaattaatattaagagggagaaagggatacacatacaaaactacaaggagagcgattttaaaactttgtgtggtttttacttgcatttcctgtaatgatcagtgatgttaacgacgatgaggtactaactcacaccagtcagaatggctattattaaaaagtcaaagaataacgtgctggtgagggtgtggagaaaaaggaatgcttatacactggtggtggaagcgtaaatttgttcagccgttatgggagactgtgtggcaattcctcaaagacctaaaggcagaaatacccttcaaccccgcaatcccattactgggtatatacccaaaggaacgtaaatcattctattataaagacacatgcatgtgtatgttcattgcagcactattcgctatagaaaaacatggaatcaacctaaatgcacatcaatagtagactggataaagaaaatgtggtacatataccataccattccataccatggaatactatgaagccataaaaatgaatgagatcatgttctttgcagaaacatggatggagctggaggctattatccttagcaaactaatgcaggaacagaaagccaaacattgcatgttctcacttacaagtgggagctaaatgatgagaacacatggacacatagagggaaaaaacacacactggggcctacttgagggtggagggtgggaggagggagaggatcagaacaaataactaatgggtactgggtgctacttggatgttgaaataatctctacatcaaacccccatgacacaaatttacctatgtaacaaacctgcacgtatacccctgaacttaaaagttaaaaaaaacctttgtgtggataaattctaagtgatacaaattatattttatctaatctctcaaatagctattttattttgttcatgctattttagtcaatataatagatcttgcatcaaaaatcccattatgtctaggttttgcttcatctcattaaattaattgtcttaattcccaaggaccattatttgtgttttggccatcttttgtgtctggacaatttgctataagtgattttattgtagctcaactcttatttatacaacatgtaagtattgttcttatggccaattttcagagatgcatatgtaatttaatttcattttgttttctacatttctctgtagtactatgccaatcagaatggctcaaataccaagggaagtgttattggttctctaatgagatgaaaagctggagtgacagttatgtgtattgtttggaaagaaaatctcatctactaatcatacatgaccaacttgaaatggtaattggtctagtatcagggttatggcatctttgcagtaaaaaatggctttcctcaaatatctttccatctttgcattaaatcatcatttaccttgattatcgagttttgggcaccctcttaaattttgtattccaagtgagtgcctcacttctcatgctagatctggcccaaattcatatattcaacttgcaattgtgtgtgtgtgtgtgtaacatatatatgatataatgtgtgtataagtaagatatgaattgattaccataagaatccctatgcagagtgcttttttgcaataacatttaaaatattcagtgtgtctgaattgctaaaatattttgttcatttagtccctcgtccacattttaggcttttatacagaaaaacctaagacaattaaactacgtatggattgggcttaactttacctccttgaaaatgacatggacttgggtggatggttctccaatagattcaaagatgtgagtctttcttaaaaggcaatctgatttattgtttattgtagaatatgtctcctccaggttcaccaaattcaactctgaaatagttactggtactacagaattcaaaagaatgaaaattaatttagtatttacaggagtaatgatggatagtttgatttgacttttaaagaaaaaggatttgaaaatggtggtttatgattttaaaatttctcacactttatatagaaaagtagattgaatgaatgcagtctcttatttttaaaggtctcaatgttttctttagccatcttcagtaataaaataaaaccaatgtgcattttttgtgttatgtgattatcatagtgtcaaaatacaaatggtatatacaacatagaacaagattatccaaaagtctctgaacaaatgcatggaattattgattttaaaagttctgtcaacatttttgtgcgcattattttataataaaatatttaattaaaaatataaacagtaaaacagataaattcaaaatcctattcctatgttagcaggcaagataatggtccccaaagatgtccacattctaattccaaaatgctgtgaatgtgttattttatatggcaaaagagcctttgcaggtatgattaaatgaggaatctcgagatagggatattatcctggattatctgggtggccccaattaaatcacaagggtccttagaagagggaggaagcagaattagagtcatattgggagatatgaagtggaacacagagattcatatgatgtgaaatcacgtctgtgagccaaggcacgcaggtggcctcggattcctgcctagtacatccagaaggtgactctgcagacgttttgatcttagccctgtagggcaatcttgggcttctgatactcataggtgtaagataataaattagccttgttttaggccactacatttgtgataatttgtcatagtagtgatagaaaaatagtacattatagtaaccaacttaatggtgttattgtattattttccccttatttctattcatcattaaatattacatattttctatctgactgcactaaatcaatataaaaagtgaataaaaaacattatttggaatgcagtgtaaaattatggatgtgtgtcatctgagagcagagttgtgtcactgaacgtcatgaagttgcccaacttggttttgtcttcattccaaatccattcatcactacccgttagggttgagttttaagtctagatcatgcttggagatttttgtccataatatgttcaatacaaaatttaaaactaaactcggacaaagtgtattttctaatatgaaaattcagtacttacttgcccttatcaatttggaagctttgaagatcatgtgcaccttttccaagattctttcttgaactttttccacaggtcaaacaaatttatcagaatgtatcactaacactacattattttatacataaatttgttaatatttttaatatgttacattataagtaaataatgcaataaatatgcaatttattatttaggtcatgcacagttcgttttgtgtattgagttctttacaaacctcaattcatataactgctaaacaatatcatgaagtattattatcgttcttatacaattagatataagaaggcaagagaggttgttaagtgaggtgtccacatggagttaatcttatttttaatctaactgaactacatggggcaagaggaggaatactagaatgggaatgtggagggaaatttattcttacttctgttagttgcagactctctggcaactcttgaccaaccacagctaacaaggctaagttacagttactgtaatcgttagtgaatccaagtatgtaaaaatgctttgagattttgaattacttttttatttaaaagaggatattagcagaagacacaaatggatgtcttcagctacagtgattaacaaagtatttattctctcttccctagattcttcataaagggaccagctaaagaaaacagctgtgctgccattaaggaaagcaaaattttctctgaaacctgcagcagtgttttcaaatggatttgtcagtattagagtttgacaaaattcacagtgaaataatcaatgatcactatttttggcctattagtttctaatattaatctccaggtgtaagattttaaagtgcaattaaatgccaaaatctcttctcccttctccctccatcatcgacactggtctagcctcagagtaacccctgttaacaaactaaaatgtacacttcaaaatttttacgtgatagtataaaccaatgtgacttcatgtgatcatatccaggatttttattcgtcgcttattttatgccaaatgtgatcaaattatgcctgtttttctgtatcttgcgttttaaattcttaataaggtcctaaacaaaatttcttatatttctaatggttgaattataatgtgggtttatacattttttacccttttgtcaaagagaattaactttgtttccaggcttttgctactcttcactcagctacaataaacatcctgaatgttttcttaaatagtagcacctttatttctatgatagaagccctaaaagtagtatttctaggtaaaagtgttaaatgtgttgttttatattttatacaatttttatatgttgcacttttctttccaaatttagaagctttcaaacttataagaagatattaggtgcagaaaaagaatatacttatttccttgagcagtggtttgtaattctccttgaagaggtccttcacatcccttgtaagttggattcctaggtattttattctcttcgtagcaattgtgaatgggagttcactcatgatttggctctctgtttgtctgttattggtgtataggaatgcttgtgatttttgcaccctgattttttaccctgagactttgctgaagttgcttatcagcttaaggagattttgggctgagatgatagtgttttctaaatatacaatcatgtcatctgcaaacagggacaatttgacttactatcttactatttgaatatccttttattgctttctcttgcctgattgccctggccagaacttccaatacttagttgaataggagtggtgagagagggcatccttgtcttgtgccggttttcaaacggaatgcttccagtttttgcccattcagtatgatattggctgtgggtttatcatacatagctcttactattttgagatacgttccatcaatacctagtttattgagagtttttagcatgaagtggtgttgaattttgttgagggccttttctgcatctattgagataatcatgtggtttttgtcattggttctgtttatgtgacggattacatttattgacttgcctatgttgaaccaaccttgcatcccagggatgaagctgtcttgattgtgacggataagctttttgatgtgctgctggattctgtctgacagtattttattgaagattttcacttcgatgttcttcagggatattggcctgaaatttcgttttttgttgtgtctctgtcaggtcttggtatcaggatgatgctggcctcataaaaggagttagggaggattccctctttttctattgtttggaatagtttcagaaggaatagtaccagctcctctttgtacctctggtagaattcagctgtgaatccatctggtcctgggcttttttcagttgttaggctattaaatactgccttaatttcagaacttgttattggtctattcagggatttgacttcttcctagtttagtcttgggagggtgtatgtgtctaggaatttatccatttcttctagattttctagtttatttgcatagaggtgtttatagcattctctgatggtagtttgtattactgagggatcagtggtggtatcccctttaccattttttattgcatctatttgattcttctctcttttcttctttattagtcttgctagcggtctatctgttctgttgatcttttcaaaaaccagcggctggattcattgattttttgaagggtttttcgtgtctccatctccttcagttctgctctgatcttagttatttcttgccttctgctagcttttgaatgtgtttgctcttgcttctctagttcttttaattgtgatgttaggctgtcgattttagatctttcctgctttcccttgtgggcatttagtgctataaatttccctctacacactgctttaaatgtgtcccagacattctggtatgttgtatctttgttctcattggtttcaaggaacatctttatttctgccttcattttgtcatgtacccggtagtcattcaggagcaggttggtcagtttccgtgtagttgtgcagttttgagtgggtttcttgttcctgagttctaatttgattgcactgtggtctgagtgactgtttgttatgatttcagttcttttgcatttgttgaggggtgttttacttccaattatgttgtcaattttagaataagtgccatgtggagctgagaagaatgtatattctgttgatttgaggtggagagttct

SEQ ID NO: 14686 - DNA, 11309 bp, Human
tcaaggtctgtaaatggtgggtctattattaggtgtgtagttggggaagagtttatctagtttgctgggaaggctgctcatgggtctctgagtgggttcctcaacctgtggcacagaggagttagtgctaagtcacaaggtttcctcggggtctatagctgaaaccagtgtcttcatgtctgtctctggggtcatggttgagtgtgttttctggcaggtctgtgggcaggcagatttgcctcagactgtagttgagttgggctggagctggatccagaattgtttcaagatctgaaataaaactaaggtctgtgcctgcaggggcactaatgatgtctctctccaggtccctgtatgggcaaactgctctctagcatagctgagaagtgtcgaagccccttttctgtccaattaaaggatctgctgtgaaacctaggtcaatggtctcctagttgggacatggatgcacatgtcctccctctgtatccctgagctggcaagactgctcacagtccacagctgagaagggtgaaggtcaagattcaaggctgtttcagaaactaccgtggaactgaagtcagcaagcctgtactgctgacaaagatgattgagtctcacagcaatttcctgtgattaactcaggtcacagttgagaggagtttgagtggagattcagggccattttagtatcttctgtaggacagaggtcagcaagcatgccccagaggtacagatgtatatgtctcccaggaagtctctgtgggtgaaggactgatctcaagttgtggctgacactagttaaagccaagttagagggctgtttcagggtctacattgagactacagttgatatgcctacctcctgagacactagtgtgtgagtctcctcctgggcccctgggcaaatggttttggcagcatgaccaaggcctaaatggggctgaaggcaagcacaggaggatgggtcccttttcaggtctggagatggaatcactgttggtaagtctgccacttggatgcaaatctattccctaaaacaaccttcctaggtcttgggttccactggcattttacaaactcctacttgaattccaaactccctcaaaggaacttttgtctgtggatggctgaaaaattattgttgctgtgggggcatatgtgtgggggaccacctattctgccaatttactgactttcctcctagtaagattttaaaattactttttccccatacatagtttgacttcagtttttgtcatttacaactaaatatttctatgaaagtcgacataatttgttatggcggaggatgaataaatgaagaatgtaatgaatagctatttaatatttcaatttctggtatgctaatatatttcaaaattgattaatattttacctatccaagatatttttatcaagggtaatctgaagattaaataatctatttttaaaaattaagtgcaaaaatttaagaactaagagaagttaataatataactttggcaatgatgctttttgtgccagctacaatcaattgagtaattactgcagtaatttttcagaataattaaggaaaaaatcagtagatatcagttgataatattactatgagttttagaatgttttctattataatggaagtgacataataaaataatataaagaaaagaagtatgcaatgttaagatttagcaacctagtctaaaaggcactcttaacaaggtgagggttgacaatgttcgtgatcaagacagaaaaaaaaaaaattctcataggcacttgaaaaatgaaccaactaaatgacacactttcaaagtcaaccttgtacttttaatagaccaagtatcctatattttggaggtgtgtgatgagataaaactgatttcacaatagcccatgtgtagaatttcctgttcaaaccttagtaacacgttgatgagaaatctactttttccactcttgactcactctgagccttcacagggcagtctgcgaagattgcaggcattgtttgttcttgtcttggatttatgcctttaaatttcaccttttattacacagctatagcaggcctttttatgagactaacctggcctctccactaaaggatgtgtgactttctggggacagaaggtatgtattgctactctccaactctctactagcctacctcatttagtgggtgatttcaagtgctcaatatgatacaaaggaggtataattaatatacaataaaatcaaagtagaatattgctgtcttcatttgaataactcagggtaaaaacctaaaatatgaaatatgttgaaggatttcttaaagttttcaaattattgtttgtggaaatctagtgggtttgttgatcaatatcgtttaagggaaagctattaacatcacaataatgaacaattaattttgtattttgtaatcagtacatcatgtatctttgaataataatttatatttagcttagccattaaagattattaaaataaatcaatcaattgatgaaagccaaatacaattcctcagacacgtagattagagaaaagcagtttttatttttaataaaaatcagaatgaggtagattacataaaatgctaaaggtattacaaagcaataaaaatactttttaaaaattgatcaaaatattgcaaaaaaagatgtagcgcatggacataggagacttatctgaagatttattttccatgctttaactgacatgaatcagaaacagtaacataacaattgtgactaaaataataattaaagtagctaatgcttattgagaactttaagtgccaggttgagtggtaaatgttttacatgcaacgttttatatgttcttatgcccattttagattaacaaactgggttattaaaaatagaataactttttaaaggtcgcacattataagtgtcaaagctagaattaattctagatctcactgactccagagcccattgactaaatgatttaattacgttatctgaaattttacaagtacttatacaactaaagtggcctttactcactttgacaaccataaaatcattctataagtttaaatgaaatgtgctttaacatgaattacctatacttttatttatcattttttggttcataatttagccaggaaataaattaccaattactaattaaattaccaatacttctgtaagtattaacaatttatgtagtgttcctaatactatttaggttatgcataagttaactgtgtcacatagcattttctgtcatatacaaatatttaattttttataatttttaataaataatttttaataatttcttagaacatttcagccattaagaaaagaccatttaattacctctattgattttcattaatgtgtataaattactaaataaaagtaatgtagtgcaagaaatttttatatatatatatgtcaactttactattactcatgtgcagaccacatagtcttaaccattactggatttcaaaattaacataaaaatgagtgcagaagtttttctaatacaacattttaatttttaacacaggtaaaacatcagactttaagaaatatatttttattcctgaacttctttattccttagtaatttattgcttctcattgccccagcaataatattttgtcaaatgcagaaaatttatcttttttttttgagtcggagtctcactctgtcgcccaggctggagtgcagtggcacaatctccgctcactgcaacctctgccgcccatgttcaagagattctcctgcctcagcctcccgagtagctaggactacaggcgcctgacatcatgcccgactactttttgtatttttagtagagacggagtttcaccgtgttagccaggatggtctcgatctcctgacctcgtgatcggcatgcctcggcctcccaaagtgctgggattacaggcgtgagccaccgcgcccggcctaaaaatctttttttaaaacaaatattcataagaaacgtgtttaggcttgaagaaaatcagagaaagaactttagattatttaatgcaaaatgagctccaatactcgttctccacctcacccttttaattgcactagggaatcctgtatataaaccatttattaacttcttaactactgttattatagagtacagtccctgacatcacacactgcagagatggataaccaaggagtaatctactcagacctgaatctgcccccaaacccaaagaggcagcaacgaaaacctaaaggcaataaaagctccattttagcaactgaacaggaaataacctatgcggaattaaaccttcaaaaagcttctcaggattttcaagggaatgacaaaacctatcactgcaaaggtaaagcatttaaaagatcctcaatataacagtctaggatgtgcagcttggggtacaggaatgtggggaaagagaagggagtgctcatatatcttctatttgcaaagatcagaattccaagttgagatatgctatttcaatgtaaagtatgaagactgattgaactcattgttgaagtttgtagtctttgtcaaataattcatggagcattatttttcctgaaaattcaatggtatattattctgagaaaaagattacaatgggagatgagggtttggggtccaagtttctctgtatgattcctgtgcattcaggttctcttgtctgtgaatcttctaaacgactgtatccacctctcctttcgcactgttcccatttctctccctgcagatttaccatcagctccagagaagctcattgttgggatcctgggaattatctgtcttatcttaatggcctctgtggtaacgatagttgttattccctgtaagtctattttcgaagattacaaggggaattttcacgttaatgattgaatgtgcctctaaacatttcatattttcagggaatagagttctcattgtaatgtatatatttggactaaatgtggaatgattattctgaatttgtcaaagaataaatgaaagaataattgttgaaagtattcgcttctgatgcaatcgtatgtatatatttggatttcataactcaaaaatatgttctaggagtctgaaaaaccttactgagaaatagaaattaatttttgaaagtagttaaatcaagaattataagaactatatgagatggtgaaatttggttctttagatctatgaaatacttttccaaaaaaccaccattactttatcaaatttttcttaaaatcaattttattccatattattctaactctaaataatacaaaaaaattcaaacaaaaacttaaaattattatgattgatttagatgctaatttttttacaaagattactttaatttttctagctacattaatacagaggcacaacaattcttccctgaatacaagaactcagaaaggtatataataatttttaaagttttaatattgtacagtttattttttcttgatcttaggctgtacaaaaataaaattttgggtgaaaaattataaaatttggcaataagtgttcataaataaaattagagtaaggcattcacttgtcatcaactataagtaaaatcactatgctttctttttatctgttgtgttcaaattcttactgctataatatgataagatacaagttatttattgttccttaaaaatcagattagttcattgatttttcaagacatgtatagagtggatttttgtttgctggtttgctttatatgggaacacaattaggagatgaaaggctgaccctttattgcgcatgtgtgtataagtgactgggtattttgacactatatatttaccagcccatgaagatgtatagatatgttgcatacatataggtttatatgtttgcaaatatgtgaactaattttcatttttaaaaattcatattggtctagatagtaattcatatctttatttagcacgtcattgtggccattgtcctgaggagtggattacatattccaacagttgttactacattggtaaggaaagaagaacttgggaagagagtttgctggcctgtacttcgaagaactccagtctgctttctatagataatgaagaagaaatggtaagatgtaaatgttttaaacactttatgaaaagcttctttcggtcgataatatatttgtagaaatcatccatatgtgtgggtatatacatttagcttatatgttttcaagtttatgtagtatttaattgattgacttaataatgttttaaaattcatatactgctaatgtacttttgattattttcagtttttgcttttcatggaaaaccatgcttctagaaatgctttcaatccacaatacattttgctatctaattttatcgggcatgatgtgatctggtcatgcagattgatcacaaagtgaatgaactcctgtgatacaagtcagatcatgaaataaaagtttccagctctagtagttccacccctgtgtatgccctcatcacttatcctgactcctctccaaaacactgtcttgacttttaatgttataaataacgtttacctgcttttgaatttatataaagggaatcatacactgtgaatttcatgtctgtgtttttcactcctatctgatatttatgcaattcctccatattattgcggttatctgtcgtttattactgttcactgctgtagtatgtacaaagaacactaagaatccattcaatcctgtgtctctggatggggaagtgagtctcatgccctcagggacaaagaggaccctgggtggtgcactggtagtcattgggttcctttgctgatcctcctcacccacatccactctggtgtctcttggtatgagaaggaagtacttcctctggctgtattggtagcaagtctcctggtagatcatccttgccagtggtaccagccttgcctgttgttgcggaggggactccccttcaatacagaacaggagtgagctttgctgggcctcctcctattgccaggttgggtgtagggaaacagcaggcctaggtcaccttcttctgtcgtgtggaggacttaacatgctcgctcggacacttggttgatccctgatgctagggtcccagacaatttcatctttctctttccacctttcagagttctccattgcttttgtctttcattaatcccagagtttatagttgtttttagtagggagtagcagagagagacgagtctacaccacctggtcaggatcactgttattccaccaaaaccaaatcagataaaaaagtgagggcttatctagttaaagaatggtgtggtacccagaaaacccaatatgtagcttccatgtcatttatttctgaatgacaacctctaatttctcttctaaatctccaactctgagaaatatagcacaaaaatagtttgatttagtcacagtatctggaggaatgaatgcacagtatcaggagacttatttaaatccttactgtgtttattcagtcaattggggtaactattataatgcaagaattaaaacttctttattaacatgagaagaataaaagtactaagtataaacattgatgggttcatttatatcaaaattataaacatttatgaaagtttttggcactgcaaatagtggttttcaaatttaatatattgtttttgtaatgttttcataattattatttaagtgaaaattctttcttttcttttagaaatttctgtccatcatttcaccatcctcatggattggtgtgtttcgtaacagcagtcatcatccatgggtgacaatgaatggtttggctttcaaacatgagtaagttgttttgtatggcgctatataacaatatatatataaaggataaattcagaagaataatatgaataaatctatgtggaatcatagagatgaagaaagatgtggaaagttagtgaaatgctgacataaatattttacaatagaccatagtagtccatatatttcaaccgctcattggtcagctagtaaccttcttgattatcagatggaccaggggtgtccaatctttggcttctgtgggccacattggaagaagaagagtcttgggccacacataaaatacactaacactaacgatagctgacgagcaaaaaaaagaaaaaaaaaatcacagaatgttttaagaaagtttacgtatatgtattgggccgcatttgaagctgtcctgggtcacatgcggcccgtgggcagcgagttggacaagctcgagctggactatcagggaattgcagtgcttgtttttattaaaaagccacgcttactttttttcttaagaatatcctcaaagcacaagagtagtgctgttggcatattgctataattttgttattagtagttattgttgtcaatctcttattgtgcctaatttataaattaaattttatcacagttatgaatgtgtagagaaaacataatctctctataggttctgcactatctgccgtttcaggcatccactggaatcttgaaacatatccctcgtggatgaagggggactactctgttgagtgttcagaataatgactcttactaatattatgaaaaatttaattacccttttccatgaaattcttttcttacagtacatggaaaatgctttcgtctcatgaatcatttgcttaaaatgtaacagaatatggatttttctccattacaggataaaagactcagataatgctgaacttaactgtgcagtgctacaagtaaatcgacttaaatcagcccagtgtggatcttcaatgatatatcattgtaagcataagctttagaagtaaagcatttgcgtttgcagtgcatcagatacattttatatttcttaaaatagaaatattatgattgcataaatctgaaaatgaattatgttatttgctctaatacaaaaattctaaatcaattattgaaataggatgcacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctcagggaggttgaaataggagatgaccactaattgatagaacgtttctttgtgtcgtgatgaaaactttctaaatttcagtagtggtgatggttgtaactctgcgaatatactaaacatcattgatttttaatcattttaagtgcatgaaatgtatgctttgtacatgacacttcaataaagctatccagaaaaaaaaaagcctctgatgggattgtttatgactgcatttattctctaaagtaatttttaaagattagcttctttataatattgacttttctaatcagtataaagtgtttccttcaatgtactgtgttatctttaatttctctctcttgtattttgtattttgggggattgaagtcatacagaaatgtaggtattttacatttatgcttttgtaaatggcatcctgattctaaaattccctttagtaatttttgttgttataaatagaaatacaactgatgtctgcattttgattttatatctacttattccactgattttatatatttaaatctattatgtcaactattgatttatttctgggtgttctatataacgagcaattttatctgcaaatgatcacacttttattttttttaatccatgtgctataacttagttttattttcatttattttcactggctagggttttatacccatagttgaatagaaggcacaatcaaagttctttgtggatcatatgcatcattttctggttttggcaaaaaatacttcaacatgttatacatatttaaaaagcttggtgttttttgcatcctatctttctcatatcgaagcagttttataatactattttctaatagattttatcaattgtaacatttttattaatttgtatccgttggaatgatatatgttttgtttatataacattttataaacttttattttttcaaatgttaaaccagcctttgtttctgaaatagatccatgatgatcattgtatatttccctcataaaatatcagtgctggccgggtgtggtggcccacgtctgtaatcccagcactttgggaggctgaggcaggtggatcatgaagtcaagagatcgagaccatcctggccaacgtgctgaaaccctatctgtgctaaaaatacaaaaattagctgggcgtggtggtgcgcacctatagtcccagctactcgagaggctgaggcaggagaatcactttaaaccaggggtcggaggttgcagtgagccgagagggcaccactgtactccaacctggcgacagagggagactctgtctcaaaaaagatgaataaaaaaaaattagcgcatatatattttatgtagggtaagatttgtttcttcatccatgttcacaaggatatttgaccatgtttttattcatagctatatacttgaaaggttttgatatcaaggctatcttgggaagaatttctctttttctataacctagaagcatttgttgagagtactgctttatttttaaatgttataattcactagtaatgccatctgagtttgtagactatttttctaggaaagtttatgtctaaactgaatttctttaatacatggtgggatatactcagatttctatttgaggtactgcatttggtaatgagtatgtatgaattttctatttcatatagacattaaaatgtaatgaaaatagttttattgcctctaaataactgtaaagaccataatggtattgccatgtttaatctagaaataggccagttgtggtggctcaagcctataatcccagcactttgggaggcatcattgtgcctggcccttatcaattttttaaaatgttaaatttattatttttgtggatacgttagtaggtgtatatttttagtagtcgttcatcaagttttaaaagcattttcaatgaaaatacctttggccttgctgttctctctattgtaacattattctttatcgtgattttttactgtttattcatctttttcttatacatcacttgtatttaattttagcttttctatttttaatttattttagtgcattcaatggtaatttaatttttaggtcatcttttgtaatatatgtacattgagggcaatcggtttttacaagagagattttcattctattttccttataattcatataaaaattgtgaccattcgttttgataatttatttcacccatatgttatttagata

SEQ ID NO: 14687 - DNA, 11309 bp, Human; identical to SEQ ID NO: 14686

SEQ ID NO: 14688 - DNA, 86857 bp, Human
  misc_feature (1)...(86857): n = A,T,C or G
cttgttctgtcacccagatttcagtgtagtggtgccatacctcagcctccaactcctggactcaagcaatccttctgcttcaggctcctgagtagccggaactacaggagcacaccacgatattcggctattttattttttgtagagatagtgtcttgctttgttgcccagcctggtctcgaactcctgggctcaagcgattctaccgcctcggcctcccaaagtgctgggattacagacgtgagccaccgcgcccagctgctttatggatttttttttttggagacagagtctcgctcttgttgcccagactggagtgcaatggtgtgaccttggctcactgcaacctccgcctcccgtgttcaagcgattctcctgcctcagcctcccaagtagctgggattacaggcacccgccaccacaccacgttaattttttgtatttttagtagagatggggtttcatcatgttggccaaggctggtctggaactcctgacgtcaggtgatccacccaactcagccttccaaagtgctgggattacagggatgagccaccacgcccggctttttttttttttttttttttttttttctgttgagatggagtctcgctctgtcgccaggctggagtgcagtggtgtgatctcggctcactgcaacctccgcctcccgggttcaagcgattctcctgcctcagcttcccgagtagctgggactacaggcgcgcgccaccacccccagctaatttttgcatttttagtagagacagggtttcaccatgttggccaggatggtctcgatctcttgacctcgtgatccactcgcctccgcctcccaaagtgctgggattacagccgtgggccaccgcgcccagcccgctttatggattttgcaagtcatttactccctctaagcttcagtttcctcatctgcaaaattgggaggccatgattctggcagttataacattcctgggagcaatggaggagaatgttatttagtaagatgcctgtgaggaattatgatgagaggatggagaaggtggggtgtgtgcaatggtgaagaagggatctgaggactgtgaggcacggctgagggctcaggaaagaggctcccattacaaattttaaggctataggaccccacccacactttttgggggatcatattccacctttgtcccggccccgcctccgccccacccttctccccctcccctttctttccttcccctcccctcaggctgagaggcgccacacttcttatggccgccacagtgctccgctttccacagctcgagggctgcgcgcgctctcacgctgccacctcactcgcgtgtgggctcgccctcagccccttccgattggctcattatgtaagtgacgtaagggctccagcctcccactaacttatccctggcttgccccgcctcctcctggcttcttttgacgccagtggaaacctaacctgccccgtcgccgccgtgcgggaggagccggtagagctgtccaaaccaggaaggcgatggcgatggcggtggcgcgcacgcatgcacgcacgcacgcacgccacggccggcggggccgcagctcgcgcccgggctcgcccgcgccgcgccagaggtcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcggtgagtgcgtggctcccctactcctggcagctggccgcagcgtccccgcaccgcccccggtgcggcccttccgtccgcggaggctccctgcccgcctcgcgtccgcgctcgttgccaccgcagcccttcccgatgtgccccccggtgccactggctcttcgccagtggccgagtttttaccctgttccccgggttcttcaatcctcgactccccggctccgttccccgcagtccggccatctccggtcgatctgccctccctccccagacctcaccccgcccagcctcttgtccatccctttcttcctccggtctcggtcattgcccgtaccccggccccctttcttgagccccacccttattccttgctcttttcccagttcctcagctctgtgaggcccactcagggaagccccactcccgagagcgggccctcttcaaccttggccaaggagggtgggatctgggcgttgttttccccagaggcttggccctgcgaagtgctgatgtcgtggaaggtgggaaggggtggtagtagaaaaaattaaatgattttcacctgggtgggaaattagtctgggccatagaggaaacatctgaattggagacgacttgagcatggggtggttgggggtgaaaggggtagcgtcggcagtggagatttttgccccttaggttagatggggctgtggcttgtcggaaaacctcattttgttctcttgactttcatcactgacaattcttttggcaatgttgatgatttttcaatctctgccagatgctatgtcatgatcattttacttggaatttttctcatctcacctcccctttttctcttttcaacatgaagcagcgtctgagtctcatggtggtacaaaagggaattactggggaaatgttaattattcattccttcttgagtattttccaatgatatattgaggattcatgtgagagaaggcttggaataacaaacatctttgttttgtcggatttcctttggaaaatggagtagagtaggaacagactcatcatctagttacctaaattagatttaaataccatttgggctaaataattcttttatgcttaatattctgtactgtctgatgagtgaaattgttatgtcatttacctggtcaggttctgctgtcactgtacttttgtattagatactagatcctaattttgtgatggttgtatctacgattacttcttgtagtaattccagttttatgctgtattatacaaacttgacactcgacaattcagagatgattaccctcctttgtttttctcatactttgcatgcccatctttaaaattcagacattgagagattagttctgagtcatcaaacattgagtacctactaggtgttttaggtgaggttatagaaaacattagttatttgttttgactggaaggcatgtaagtgatataaattcgtagcttttattactactttgaactatttatactaatttgtatgccatcacagaggttaatactcttgcaaaattgcctccagttagaactgggaaatcatttttctcctttcatgtgtagattatcttcccctcctcccttttggggggaaaaatacaatctccctcctttttgcttatatattttcctgaagtaagtataaacttgtgtctttaggtgagtaacttggtagaacctatggagttgcttctagtccagcttttctgtgtcaatatcaggatagttcccaaacataaaatatagtttattggttattattgataaaaaggatccaaagtgcttattgtgcattctaaggatattattgccttccttatgttgtgatgcacagctatttagtttgcatgaaaaaacctattcatcttcctgcctaaaaaggttttagcatgaatggagtgcttaacttcctaagtatcttcaggtttcctttgaatttcttgagtatttgtgtatgttctaatgcataatggagagttttatggcttctaatttcgtaccttgtttaagcctctactaccctcccccctccattactgaagcctggttagattttttttaatagacttcattttttagaacagttttagacttacagaaaaattgaaaagatagtgtagagttcccatatacccacacatctagtttcccctgttatcaacatcttgcattagtatggcacatttgttaacaattaatgaactaatattgatatgttattattaacttaagtccatagtttatttagatttttagttttaacctaatgtcctttttctgtttcagcattcaattcaggatgtgaagttaattatcttttgaggttactatattgtcaagtaatgccattcattagctttgacaatgaaagattgatctctgttttcatggtcagtgtctatagttttcttatgcgttagtagaagtctgtagactccatgtccttttgatgtaactcttcatgaattatttatttttaggtctgttagaattccacaattcagctttcaaagactgtaatctatggcaaagccttgtttcttcttaatagcatttaccacatttacaattatcttattttttatgtgtttgtttttatttcccacagaagaatgcaactcccatgaagataaaaactattcttttttgttcagtgtgtccccattgcctagcgtagagccaggctcatagtagctgttcagacatgttgggtaaatgaatgatggctgaatctagtagtaacgaaagctagtagcctatgttacactctttgacatggttacgcaattgatagtttaacaataacacttaaaacttacatcatttgattgtatacaggaatatatcagatacttaagggggtagagaaaccaatcgtttagaggcccaaccatttcattcaaaaaataggactgacctgaattttgtacttttttttgagttgagcaaaattcgtcttcctttattaaagttgttaaattatttgctattaatgtaacgcatgaaaagtattcaaattataccaatgatgtgctcatggaactgatttgaaattaggttttatttggcttatcaaaaatttaagatactaggctgggtgcggtggttcatgcctgtaatcccagcactttgggaggctgagataggtgaatcatctgaggtcagcagttcaagaccagcctggctaacatggtggagtccccggctcccccccaccccatggcccggtctctacaaaaatacaaaaattatccaggtatgatggcgggtgggagcctgtaatcccagctactcaggaggctgaggcaggagaatcgcttgaacctgagaggcggagggtgcagtgagctgagatcatgccattgcactgcagcctgggtgacagagtgagactctgtctcaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataaataaaggaatgttgaaatacacaattggaagtttccttgaggagtctgttttgttactacctctggctattgtcttgagatgcagaggcagttttagtaatgtcactcagtggtttacagtagaagatttcactatatatacatgttaccaattataaattaggagatgtaatggcagagagaagcgcatactcagcctactactgtttttttcactttatattgccttttctttttttccatcaatgctgatcaaattgcaatatgttagataaggaaaaaatgtcttattgtcagagactagcagtactgaccagttgtttttcttttgagacggggtctacctctgtcactcaggctggagtgcagtggtgtgatctcagctcactgcaccctccacctcccaggctcaagtgatcctcccacctcagcctcccaagtagctgggacaacaggcacgcaccaccacgcctggctaatttttgtatttttttgtagagatgggattttaccatgttgcccaggctggtctcaaagttttgagctggcgagatcctccggcctcagcctcccaaagtgctgggattacaggtgtgagccaccacgcctggccagtactgaacattttatattggctagatcagtggtttttaaactttttttccccaagacccctttctgctcttacaaatttttgaggatcctgaagagctctgttaatgtagttgttattgttgttcttcttcctcctcctcctcttctttctcctcctcctcttcttcctcctcctcttccttctcctcctcctcttgttcttcttcctcctcctcctcttctttctcttccttcccccttctcccttccttccccctttccacctcccccttcctttccttttctcccttccttcctcctttcctcttcccatttccttcccccttcttggatgcagtgactgttcacaggggctatcatggccaactgcagccttgtctcaagctctcctcctgcctcagcctccctagtagctgggactataggcacatgccactgtgcctgacttttgtttatgtagtttatgtcaacatttaggccgggtgcggtggctcacgcctataatcccagcactttgggaggccgaagtgggtggatcacctgaggtcaggggttcgagaccagcctgggcaacatggcgaaaccccgtttctactaaaaatacaaaattagccgggcatggtggtgcgtgcctgtagtcccagctcttcgggaggctgaggcaggagcattgcttgaactcgggaggtggaggttgcagtgagccaagatcgtgccactgcgctccagcctgggcaacagagtgaggctccatctcaaaataaatgaataaatatatcaacatttactgtattgaaaaagaaaatttcaaaatatttaatatgttaaaaaataatagggccgagcgtggtggctcatgcttgtaatcccagcattttgagaggccgaggtgggcggatcacttgaggccagaagtttgagaccaacctggccaatatggtgaaaccccgtctctactaaaaatacaaagaaattagcctggcatggtggtggacggtcccagtggtagtgccagctactcaggaggctgaggcaggagagtcccttgaacccgggaggtggaggttgcagtgagccaagatcacgccattgcactccagcctgggcaacgagcaaaactccatctcaaaaaaataataataataataataaacccatatgcatgttaataccctttttttttttgactgcatccctctgttgcccaggatggagtgagtgcctcccgggttcgcgattctcatgcctcagcctcctgaatagctgggaccacaggtacatgccgccatgcctggctaattttttgactttttagtagagacagggttttgctatattggccaggctggtctcaaactcctggcctcaagtgacctgcttgccttggtctcccaaagtgctgggattacaggcatgagccactgtgcccagccttcatgttaacatcatttctgaaatgaaaaagaactattttccaaacagatatttagtgagagtgacattgttttacatatttgcaaatctctttaatgtctgacttaatagaggacaattggatttgcatagctgcttatgcattcaatcctgtaatattacacatcatataggcactgggaaactccacaatacatttcaagagagtaagagtgaaaaattcaaataacatcttaatcttatgaaaatggttttgacatccaggagtttgtggacctccccaaaggtcttgggagatcctaaggggtcagtagaccactctttgtaaactgctgggttaggtaatatcaagtcaattgtatctcctgttataatgttgccagtttttcatatcttgttctgaagccttaaaactgcgtggtacatacagttaatgatttagagcactagaggactggtagagatggagagtaagagtctaggtttcatgttttagcagtggctactgacctttggcagattactcaacatgtctttatgccccatttttccttatctataacataaagataatagacctatcatagagttattgtgacatttaaactagtcaaataatgcaaaacatttagaagagtgctgggcacatgagaagtgctcagaaagtgttttaatttaacaaatctttattgaaaattgctacagtgtcaggtggtttggtagtgcttacttttaaggaatttacgttttatcagggaagaaatacacaatacttaatacaatatagcatgatgagtgccactgcttttaaaagtagagctaaggctgggcgtggtggctcacgcctgtaatcccagcactttgggaggcctaggtgggcagatcacttgaggtctggagtttttttgtttttttgtttttttttcagacggaatctcgctcagtcaccgaggctggagtgcagtggcgcaatctcggctcactgcaagctctgcctcccgggttcatgccattctcctgcctcagcctccggagtagctgggactacaggcgcccgccaccatgcccggctaattttttgtacttttagtagagacggggtttcaccgtgttagccaggatggtctcgatctcctgacctcgtgatctgcctgcctcggcctcccaaagtgctgggattacaggcatgagccactgtgcccggcgaggtctggagttggagactagcctggccaacatggtgaaaccctgtctctactaaaatacaaaaaattagctgggcatgatggcgtgcatctgtaatcccatctcaggaggctgaggcaggagagtcacttgagcccgggaggcagaggttgcagtgagtggccatgttggccaggttagtcttgaactccttgctgtctcacccaggctacagtacaggggtgccattatagctcactgcagccacgagctcctgggctcaagtgatcctcccacctcagcctctggagctgttgggattagaggcattcgccattgcgctcggctgattaaaaaaaatttttttagcaaacgaggtcttgctgtgttgccaggctgctttccaactcctggcctcaagtgattcccgcctcaagctcctgactctggaattacaggcatgcaccacctcacctggcttggactttttattagacttcctgattttatttcatctggtctctttcatttccttaagcttctgttttaattctcataagatttttctcaactttcttccatttttttattatttttttctgctatcattttaattttttttttcttttttttgagctggagtcttactctgtcacccaggcttgagtgcagtggtgcaatctcagctcaccgcaacctgtgccttccaggctcaagtgatcctcccacctcggcctcttgagtagctggaaccacaagcatgcgccaccaaggccggctattttttgtatttttggtagagatggcgttttgccatgttgcccaggctcatctcgaattcctgagctcatgcgatctgcctggcctcggtctcccagagtgctaggattacaggcatgagccaccgtgccagttcttatcattttaatttcaaagagtgtttttgttcatcttctgaatgttcctttctgtagcatctgtgtttttgtttttttgagacagaatcttgccctgtcaccccggctggagtgcaatggtgcaatcttggcttactccaacctctacctcccgggttcaaacgattctcatacctcagtctcctgagtagctgagattacaggcatctgccaccatacctggctaatttttgtatttttagtagagacgtgatttcactgtttgtcagactggtctcgaactcttgaccttcagtgatctgcccccttggcctcccaaagtgctgggattacaggtgggagtcaccacacccagccttctgtagcatctttttaattcccaatttttaccttttcttgtcattttgaagatgttaataagatacatgacttttttcttcctgcatatttagtttttgtaaattgtttttcatctctgcttgttttagtttctctatttcctgtttgatgtggtcctcaaaaaactagtgtttcttggctatttgcttctatttaagaggtgagcactgagagttgtgtttttgtttttgttttttatgctcttgtgtgggtttgtgggtctttactgcagaatgatcttgctgagttcctttttgggagtctctgatgttaggtctttaagtctttttgctggtcagattccctgaagaagaattactcagtgcactgctggagagaatcttggttgtcagtgttcttggaggtgaatggagagagggtttgaagtcataacatacagtaaatgcatttagtctccttgattttaatattgtttgtactctatccctcagctgtaccttgtaatccctagtacagaaaccccgtttttctttctcagcagcattatcttctaattttcagctgtgttgaacagaagagggaatagaagagagtgttaatctacttgttaaatagactttcatcccttccttctgtttttagctccatctttacctttatttctagatgtacttggcccagacaattcctaagtcaatgggggttctgtggtccaaatcagctttctcagctttccccattgtcggtttaaaattgatcattattgagtcttttaggtcaattactacttttccatttgctttctactttctaacttggatgattcagattttccgagaaccaacacttaatacttgcttagggttggttagttggtttgttttttgagacggggtctttctgtgttgcccaggctggagtgcagtccattcacaggcatgattatagcgtactacagcccggaactcctggctcaagtgatcctcctgcctcagcctcctgagtagctgggactatagagtcaggccagtgagcctgactcttttcttttttaaaagtacactttggccggggggcatggtgactcacacctgtaatcccagcactttgggacactaaggcgggaggattgcttgaggccaggagttggagaccagcctgggcaacatagtgagaccctatctttacaaaaaattaaaaaaattaaccaggtgtggtgtcacatgcctgtagtcccagctacttgggaggctggcttgagcataggaggttgaggctactgtgagtcttgattgtgtcacctcactctagcctgggagacagagcaagaccctgcctcaaaaaaaaagtacattctataaaattaaaaccaacttatttacccccatactcatagtagcattattcatagtagccaaaggtagaggcaaacaagtatccatccacagatgaattaataaacaatatgtgacacatgcatacaatggaatattagccttaaaaaggaaggaaatcttggcctggtatgggggctcatgcctgtaatcccaacagtttgggaggccaaggcatgaggatcacttgaggccaggagcttgagaccagcttggccaacatggagaaacccccccatctactaaaaatacaaaaatttgctgggcgcggtggcacatgcctataatcccagctgccctggagactgaggcacgagaattgcttgaaccttgaactgggaggtggagtttgcagtgagctgacatcatgccactgcactccagcctgggtaacagagtgcgactctgtctcaaaagaaaaaaaaaaaaaagggaaggaaatctgacacatgctacaatgtggatgaactttgaggacgttatgctaagtgaaataaggcagtcacaaaaggacaaatattttatgatttttaaaattaataagtactaaataaacctccttgttatcctgtccgttgtgagattgactaaaccttgccaaaacatcctgacaaactttacttttgagatgaaatccaaactctcttgtctaagttaaaccctttcatggtctgacgtctaccttcgtatctctcacttacttctaacactcatctttacctgttattataaggcagatttaaaaaaaatattttttaaaatttgtgttaaaaatgttgtaattagaggtaagatctcgctatgttgcccaggctggccttgaactcctgagctcaagtgattctcctgcctcagcctcctgagtagctgggactacaggcatatgacaccataccctgccagtttgtttttttcttacagtcagggtcttgctctgttacccaggctggagagtagtgatgtgatcatagctcactgcatcctcaaactcctgggcttaagcagtcttcctggcttagcctcccgagtagctaggactataggcacataccaccacacctggctaatttttaagttttttcatagagatagatcttgctttgttgaccagggtggtctcaaactcttggccttgagcaatgctctggcctcgagtgatcctctggcctcggcctcccaaaaggctgagattacagtcatgagccactgagcccagcctattttggtttcttaaattgtcattaagttgtatactgtacaacttttatttttcagtagttttcggggaacaggtggtgggtgtttggttgcatggaagagttctttagtggtgatttatgagattttggtgcacccatcacccgagcagtgtacactctacccagtgtgtatgtagtcttttatccctctcccacttccctgtgagtccccaaagtccattatctcattgtttttcctttgtgttctcatagcttaactcccgcttatataaatgagaacacacgatgtttgattttccattcctgagttacttcacttagtaatggtctccaactccgtccaagttgctgcgaatgccattacttcgttcctttttatggctgagtagtagtccatggtagatgtataccacatttcttttttttcctttttttaagatagagtctttgtctgttgtcgaggctggagtgcagtgtcgtgatctcggctcactgcaagctttgccttccgggttcaagagattctcgtgcctcagcctcccaagtagttgggattacaggcgtatgctgccacgcctggttaatttttttatttttagtagagacggggtgtcatcatattggccaggctggtctcgaactccttacctcaattgatctgcccacctcggccttccaaagtgttggaattacaggtgtaagccaccgcgcccagcctaatccataattttttaaagttagctttggtagaattttggggggatgaaggaggattcagaaatagacaacaggtataaatggcatatttgaaaagtgaacttgtgatttaactaaatactgtgttttggggtccttaaaatattttttgactcttcattatggaaaaatttaaatgtatagaaaaatacggagactagcatcaggagcccctgttagctgttacatagctttaataattattaactcgtatcttaatcttttttcatctatatagcattcccaacctctgtaccaaagtgggttattttatgtgtctatttattttttagagacaaggtctcactctgtcacctaggctggattccagtggtgcagccatagctcactgtaaccttgaactcttaggaaaagtgcgttattttaaagcaaactccacacgtcgtattgtaactattttgctatggctgctcaaagaggaagacctccttattgaaatattcttgacatttatatacataattgctcatagaggcctttatttttgggatactgttcattcctttacacgtttttgagcttaatatttcaggatctctatattagagaattaaaatatccatgagttcataatctaaagaagtgacagctcttcctttaaaagaattccaattaacaaatacagacagaatgaggtaaatttaaaaatcaccattagaataccacagtaataactgctgcaggtaagatccctttgatgaattttaaaattggtgggcaaaagtttgagaacacaatgtttgcatcatctcaaagtatcttccccaatagttattatttacaaagggaaaaacattaactttagggtgaagaaacactgtagacaccaccaataaccaagtgatcaaggttaacatcgttaggaataagataatgggccattatgtatcctctgttataatgcactgagaaaggcacatcagttctgtggtagttttgccaagaattcatggcctctgtctaatcgtgagaaaacatcagacaaatccaaatcgaggaacattacatgaaacaactgacaagtattatttgaaagtgtccatgtcatgaaaacaagggaaaatggggaaaatctcacatatcagaggagaccaaggagacatgacagctaaatgcaatgtgggatcctggatgacatcttggaacagaaaaagggcattagaaaaatgggtgaaattctaaataagttacatagtttagttaataacattatatcactgttaatttcttagttttgataattgtgctgtggttatgtaagattttatcttagaggctggccgggcatggtgtctcacagctgtaattcccagcacttgggaggccgggggcggggcgggggggggttccgatcacaaggtcaggagttcgagaccagcctggccaacatggtctctactaaaaatgcaaagagtagctgggcatgctggtgggcgcctgtaatcccagctatggaggctgaggcaggagaattgcttgaacctgggaggtggagattgcagtgagccgagatcgcaccactgcactccagcctgggcgacagagcaagactccgtctcagaaaaaaaaaaaaaggaagattttgtcttagaggaagccaggtaaaaggtgtactgaaattctctgtactatttttatagcttttctataagccaaaaaaatttccaaatagaatgttaaaacagtcgtatggctggttggggtggctcatgtctgtaatcccagcactttgggaggccgaaacgcttgaacccgggaggtggaggttgcagtgcgccgagattgcaccaccacactccagcctgagtgacagagcgagactccgtctcaaaaacaacaacaacaaaaaacagtcctactacgtgtactactgttattctgattttaccgtgaggaaattgaggcacagagagattaactaacttgtctcatggttgcgtggttagtaagtaggcaagctgggatttcaacccagtagtctggttctacaactcacttttttttttttttttaatttatttcgaggcagagttttgctacgtctccctggttggagtgtgatggtagtgtgatcactgctcactgcagcctcagtctcctgggcttaggcaatcctctcaccatagctgggaatacaggtgtgtaccaccatccccagctaaatttttttatttttagcagagatgaggtcttgctgtgtttccaggctggttttgaactcctgtgctcaactgatcctcctgccttggcctcccaaagtgctggttttttttaagagacagagtctcactctgtcacctaggctggagtgtagtggcacaatcatagcacactgactttgaacccctgggctcaagtgtttcttctgcctcaatttccctagtatttgggactacaggcatgtgccactgtgcctggctattttttgtgtgtgtgtatagagaaaatgtttgattgatatgtagtatacatagaagcatataaatcataaatatacagcttgaatgagaaaaattgatgaatattctcattcttacaaaagttatttcttactataaattagaaaatttgactttttttcttttctctttagcttacaacagctttttttttttcttttaaattgatggggtctctgttggccaggctgctcttgaactccctgggctcaagtgatcctctcactcagcctcctgagtagttagctgggactactggtgcgaactctgcacttgactgatcttcattgttttgtatctctatttctttctttctttttttttttgagatggagtctcactcttgcccaggctggagtgcagtggcgcagtctcagctcactgcaacctctgcctccagggtttaagcgattcttgtgcctcagcctgctgagtagctgggactacagatgcgtgccaccaccatgtcctgctaatttttttattttttttgagatggagtttcactctgtcacccaggctggagtccagtggagtgatcttggctcactgcaacttctgcctcccgggttcgagcagttttcctgcctcagcctccttggtagctgggattacaggcacacgccaccatgcctgactaagtttttatatttttagtagagacagggtttcaccatgttggccagcctggtctcaaactcctgacctcagatgatccacccatctcatttttgaatttttaatagagacaaggtttcaccatgttggtcaggctggtctcaaactcccgacctcaagtgatccacctgcttcagcctcccaaagtactgggattataggcgttagtcactgcacccggcctgtgtctctatttcttaaggttaattttatgtctctgtgagttgtatccactttcatttttctaagaatgcaaagttgttttaggccaaactctggaccacattaactgcctaaagtactgaatgaagtctacttggtgaagtttctctccattggttaattaattcattcagtgccaggcagaaactgactctctgagtatacagctatgaacaagaaaaatacagttcttgtttcttattttatcgtgtgtagttgagagaggtaaactagtaaataaatgcattaacaagatactttgagatagtgttaatgtgtttattatattaccaatttttcctattttttcccataagaaaagatggatcatgctttatttaaaatttctacacttaagtgtttgagtgaaataatgctgataaagtgagtcttgtgctagtagtcagtcttatgccagtactctttactctttttttttttttttcttttgagatggattctcgctctgtcaccaggctggagtgcagtggcgcgatctcggctcactgcaacctccacttcccgggttcaagcgattctcctgcctcagcctcctgagtagctgggactacaggtgtgcatcaccatgcccagctaatttttgtatttttagtagagatggggtttcaccatgttggccaggatggtctcgatctcttgacctcatgacctgcccgcctcggcctcccaaagtgttgggattacaggcgtaagccaccgcgcccagccccagtgcttattttgaactttccactggaatattcttttagagtgcaaactattttgatttctctttttgtccttatgatacaattataaaagtatgttgactttgttgtaggagtaaaataaaagtcctgctgccatctaaaattcttttttttttttttttttttttggagacagggtctcactctgttgcccaggctggagtgcagtggtgtcatcacagtatactacagccttgacctcctgggctcaagtgatactcctccctcagcctcctgagtagctgggaccacaagcatgtgctactacatgtggctaatttaaatttttttttttttttttttgagatggagtctccctttgtcacccaggctggagtgcattggtgcgatctcggctcactgcaacctccacctcccgagttcacgccattcgcctgcctcagcctcccgagtagctgggactacaggcgcccaccaccatgcccggctaattttttgtatttttagtagagacagggtttcactgtgttaaccaggatggtctccatctcttgacctcgtgatccacccgcctcagcctcccaaagtgctgaaattacaggcgtgagccactgcgcccgtccagtttaaaattttttgtagagatagggtcttgccatgttgtccatgttgaacttttgggctcaagtgatccctgcctcagcctctcaaaatgctgggattgcaggcatgagccatggcacctggctgatctaaaattcttagagagatgcaatcttaggctgaaagtaatttagaaagataatttagttttttttccttcaggcagaaccatatctgatatcaattttatgagctaataatgtaaccaggaaagaaaagtttcacaaaattgtgttatgtgagcaagggttcagagcctctaaagtacatagtatgcttggagaataatgaatagccttctgtaattggcagatgaggtttatgtttgttaaaggtgtgagatgagactggaggctaggctcagaattaagtgtttttttttggttggtggtttttttctgagacaggatctcgccatattgcccaggctgcagtgatcctgtctcactgaagcctcagtctcctgggctcaagtgatcctcccacctgatactcttgagtagttgggactacaggcacacaccaccacacctggcttcaaactcaagtttgacataaaggtccttgatgacctgctaaaagtttaacattatcttacggatactggggacccctgcaatgttttataaattgaagaaggatacctctgctagtatggaggttggacactgacagtgctttctttcttttttctctttttttttttttttttgagacagagtttcgctctgttgatcaggctggagtgcggtggcgcaatcttgggtcattgcaacctccgcctcccaggttcaagtagttctcctgcctcagcctctggagtagctgggattacaggtgcccaccacaagatctggctaattttttttgtgtgtgtatttttagtagagatggggtttcactatgctgcccaggctggtctcaaactcgagtgatctgcccgtcttggcctcccaaagtgctgggattacaggcgtgagccaccgtgcttggccttacagtgctttcttatcttgttcactctcttgtatgtgtgcatatttgttttcttcagtggattgtaagctcctttcaggtcagggctttactcgtatttgtttttgcattcttatcccccaacctccttatttcctagcatttaatagttttggaatgaagtgagaaatagccatttgagcattgatgtatttgtttactttttttttttgagacagattttcattcttgttgcccaggctggagtcaatggggcaatctcgattcactgcaacctccatctcccgagttcaagcgattctcctgcctcagcctcccaagtactgggattataggcatgtgctaccacgcccagctaattttgtatttttagtagcgacggggtttctccgtgttggtcaggctggtcttgaactcctgacctcaggtgatccacctgcctcagcctcccagtgtgttgggattacaggcgtgagccaccacgcctggcccatttttctttgataagagtaatcagtagtctgtctttaccattatgtatctttcttatctgcagcttttatgtagttaaacaagtttttttgtctgcgtgtggtggatcacgcctgtaatcccagcactttgggaagcttaggcgagaggatcacttgaatccaggagtttgagacaaggctgggcagccatagccagaccctgtttctattttgttttattattatttatttatttatttatttttgagacagagtctcgctctgtcgcccaggctggagtgcagtggcacaatctcagctcactgcaacctctgcctcctgggttcaagcaattctcctgcctcagcctcccaagtagctggggttacaggtgcccaccaccacacccagctaatttttgtatttttagtagagacagggtttcaccatattgaccaggctggtcgtgaacctctgacctcaagtaatccacctgcctcagcctcccaacgtgctggaattacaggcgtgagccaccatgcccagcctattttattttttcttttttaattttgtttttctttttaaatcacattcccttcttgtccctatatgtctcctggaggcaggagatatataggaaatatcagtaagtgcctctcaattttgctgtgaacctaaaactgatctaaaaaattaaatcttaaaaaatttcatttcattttgttttaattttttatttctttttgtcttttccagaatattatgtagttggatcatgtatgcattcctttcgagataagatattttcatttaatagttcacattaggttctggcatgtctttctatgatttgatagcttatttctttttggtgctgaataatactcaattgtgtggatataccacagtttgtgtatccattcacctactgaaggacattttggttgctttcaagttttgccagttactaataaaaagcagctgtaaacatacatgtacgtcctttttttttttcttgtgcagatttttgtgtggacatgttttcagctcttttgggtaaataccaaggagcatggtcgctggatcatatggtaagagtatattttgggccaggcacggtggctcacgcctataatcttagcactttgggaggccgaggtgggtggatcaccttaggtcaggagttcaagaccagcctggccaacatggtgaaaccccgtctctactaaaaatacaaaaaattagccaggcgtggtggcatgcacctgtaatcccagctgattgggaggctgaggcaggagaatggcgtgaacccgggaggtggagcttgcagtgagccgagattgcgccaccgcattccagcctgggcgacagagcaagactctgttgggggggtggggggaaggagtatattttgttttgtcaggtaaatattttttgtttttactttggatgtctctatttcatcatgctggaaactcatactgtagatctaataaatattattgtggagaaaccacttttattaaaaacaacttttgagccatagatgtgaaattacttattttaacaaattttctatacaaccacattcattctctccatttttaaatacgactgtacaggtgtagtgtagtttttttttttcttttttttaaagacagagtctcactctgttgcccaggctggagtgcactggcgtgatctcggctcactgcaacctctgcctcccaggtttaagcgattgtcctgcctcagcccccccgagtagctggattacaggcgcatgccatcacgcctggccaattttgtatttttagtagagacggggtttcaccatgttggccaggttagtctcaaactcctgacctcaggtgatccgcctgccttggcctcccaaagtgctgggattaccggcgtgagccgctgctcctggccagctagtttttttttttttaaattaactttaggagaaacaaaaaatcttgattcaatttaggtcttttagagaaaggctactagatttttaaactttagttttattgactaggtaagttacactgaagtagcattagcttggtttatttgattttgttttcctctagaattgcatcacctaggtgagacgcccttggatatgatattgcagtgaggtttgcttgcagctgagcttttctgttgtgatccctaggtacttttctcaactgtctttgttaccaggatggaacaatgactagatagtgtcttttgcttggctttgttactacaatcatagcatatgatttaagctaccattatcatagcggattaattttttatagtgtttttttgtgggaaaaagtaaaaaatataaatatctaattggtctagttcaatactatctggccaatgttattgaccaagaattatgaagcaggtcagaatttatcatagttatagattgtagactaattgagtcctctcttttttttttttttcttttttttgagacagagtcttgctctgttgcccaggctggactgcagtggcgcagtctcggctcactgcaacctctgcctcccaggttcaagcgattctcctgcctcagtctcctgagtagctgggactacaggtgtgtgccaccaagcccagctaattttttgtatttttagtagagatggggtttcactgtgttagccagggtggtggtctccatctcctgactttgtgatctgcccgcccgggcctcccaaagtgctgggattacaggcatgagccaccgggcccggcctgaggcttctcttttttatgcaaataccagtcttagattgtgtgaatcctaggtatccttcaagagtatattatgtgaggacttactttgccacttataaaacttatcttttaaattaatatccctcggttttcttgaggccccaataattagtttatctaacttttaataatcaaccttagaggtggcaggatttcttgagcccaaggacttggcactgcagtgagccatgattggtgtcactgcactccagcctgagacagaacaagaccctgattcaaaaaaataaaaaataaaaaatcaggctgagtgcactggtggctcatgactcatcccagcatttgggaggctgaggcgggaagatcacttgagcccaggagttcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttttaattattattactattttttttttgcagtcttgctctgtctcccaggccagagtgcagtgctgtgatcttggctccctgcagcctccacttcccaggttcaagcgattcttgtgcctcagcatcctgagtactagacctgcctaatttttgtatttttagtagagataggatttcaccatgttggccaggctgatcttgaactcctgacctcaagtgatctgcccacctcagcctcccaaagtgctgggattacaggcatgagccactgtgcccagccccaatattagtttagtttagtttagtttagttttgttttttgagacaggagtctcactctgttgcccaagctggagtgcagtggcgcagtcttggctcactgcagcctccgactcccaggctcaagcaatcatctgggctcagcctctcaagtaactgggactacaggtgtgtgccactatgctgggtaatttttgtatttttagtagagacggggttttgccatgttgcccaggctggcctcaaactcctgacctcaagtgatctgcctgcctcggcctaccaaagtgcgaccgctcctggcctcaatattggatatttattttattttttactttgagacaggatcttaccctgttgccagggctggagtgcagtggcactatcacagtttatagtagttgcaaactcctgggcttgaatcttcctgcctcaacctcccaagtagctggggctacaggtctactccactgtgcttggctaaatttctttttaaatgtttttggagatggagttttgctttgttgcccggctagccttggactccttgcctcaagcatcctccagtttcagcttcccgagtatctgggattacaggcaagagccactgtccctgaccattttagccatttttaagtgtgtagttcagtggcattaagaacattcacattgtagtaccggctaggcatggtgcctcacgaccataatcctggtactttgggaggccgtggtgggaggattgcttgagctcaggagttcaaaaccagcttgggcaacttagtgagaccttgtctctattaaaaataaataaataagtaaaaaataaataaaaaataacattcacatttagtacaaccatcacctgcataaatttttataacaactttatggagctaaagtttacatatcatataatttacttgtatcaagtatacagtttagtggtttttagtatatattaataacatgtggtctttttttttttttttttttgagatggagtctccctctgtcgcccaggctggagtgcatggtgtgatctcggctcactgcaacctccgcctcccgggttcaagcaattctttgcctcagcctcccgagtagctgggattacaggcgcccaccaccacgcccagctaatttttgtattttttttaagtagagacggggtttcaccatgttggccaggctggtcttgaactcctgacctcatgatccacccgccttggcctcccaaagtgctgggattacaggcgtgagtcaccatgcccggcaataatatgtggtctttagtgactgatctctttcagttagtgtagtgttttcaaggttcatttgttttgaagcatattatcaatacttcatcccattgtatctgtgtaccacgttttgtttattagttgatggacatttggcttgtttctgcactttggctcttatgggtagtgcttgccatatgttataatgatttcattatcatttagctcaaatgatgatgagttttagaaacagggtcttgctctgtcacccaggctggagtgcagtggtgtgatcatagctcactgcagcctcaaactcctaggttcaagcaatccttctgcttcggcctgccaagtaggggactacaggtgcatgccaccacactctagtaaattttaaattttttgtagagatagggtctcgcttatttgcccaggctgatctcgaactcctgtattcactcgatcctcctcagcctcccaaagtgatgggattacatacacgagccaacacaccaagcctaaatttccattgtgagttcttcttgaacctctgggttagaagtacattatgttatttccaaacatttcaacattttctggatatcttttagttgtaaatttcttgttcagtttcactgagggcagataatacgttctatatgatttcaaacatttgaaatttgttgagacttgctttgtgtcccagcacttgttttctttctttcttcttttttttttttttttttttgagacagtgtctcgctgtgtcacccaggctggactgcagtggcatgatcacggttcattgtagctttgacctcctgggctcaagcaatcctcccaccttagcctctcaagtgtctgggacaacagtatgtaccaccatgcctggctaattgtttttttttttttttttttcttttttttttctttctcgagatgaagtctcactgtgttgcacaggctggagtgcagtggcacagtcttggctcactgtaacctttgcctcccaggattaagtgattgtcctgcctcagcctccggagtagctgggattacaggcatgagccacaatgcctggctaatttttgcatttttagtacagacagaatttcaccatgctggccaggctggtctcaaactcctgacctcaggtgatctacccaccttggcctcccaaagtgctgggattacaggcgtgagccacaccgcgcctggccaactgtacttgttttcaattaggagataccttcatctagaattactttcactggtgaatttctttttctttttttttggagacagagtctttctctgttgcccaggctggagtgcagtggcacaatctcggctcactgcaacctccgcctcccgggttcaagtgatttccctgcctcagcctcccaagtagctcagattgtgggtctctgccaccacacccggctgatttttgtatttttagtagagatggggtttcaccatgttggccaggctgatctgaaactcctgacctcaagtcatctgcccgccttggcctctcaaagtgctgagattacagccatgagccaccgcacctggccttaaaacggtgaatttctcatatctgtaatcccagcactttccacctgtatcgtctgctactctggaggctaaggtcagaggattatttcaacccaggaggttgaggccatggtgagccacgatcatgccactgcactctgtttccaaaaaaaaaaaagtaggtgaattgtatggtatgtgatttatctctctctgtctctctctctctttttttttttttttttttttaaggcaaggttgggattccagaaactgcctcctcaaatactgcttattctctcaaatagacttttgaggttgggataggtttgatattagcagcaaaatcctgtaagagggcctgtaacttcaagattatgtcctgcatatgggttattacagatttacttgtctgatttattgttgaagaatttaggtaatctcgtatataagtagagttacatatttaaatttatttctttccaaataagattggaaaaataaataaagcttcctaagttagctctctaatactcatggtccttgttaaaggcctgagataccttctttttcttctagctaaagtctccttcagacctcatgtttaaagttatttttctctggaaagtttttctttaccttctagccttataatagaagactgcccccattcacaacatgctcttgtactttttatcactctgcagtaactttttgtctctctgacttaaccttagcaagtactatgttctgattgtttttatatccccagcatttttcagtccctggcatttagtatgttctcattaaaaggaagaaatataagtgagtaggatcatttttctattatatttgccctgggctacaaaagtttcaaagattgagccctatcatttgaattagaatttatacccaagttgtttgccagtggttgttaatacagtcaaatggaatgtgaatcctactgagatcattgttgtgtctggccttcacagaattgcaagagtgtgtaattagcatggtgcagatggtgtgattttaggaatgttattataaatgttgaaattgtgctagaatttctattttgtttctggagattgcattgaggcagcatagtgaatgcaaatgtagttattaagagatgatttacaaatacatgcatcaaaattttatatttaaacatgactttcaaaggaaatgctcattggagcatttctcatttcaggcttttggattaaggatgctcaagtataatgcaaattttctaaaatctgaaatatttatggttctgagcattttggttaagagatactcaacttgtagttgtcttgttcctacctacttttactgagagacactctcctttagttttttttctcctagattttagattactcctgttaggaaccaggcctcacggcaggaggtaagcagtgggcctgagctccacctcctgtcagatcagtgctggcattagattctcataggagcgagaaccctatagtgaactgtgcatgtgagggatctaggttgcatgctccttatgagaatctaatgcctgatgatctgaggtagaacagtttcatcctgaaaccatccaccgttcctcctccccaactcccacagaaaaactgtcttccatgaaactggtccctggtgccaaaaagattggtgactgctactgtagatttatctccaatttgggtttgccatttttttttctcactattaaactggataaactggccaggtgcggtggctgaagcctgtaatcccagctctttggggggctgaggcaggtatatcacctgaggtcaggagtttgagaccagcctggccaacatggtgaaactctgtctctactaaaaatacaaaaactagctgggcgtggtggcgggcgcctgtaatctcagctacccaggaggctgaggcaggagaatcgcttgaccccaggaggtgaaggttgcagtgagctgatatcgtgtcactgcactccagcctgggcgacagagtgagaccccgtctcaaaaacaaacaaaaacttgataaactgggtaaattcttctccgttattaaactggagtttttttcacttcacaaggtgaagtgcccttcttgtcacagtatatcaggggttcttgatagccacatacatatatacactttttattgggaatgatacatatatagtaaagtgttttactctttgagaaaaagattttattttaaagtataacatccagtaaagggcacaaagtagacaaatcttaaatatatggcttgttggaaattttacttttttattcacctttgtaatgattaataccagcacttagaagattccttggctccctttctcagttagaaaccccttacaacttttcttgacttctatcagcattaattctaccagttttgaacgtcatataaatagaattacagagtatatattcttttgtatctggtctctttcactctatgtagtgtctgaaatttgttcatacaattttacatgttaggatattttgtcattgtaatatttcattttatgactatgccacaatttgtccattctctttatttatttatttatttttatttatttatttttttttttttgagatggtgtctcacaccctgtcgcccaggctggagtgcagtggcatgatctcggctcactgtaacctccacctcctgggttcaaacgattctcctgcctcagtctcctgcgtagctgggattacaggcgcgcatcaccacacccggctaattcttgtatttttagtagaaatgaggttttgccatgttggccaggctgatctcaaactcctgacttcaggtgatctgcctgcctcagcctcccaaagtgttgggattacagctgtgagccaccgcgcctggcctaaaatacagctggagaattaattccagcaagggatggcttgatgatttttgaaagacttggcttaaaacaacaacaacaaaaaaatcaatgtaacagcagaagcagcttctgccaaccaagacaagtttccagatgccatgaagaaaataattgaggccagatgtggacgctcatgcttgtaatcccagcactttgggaggtcaaggcaggcggatcatgaggtcaggagtttgagaccagccaggcgaacatagtgaaaccctgtctctactaaaagtaaaaaaattagccaggcatggtggcacacgcctgtaatctcagatactcgggaggctgagacaggagaattgcttgaacccaggaggtggacgttgcagtgagccgagatcgcgtcactgcactccagcctgggtgacagagcaagacatcgtctcgggggaaaaaaaagaaaatcactgaggagaaaggatagctgcctgaacagatctgtttgtttgtttgctttgagacagagtctcactgtgtcgcccagactgtagtacagtggtgcactctcagctcactgcaatctctgcctcccagattcaagcgattctgttgcctgagcctcccaagtagctgggtttacaaggcgcactcccccacgcccggctgatttatttatttatatatattttttgagacagagtctcgctctgtcacccagtctggagcgcggtggcgcagtctcgactcactgcaagctctgcctcccgggttcacgccattctcctgcctcagcgtcccaagtagctgagactacaggtgcccgccaccacgcctggctaattttttgtatttttagtagagatggagtttcaccatgttagccaggatggtctcaatctcctgacctcgtgatccgcccgcctcggcctcccaaagtgctgggattacaggcgtgagccaccgcacccggccttttaggtatggttcttatcctcccaaaaagtacattttgggagtattggagatgttgatttacccagttcctttctaattgataaggttttttttgcattcattttgtattttgagtctgtgtcaagccactggcaaaatagaaaaataatcagatatggtttttgcccttggagaatgtgcttattggtaaagaaattgccagcattccactacttttgacctcatgacactttcatatggattaacctaaaaatatcaatacagtccagacacagtggtgcacgcctataatctcagcactttgggaggccgaggcgggcgaatcacagggtcaagagatcaagaccatcctggccatgatgaaaccccatctctactaaaaataacaaaaaattagctcggcatggtggcgtgcacctgtagtcccagctatttgggaggctgaggcaggagaatcggttgaacccgggaggcggaggttgcagtgagccgagatcttcccgctgtactccagcctggcaacagagcgagactgtctaaaaaaaaaagaaaatatgtgtgtgtgtgtgtatatatatatatatatatannnnnnnnnnnnnnnnnnnntaatatctatctatctatctcacaatacaaagtgaagttatggatctttggtaattctttgccagagaagtagagagttctatctggttttgaaatgaattttaaaacagcttttcttgtcagtttttctcactttttttttttttttgagatggagtctctgttgccaggctggagtacagtggtgtgatctcggctcactgcaacctccatctcctaggttcaagttattctcctgcctcagccttccgagtagctgggactacaggcgtgcaaccaccctgcccagctaagttttgtatttttagtagagacacgatttcaccatgttggccaggatggtctcgatctcttgacctcgtgatccacccacgttggcctcccaaggtgctgggattacaggcgtgaaccatcgcacctggccagtttttctcactcttaaaacagtgtagttcttgtagccctcataccccttctaagactatcttttgcctttctactcccagggattatactttgatttgctagatgaagtggacctaagcctccattaattctttttgttagggccaagtaaacacttacttggccttttgtgaattaggaatgtcagtatataataacagaatgttttcaacttttaactatagactgtttacctgtgcttttaaattgggagatggttgtctgtgtttggagaaagtcattttgacaatcttggggctatatgggttttaattattcttagtagaaccattgcaggtatttcccattgactttaattgcagttctctgtagaaaaattttctgagaacccaatgtaatgtgttcactgagcaaatctttttttcgtttcatttcagttggaaagacatctttgatcaccagattcatgtatgacagttttgacaacacctatcaggtattttgtttttgccaatttatttgttgtctattttttgttacaagtaatattcaagatatttttaaaaaattatttacttgcagttgtggatgtaaaagtactttctataatctgtaaaatgctgtataaatacaatgtgtaaatgattttgtccagtcctaggataaacttttatcatttgatttcttttgtctcttccaaagtctgttgaaatatatctccaatatcatctaggatggcattagaagtaatggtggatattctctatagattttgtccaagcctaggattctgtgacattttttatctacatttgaaattaagaataaatgaataatgaaattagaaatcattaacagaaggatatttggcacattcacaaatatgtgaaaattaaataatacactcctaaataattaatgtcaaagatgaaatcacaagagaaattagaaaatgctttgagatcaataaaaaagaaaacacagcacaccaaaacttatggtatacaactaaagcagtgctatacaaaaaagaaaagagatactaaataaatagcctaacattctactttaagaaactggaagaaaactaaacccaaagcgacagaaggaagaagctattttaaaatttaggttttatcattattcctgtatggtgaggccaatagatcaggagatgattgccattgaaaagatagtttgttatactcacagatcccaagagaagagggcatgccatgccagagggggccacatggggaagcactgggtcagttaaaaggcaggtggctggggaaatgtggacaaaagccttgattgtggttttcagggaagaggcacacaagacagggtaagcaggtttaggattagctagttcggataatttcaggggttctggggttgaggggctgttcctggttgtctagtacctggcccgggtgattagggcagtgtagtattggccctcagtgtcatagaggaggtgctggggtattggctttggattggttggtttgcctatgaaaggagtactcaaaggtgagtttactatctctaatgaaaaagctaatcctggcaggggcagtccctccagtgtcagcaaggaccctgatgtcaaaacatcaaaactatagaaagtaaaaagacatgcttaatacagaagttaataaaggttaaagcagaaatatatgaaagagagagcagaaaaacaatggaggaaatcaatgaaaccaaaagcagttctttgaaaagataaaaaaattgactaactttagctagactgaccaagaaaaaaaagaagactcaagttctgaaatcagaaaagagggaatattaccaccaaccatacagaaataaaaagggttgactgggcgcagtggctcatgcctgtaatcccagcactttgggaggctgaggtgggtggatcacctgaggtcaggagtacaagaccagcttggccaatatggcaaaactccatctctactaagaatacaaaaattagccaggcataatggtgggcgcctgtaatcccagctacttgggtggctgagccaggagaatcgcttgaacccaggaggcggaggttgcaatgagctgagatcataccactgcattccagcctgggtgacagagtgagactccatctcaaaaataaaataaaatcaaaagggttataatggaatggtgtgaacaattaaatgctaactaattagatgacaggtaaaatggacaaattccaagaaagacacagtttactaaaactatctcaagaagaaatagaaaatcggaatatatatctaataagtagagagaattagtaataaaaaaaactgcccacatagaaaatcccagcatcagataatttcattggtcaattctatgaaacatttagagaacaacaccaatactttgtaaaactcttctgaaaaatagaagaggacccacctcattctgtgaggtcagttactctaatattcaacccagacagagatatcaaaattaaactacagaccaatatcccctatgaatatagacacaaaaattgtcaacaaaatacaaccaaactgaatccagcaacatgttaaaaaagatatacactattatttttatttcatttattattattattattattattattattattattattattattatttaaacaaagacagatttgctatgttgcccaggctggtattgaactcctgggcccaagcaaccctttcacctcggctttccaaagtgctgggattacaggcatgagccaccacacctgacctatgtgtcatttaacaagtggaatatacaaaaagcaataaacataatacattatttgaataaaataaaggacaaaatcacatgatcatttgaatgtacacataaaaagcatttgacaaaatccagcagcgtttcatgataaaaacatacaacaacaagctaggaatagaaggaaacttcaaaatggtaatgagcatccataaaaatgccacatcttatatacttaatgtgaaaggctgaacgctttctaagatcaggaacaagtaaggatgtctgccctcacaacctacacagtttcaataccaaaaatcaaagaacaaactaaaaggaataaattagtaatcttaagagcaagtactttgagacactaagcacactgtaaatctttaccatgttaactctttaaaattttttttattaccactacttttcagttatgaaatgtttttgtgaaacaattggggagcatagatttaaactgccttgttaaatgaattaaaaaaattttaagttaaaaaaagaaaacaagttactcttaatttacttatccattttatatgtattgtagttagcataaaaacttgatttcatttgtcattctatagattaaagaaaaaaacttgatttcaattgctttgtctttgtaatatagcaaatgttaatctgattaaggctgtcactcattaactgctgctgtcttgattattaaaccatttttatttttcagaaacctttttagggtaatcttaaaatctaaatcctcttagtatgtatttttccacatttgaagtatttatttcaggaatatggcttctgaattgaatcttcctgaaaaacaaaaacatgggcatttcttttttaggaaagctatgtaatgagccttagagttggaagcacctttatttatgtcttagttctaccatttagtagttggatgggtttggatcaattattaaatttttcagaatccatattttcacatctgtaaagtgagaatcataatccctatggatggtgactccattcttttttgggggaaaaaaaagttctttttttttttttccaagagatagagtattgctttgtcgcccaggctggagtgcagtggcatgatcatagctcattgtcaccttgaattcttgagctaatgggtttctcctgcctcagcctcctaagtagctgggactacaggtacacgccaccactcccagctaattaaaaaaaattttttttgtacagatgggtttttgccatcttgcctaagtcttgtactcaggctcaggagatcctcctgcctcagcctctcaaagtgctgggattacagggatgagccagcatgcctggccaaaagctctattcttttgtgattattaccatttaccattgagaacaacattgattgttttatttctttctttgaatactttagcacttcttttcatagtagtcctcttcattataacctgtcagcattttagacaactataatgttcacatagacaatctgctagcctcctgtacttttcgtttccataatctcagaccttctctgaaaatcatgtattctcttctcagaccacagtcttgtatccttccaatttttttattcaggtacttttactataatagtttctactccggtggttcacatcaaaaccttcaacccattaattcctccatgttatttttattttattttttcattttttaaaaataatttttcttctaatttttttttttttaagacagggtttcactctgtcacccaggctggagtgcagtggtgtgatcttgactcactgcagcctccatccccccaggctcaagcgattctcccacctcagcctcctgagtagctggaactacaggtgtgcaccactatgcctttttttttttttttttttttttttttgagacagagtctcactctgtcacccaggctggaatgcagtggcacaatctcggctcactgcaagctccgcctcccaggttcacgccattctcctgcctcagcctcccatgtagatgggactgcaggcacctgccaccacgcctggctaattttttgtatttttagtagagacagggtttcactgtgctagccaggatggtctcgatctcctgacctcgtgatccacccgcctctgcctctcaaagtgctgggattacaggcgtgagccactgtgcctgggcttttttttttttttttgagacggagtcttgctctgtcgcccaggctagagtgcagtggctcaatcttggcttactacaacctctgcctcctgggttcaagcgattctcctgcctcagcctcccgaatagctgggactacacatgcgcaccaccacacctggctaatttttgtatttttactagagacggggtttcaccatattggccaggctggtctcaaactcctgaccttgtgatctgcccacctctgccttccaaagtgctgggattacagatgtgagccaccatgcccggccttttttgtgtttttaatagagacaggttcttgccatgttgcccagactgatgacaaactcctgagctcaagcaatccggctgcctcggcctcctaaagtgctgggattattggcatgagccaccgcgcctggcccttccatgttgtttttaaacatctggtcctgtgtcttctgtcttacctttctccttttttagcttagactccatgggaaattctttaactttctagcctcttgatatggtttggctatgtccccacccaaatctcatcttgaattgtaactcccacaattcccacatgttgtgggagagatccagtggaagataattgaatcattgggggtggtttcccacatactgttctcgtggtaatgaataagtcttacgagatctgatggtttcataaagggaaacccttttcgcttgcttctgattctctgttgttgcctccatgtaagaagtacctttcgccttccactatgattgtgaggcctccccagccatgtggaactgcaagtccattaaacctccttttctttataaattacccagtctcgggcatgtctttatcggcagcgccaaaacagactaatacacttctctttggttcaatcacatatgcttgacaaaattcgtgttatgaacccagtcatctcatttctcctcattggttcttgaatacattaatgttgctagtgtcaactaggttatcagtttaccaagcactttttggagtaactatttcatactaactctgtactcctcaaaagctaactttaccacttttaccactcttctttgacccttactttgaagaccttgcttcttagagaaatggaaagtataaggcaggaatgcccttatttatttttcttaccacatcatctaagtacatgtaacagtatttgtactaatcctctttcattccagtatactgcagtaaatgccctcctcctatcaaaagccaatccctaactgtgctaaagcttatcttctctggcatttgtcattctcaacatcttcattattctttatttcctggagtttttgttatatatcaggcactattctgcatcctgggtatatagcatactgcagtgaacaaatcaaccaaccttactctcatggaacttctagtggggagaagttggacatttaacagttaatcaaataatttattaatctagtcaaaagtgctgtaaagaaatacatttaggaggccaggcgcagtggctcacgcctgtaatcccagcacttcgggaggccaaggcgggcggatcacaaggtctggagatcgacaccatgttggctaacacggtgaaaccccgtctctactaaaaatacaaaaaattagccgggcctggtgtcgggcgcctgtagtcccagctattcaggaggctgaggcaggagaatggcgtgaaccccgggaggcggaggttgcggtgagctgagattgagccactgcactccagcctgggtgacagagcgagactccgtctcaaaaaaaaaaaaaaaaaaacgaaatgcatttaggaaaacatgatcttagcatgataatgattgtggcctttatagtactacctagctgcataatttgtaagtcacaatttgctattttcagagaaggaagagagtactgttcttgacttatatactataaaatttacttttagtcagtttgtgatgttgcctatgtatatcaacaaatgtactttgatgttcgaactaatatattctcaagtgaatgtttttgtcatggaagagaaaatgaagtgttcagtgggatatctttttctttgcttttggagtcaccttttgaattgctgttgttttacatgctttacatagctgttcttgagtgtgaactttctgcagcctatatgcagtaatcccatattaaggcaaagtgaatgagaaatgcataagcgtttatatggaatttgagaaacagttcaattttttctttaaaaacctatttgttagaaatatttgctgtacaggaattgacatacataaagtttgtggtgttttatttatgtaactaaaaaaaatcttatatattgaaatgcagggtactggtttacagtatatagatatgtgggtaggagtggtgagagtcattttcttagcctttattgagtatcttatctaaaaatattgacatcgtaccataatatcttttattgtccttttcctggtttttttctctcatactactctctaacatactattttacttaattagcttattgtttgtcttagcagactgtaacctttgcaagggcatagattcttgtctgctttttattcttttaccacaggattctcagctgctaatgatggtgcctagtaggcaatcaataaatatttctttcggccaggcgcagtggctcatggctgtaatcccagcactttgggaggccgaggtgggcagatcacttgaggtcaggagttcgagaccagcctggccaacatatagtgaaaccccgtctctactaaaaaatacaaaaattaactgagtgtggtggtgcacacctgtagtctcagctgcttgggaagctgaggcaggacaattgcttgaacctaggaggcggaggttgcagtgagccaagatcaccccactgcactccagcctgggtgacagagcaagactctgtctctcaaaataaataaataaaataaaataaaataagtaaaataaatctttctttttttcccccccagtatttggaaggaatagagttcaataaatattcctgatgaatgtggacaggtgtacatgatttttaaatgtgttccgtccaatttgggtagagactaactgcatgtttgttcatcactctagtaccttacacagtacttgcaagtacgtgcttaataaatatttgatgagcaagctgggcacattggctcatgcctataatcctggcactttgggaggccgaggtcggggggaatcacttgaggccaggagttcgagaccagcctgtccaacatgacaaaaccccatctctactaaaaatacaaaaagtagctgggcttggtggtgaatgcctgtaatcccagctacttgagaggctgaggcactaaaattgcttgaacccaggaggcagaaattgcggtgagccgagatcacgccactgcactccagcctgggcgactgagcgagactctgtctctaaataaataaataaataaataatcgatgaacgaataaatgagaactaaatggggcaatgtgtataaatcggcacttagtagataatcaatttatgtaatttactgtagctttcattcttgaatatatgtaaaaacatgtaaagacttatcaacattgcattgatttttcatataaagatattatctttaggcagggtgtagtggctcatgcctatagtcccagcgtgttggaaggccaagtggggaagatctcttgaacctaggggttccagactagcctggacaacatggcaaaaccctgtctctataaaaaaatacagaaattagtggggcatggtggcatgcacctgtagtcccagctactcgagaggattgcttgagccaggaggttgaggctgcactgagacaaaatcacacccctatataccagcttgggcaagagtgtgagactgtctcaaaaaaaaaaaaaaaaaaaaaaaatatatatatatatatatatatatatatatatatatatacacacacacatatatatttgaattttatttacggaagcatcagaaaagaataaaatacttaggaacaaatttaacaaacagcataagactatacaaaacactgctgggagaaattaaaggagacacatgtattagtttgttctcatgctgctaataaagagataacccaagactgggtaatttataaaggaaagaggtttaatagactcaagttccacatggctggggaggcctcaggaaacttacaatcatggcagaaggggaagcaaacatgtccttcttcacatggcagcaacaaggagaagcacagagcaaagagaggggaaatccttttataaaaccatcagatctcgtgagaactcaactatgacacacacaaaattctatttttctgctaacagaaataaaatccccaactgatggaccacttttctgatctagtttttgattgttttttaggaacttaaaattcttagtgactcatattttaaaatgcacagactcagtttctgttttaaggaatatggcacaaagatatttagggaaaaagtatgtatgtacacgcacatatatacatagtatatgtgcacacaaacattaatgaggtggtaaaacttctaaaatagagtccatatcaacatcctctttctggagtctgtctttcttccattctttttatttatctcccctaattaatactggactgttttttaacttgtatactttttttcctttcttttttgtagtctgccttctttctattctcttattatttcaccattttctcttgatagggaaaacagcagccaggcaatagaactttacatttgttttcaccacagaaggaagctatcattgtgtggtacagaggaaaacttgttttccttacctaatgacttttattttatattggaaaaatcatgtctcttatggaaagttatgatgtttgtgagtctctggctgtctatggcattaggacagttgacaatatatcaacagtattttataaaactgctcttggggcagatacttaccattctgagtggagaacaatcagatactcaaactaaagttcaaatacaaatatttaaaccaaagttgccattgtcttgttatttgtaaaatgagaaaagtagggatgagaataagctacctggcaggaatgtataaagattagagatgatcatgtaaaaggcttaaaacaatctctgatatgaagcaagtgctgaatacatgaaaatcattatcactggaaattttgtttgtccttaattgtccttaattgactatgttgtattgatttgtttattcattatttcttccacaatcatgaatcccatttgaatcctaaactgctggccaccattaaacttattatttgttaacttctttgttttgttttacaggcaacaattggcattgactttttatcaaaaactatgtacttggaggatcgaacagtgagtaatattttcagtgtgcaattttctgcaacattccaggttagaaaactgcaatcaaagttatcaatgattgtcaccataagaagtacttagcaaagttaccaaagatagtttacagttgttgagaaaaactcttattaccgagtgagtagtacttggcagtcatcttgatttggaaaaatgaaaacaaagagctttacagagaattaaaggagaatttttatgaagaaattaaacctgctaaagaccttctaaatgccacccttgaggcattcaaaaagatttcaatttgtgaacttcaagattttttttgtcaggataggatgcgtatcaaagtgactgacaaaaaagaagttatgtgggcagggtgcggtggctcacacctgtaatcccagcactttgggaggctgaggcaggtggatcatctgaggtcaggagtttgagaccagcttggccaacatgatgaaaccccatctctattaaaaatacaaaaaattagccaggcgtggtggcgggcgcctataatcccagctacttgggaggctgaggcaggagaatcgcttgaatccaggatgcagaggttgcagtgagctgagattgcgccattgcactctagcctgggcaacaagagcgaaactccgttgcaaaaaaaaaaaaaaaaagtaatgtgtatttatttgttggatttttgtctttcatcctttggaatgttttctttaaatacagtgtaaaatctgtattctagcccactaccccttgaagagatacttgtcacctaaacagtgaatatcttaaatgcagtactttgagacctgcacccaaaaacattatttaatttccagtgttatttcttaggtgttttttttttcctgaatattctcttttatgttttgatatatagcatgtcatttcttaaaatttgaaagcggccaggtgtggtggctcacgcctgtaatcccagcactttgggaggccaggatggacagatcacctgaggtcaggagttgaagaccagcctggccaacatggcgaaaccccatcttttctaaaaatacaaaaattagctgggcgtggtggcgggcgcctgtaatcccagctactcgggaggctgaggcaggagaatcgtttgaacccgggaggcagaggttgcagtgagccgagatcacaccactgcacttcagcctgagcgacaagaatgagagtctgtctaaaaaaaaaaaaaaaaatttgaaagcttggaaacgactttatcatgatgcaagaacttgatacttgttttcaggcttctcttcctgtaatatagatatggatagtacgtaaagacatttttatgtagggctgcaaaaagatcttcctcctttttgttacattatacacacacacgcgtgcatgcgtgcgcgcacacactcgcatgttctggggaaaatgtatgggagaaatacaagcacggtagttaaaaaacaggtttgaaagtattctagacccaataggaaagagacacattttagcttgagagaagctttcaaagaagcattaattcctttactctgatagcttaggctgctcattgacatttaccttaggtttttttgttttgttttgtttttttctctatttaaccatcaacagtctactttttgccacttgaaaggcatagggattcaaacaggttttaggtagggaaaaagggaagccatatttctgattctgtgaaatttttcccagtggcattttccagtcatttatgtttggagtatgcaaatttttaatatttctcccttttgaaaaaggagttttgtgttattttcattcctcactccctgcaacctcttgcatgagtcttctttctacttccttcccaccctctcccttttacaaaaaacattgtttcttttttctttttagtattagtttggtttttttttttttatttattttttcccatctcacagatcaggcttcagctgtgggatactgcgggtcaggaacgtttccgtagcctcattcccagttacatccgtgattctgctgcagctgtagtagtttacgatatcacaagtaggtatattgcaacgggttgacctttcttatttttcttgcttgtttgactgattttgttgttaggtacgattgcaattatgggacacagcaggtcaagagcggttcaggagcttgattcctagctacattcgtgactccactgtggcagttgttgtttatgatatcacaagtgagtggagggaattatgcatttctaatcttctttcaacctttagcttagctgcatgcatgttcttgtcttgtgcttgttttccttactggcatgtaaaaataagttttatcatagtaaattacataccagccaggtcagaaatatttgctttggtgtttataccaatatgctttatatgtaactgtgccaggttttttgccccagaaattttcttttgggtccaactatgaatcctcttcaagggtttcttagtatcctgttattcgtaaaccataccataattatagttggaggaatgtttccttgatctcagatttctctaaaataaaatgatctgcatttaagtctcttgccaggttttccaaatcctccaagctttctattgaggctattacaagcttctgctagccagcttttctctgctttccccttccagccattctctctctgtagaggaagacagagaaaacataatgtacagttttctattaatcttttttatttgaatcatattttggttctgtgactgatttatttactttgttgctaacaaattacactttcatttctctccaagaaaaaaattttaaataggaggtgaaacaactagtagtctttttcttttttctaaagattgaataatgcctgtggccttttaagtgattgtaaattttccatgaagcattggtgactgacaagaaaatgctttctgattgaaattgcctttgtaaattggtttatgacatatattaggcaatattaaacattattacatgtagtggttcataacttataggaaaaccagggtcttgaactcctgggttcaagtgatcctcctgcctcagccttctaaagtgctaggtttaggccgggcacagtggctcacgccggaaatccccatattttgggtggccaaggcaggcggatcacctgaggtcaggagtttgagaccagcctgaccaacgtgatgaaactccatctctactaaaaatgcaaaattagccaggtgtggtggtgcatgcctgtaatcccagctacttgagagactgaggcaggaaaacctcttgaacctgggaggcggaggttgcagtgagccaagaccgtgccattgcactccagcctgggcaacaagaacaaaactctgtctcaactacaacaacaacaacaaaaactaaagtgctagggttacaggcatgaaccattgtgcccagcccagtatctggggctttctttttaaatttttaaaaaatgtgtaccacactacacagatgtagtatcttgggctaaaaaaaatcttaaatagacaaaggaactattcatttggactagtaatactgttactatgcattcttgcatatctcctcaattaggaattgttatctaataacgaataattgtgctggcaaaattagaagattgcattcaaggactttttttgagataggtgctatatgcagtctttcttcctttgcacctttactttgggttgctgtttgtttaaaaaaaagaggtatgttcatattgtgcattgacacgttttgtagctttaaaatgtttgtgcttactttaaccacagcaagtgaaacctggtgtatttttttttaaatccacaaatgtgattcaaatattagtacgttgttttctttagctgctgtaagaagtgttgaagtactctacttagaatccaacactagaaaagataaattttgttacaagtgtttctgatgcattaaacaaataaactttaggttaaagtgatcacaaactgaggaagcagtgcaaacagtggtgttgaaagctattgaaaggctttacagattttctggatgtgttgggacttactggctgacatactttggaaaatgctttctttgtcatgtttggtatgtgtaagtgatcaaaaaagcattgtggcaatgtgacaccatattatctgccatagctgtccttatatttcaaaaagttgtttttttttcaattaaatactacattgtactcatttgatcatgttcaaaaaatttttaaactactctaaaaggaaccttgaagattttattcttgtaatttgtttaaattgctgacagttgtaatcagataaaatggagttatgttgcaggcacattaaaagtggggtactaatgtgccagcccccttccaacttccagggcttttttggagggaggtgcccaccacctggggaggcatttttcagcaacactaatctctctgtctaccctcctatactagatgttaactcattccagcaaactacaaagtggattgatgatgtcagaacagaaagaggaagtgatgttatcatcatgctagtaggaaataaaacagatcttgctgacaagaggtatggagttattttatatgtgtgtaatgtttgatttctgtgatgcagccttttatttttgttcactgagaaattgttttgaaaggagacatgcttaatccttaagtttacgtcctcccctgcttttctttagcatgggaacctcaaatataaatgtaaatattaaacacccagtccttaagggaaatgaattttattttgtttaagcccatgtgtaaataactcttgtgcaagtttgtttagacatgaagccagtaaatattttgctttttttagatctcataagtatgaaaagtgttttgttaaagagcaagccattttggaaaaaccttatctttaaaaattgttcataatgattaaatgcacactcttttcttagtagtcttcttataaaacattcattataattcagtggtgtggatttttgttttttggttgttggtttttaattgtgtggctgagccagactgtgtagttgcactgaatagcttgattgtgataccttagtcaaatgagcaaagcgatattcaagtcacaggatgcaaaatatattaacattcactgtaggacccatggcttgaatatttgctttcagcattcttaagcgatttactgcatattctttctgctttaaatagttttgaccatactacttaatagtaagagcttttactatttatttgtttattcatgagatggatattgaaattcgggtaatgaacttgtgatattaattcaagtgttgcaaagaaagccagtgttaaaagacttgtggagatatgaagcccatttctgcacatggcacctcagttagaattggtagtacaggccgggtgcggtggctcacaactgtaatcccagcactttgggaggccaaggacggtggaacacgaggtcaggagttcaagaccagcctggccaagatggtgaaatcccgtctctactaaaaatacaaaattagctgggcgctgtggcatgcacctgtaatcccagctactcgggaggctgaggcaggagaactgcttgaaccaggggagcggaggttgcagtgagctgaaattgtgccattgcactccagcctgggcaacagagtgagactccgtctcaaaaaaaaaagaattggtagtacagttgcaaaaaagtctttcttaatttaaaagtaaattcaaagtgattgcatcttttctttataaaaatatgttttggacatgaactgctatgaaggaaattttcactattttatttatcctcactctagagactttgtaggtacttttctttttttgggatggagtctcattccgtcgcccaggctggaatgcagtggtgtgatctcagctcattacaacctccaccacctgggttcaagcgattcttctgcctcagcctcctgagtagctgggattacaggcgcctgccaccatgtcctgcaaatttttgtatttttagtagagacggggtttcaccatgttggccaggctgatcttgaactcctgacctcgtgatccacccgcctcagcctcccaaagtgccaggcgtgagccaccgcgccctgccagtacctttattttatttatttatttatttttgagttggagtctcgcattgtcacctgggttggagtgccatggcgcgatctcggctcactgcaacctctgcctcccaggctcaagcaattctcctgcctcagcctcccgagtagctgggattactgatgcctgccaccatgcccggctcatttttttgtatttttagtagagacgaggtttcactatgttggccaggctggtctcaaactcctgaccttgtgatccgcctgccttggccttccaaagtgctgggattacaggcgtgagtcaccgcgcccggcctcttcatttttaaatagaaaaattgtatatctgaattgtttccctttatagccagagttatctgaggaggatgcttataaggatttttttattgcttaatatttcagttgtgtgcacaaatggtagaaacttgtcaaattatatgtgtgtatatatatatatatatatattttttttttttttttttgagatggagttctgctcttgttgcttaggctggagtacaatggcacaatcttggctaactgcaacctcagtctcccaggcttaagtgattctcctgcctcagcctcccgagtagctggaattacaagagcttgccaccacatctggctaatttttgtattttttagtagtgacggagttttcccatgttggccaggctggtctcgaactcctgacctcaggtgatccacccgcctcggcttcccaaagtgttgggattgcaggcatgagccaacaagccctatctgaaattatatttataataatttttctttaaggtaacatttgtcagttgcgttgaaattaccatctttcttggtaatctttgccagactatcatctctcaactgttcacatttaaaagaattacagcttgttcgttccactaaaatgattttcaaatgggtaaaagacttaattttttaaagcatctttatattttgggcttttataagcatgacatgaaatcctgaagccataaagggaatgattgataagtttgaatacatagagagcatattctcctattagattgactatgattcagaagatttaaatgcacacagtattttcttttttttttttttttgagacggagtctcgctgtctcccagcctggagtgcagtggcgcaatcttggctcactgcaagctccccctcccgggttcacgccattctcctgcctcagcctcctgagtagctgggactaggcacccgccagcatgcccggctaattttttgtgtttttagtagagacggggtttcaccgtgttagccaggatggtcttgatctcctgacctcgtgatccacctgccttggtctcccaaagtgctgggattacaggcgtgagccaccacacccagccctgaaagccaaatgaaaataaatgttttaaggagaagacagttattaactatgccaaatgctctgtaagatcaaaccaaatgaagactgagaattaaccattggatttagaagtttggaggttattaatgttgttgacaagtagtcacactgaagtggtggggttgaaaatctcactacagtaggttcaagacagaatacccctctcacctctgaagttataagataagatgaacaagatgaccctatttatattaataatagtaaaagaaaaatctggccagcgtggtggctcacacctcccagcactttggcaatccgaggcaggcagatcacttgatgccaggagttcgagaccagcctggccaacatagcgaaaccctgtctctactaaaaatataaaaattagccaggtgaagtggcacatgcctgtaatcccagctacttgggtggctgagacatgagaatcacttgatcccaggagggagaggtcagtgatctgagatcgtgtcactgcaccccagcatgggtgacagagtgaaactgtcaaaaaaaaaaaaaagcctctataattaaagcaatgtggtcttgctgcatgaaaagttatggaaaagtagaacagagtagaaaagctagcaacaggcgagcgtggtggctcatgcctgtagtcccagcactttgggaggccaaggcaggtggattacctgaggtcaggagtttgagaacagcctggccaacctagtgaaacctcgtctctactaaaaatacaaaaattagccgggcgtggtggcatgtgcctgtaatcccagctcctcaggaggctgaggcaggagaattgcttgagcccaggaggtggaggttgccgtgagctgtgattgtgccactgcactccagcctggctaacagagtgagactgtctcaaaaaaaaaaaaagaaaagctaggaacagacccagtttcatatggaaaataagtatgaaggtggtacctcaaatcactggggaaaatgaactatgtaataaattgattggagtaactggttaagtgtatagaaaagataaaattggatcaagttctcatattacactaggacaaattctaaagggattagagatttaattgtgaaaataaaataaggactaactgaattctggttcttaatgatactaatgctatggcacaaaataagggaaaatgtaaagtttgattacttaaaacattataaacaaagcaaatggcaaactagggaaaagtatttgtaaatcgtatcaaaaatggctaatatcccaaataaaaaagcctctaaaaatagagaagaaaaaagataaacatcactatagaaaaattgactagaaatatgaacggttcatggagaaagtaacatagctcttaattatctgaaaagaagctctgtcttgctcttactgaagtactgattgaaactgcactgagaaatacttttgcctcagattcagactgccagaattccaagtttgttgaaatcttctgatagcaaggctataaggaaaacagttactctcataaattactgaggcaatgcagaatggtaatactcctatggaggagagagagttgatttttggcaatatctaatatcgacatttagcctttgacctggaaatcccacttctaggaatctcctcaagatacactggtaagagtacaaaaagacatatgtacaagtctatttcctatagcactatttgtaatacctagcactatttgtaatatctaaagactgtaaacaacgcaggtgcccacaaaaggaaaatggtttgacaaacttacgaacatccttttaaaggagtactagacaggtacaaaaaggaatgaagaatgtatatattactatggagtgaatcttcagggtatatgactaagtgaaaaaatgcaaggtgaagtagtatgtaacatatggtacagtttacttaagagagaaatacagatgtatatacacattacctaaagcaaaatgaggaccctactgggctgccatcccagctggactgctgctgtggagctcagcatcaagtacttccaggagaagcttcagcaggacctagaggcagagcatggtagaggtagaggatacagccctcataccaccgtgctgtatgtccatctttcaagtcctggtggtgcccgcagagtttgaagggaagccactgcttcagagataccaggtggtaaatgcatgcctagtggaagtgtgctcctctgcatctatgcctttgagcagaaagcctttgagtcccaattagctgggcccatgagtggccaaaatgagggactgggacctgtatagccgttaaactataaatcagggccaaaaaggaaagataaattataagtttaaagaaaatgggctaggcatggtgacttacacctctattcccaaaggaagctgaggcagaaggatcatttgaggtcaggagttcgaggttacagtgagctacaatcctgccaccgcacttatatgtgcaacagagcaagaccttgtctcaaaaaaaaaaaaaaattaactttttttttttcaagactgagtctctctctgttgcccaggctggagtgcaatagcacaacctcggctcactgcaacccccacttcctgggtttaagtgattctcctgcttcagcctcctgagtagctgggactacagggatgcaccgccacacccagctaattttcatatttttagtagagatggggttttatcatgttggccaggctggtcttgaactctgacctcaaatgatccacccgccttggcctcccaaagtgctgggattacaggtgtgagccaccacacccggctagatcttaactgtttttagtaaacatgttggtgatgatgttggatattgttatttcaaaatgattgtctgtattctgcataaaataaatgaatactttgcttaatgattgtctgagaactggcattttggacacgggagatggaaatacagatataagattaataaagttaaatataaaaaatataagcatgggggccgggcgcggtggctcacgcctgtaatcccagcactttgggaggccaaggcgggtggatcacgaggtccggagatcgagaccatcctggctaacacggtgaaaccccgtctctgctaaaaaaaaaaaaacacaaaaaattagccgggtgtggtggcgggagcctgtaatcccagctactccggaggttgaggcgggagaatggcgtgaacctgggaggtggagcttgcagtgagccgagatcgtgccacttcactccagtctgggcgacagagcaagactccgtctcaaaaaaaaaaaaaaatatatatatatgtgtgtgtgtgtgtatgtatatatatgtgtatatatatgtatatatgtgtgtgtatatatatgtatatatgtatgtatatgtgtatatatgtatatatgtatatatatgtgtatatatgtatatatatgcatgaattcattacattttttagcatttgaaaatttttaatattttctagctctgtctactgaaaagatttaaaccaggaggaatgagcccacattaccacatgtaaatacggtttctttccaaaggaaccagggctacttgaagaagtgacaaattaggcatctgggccagaaaatgtaaacagtggggctggaacatgtcataccataaatcaaagaagttattaaagaccattgaggttatgtcagattcaggagagccaactcaaagaagctctactggtcaaactgtaggaaaacttgaaaatcagtaattactataaaacatgtttaaatccacgagtcataataataataataataataataataataataataataatatacttaaggagaaaactcattggtcccctttggaagatgccagagactgactcgagcatttatcctcctttcctctccctccctccgtcactccctccctccttgttctaagtacctcaggataaccaaataattgagaaagtttctttctaaagaagtatttaatttgctataaaggacattggaataactggcagtaaaggacattattgggataattgacaagaataaaacctatagattcaatgatggtatgatgttgatgttaattcccagatttaataattgtactgtggttatataagagaatgtccttgtttttaggaaattcacactgctgaagtatttagggctaaaggtctgcagattggcggtttactctcaaacagttttttaaaagtgtttcagaaaatttatatacacagagagaatgagaagataacacaagcaaatgtaaaatcttaacagttggagtgttatgtaagagaatgttcttgtttttagggagtggagaattctagaataataatttcttgtaggcaagaagggagtgggatctaatacatagatgtaagttttgagaataaggacaactctttcatagtaataggactagaggtaggatataagggcacacttgcaagtaaatggaagcttgtggaaattctcttccattgcccattttctgtgttgtaggaagcagggtttgtcagctgatagtttaaatctagctaattagaacatttgtatatttatggaatacttatctgccagcttaagcattaggaataccaatataaatgacataatcttgcacttgagatctcacaatttgagacatagtgctaattgtaatgcatcacaaaataccctgtaaaggtaatattaaagtattaatattttgtatctagaggctttaccatacatgtctttgactcacttacttcacttacagaaatccacaaaatcggctgggcacggtggctcacgcctctaatcccagcactttggtaggctgagatgggtggatcacctgaggtcaggagtttgagaccagcctggccaacatggtgaaactctgtctctactaaaaatacaaaaattattcaggtgtggtggtgggcgcctataatcccagctgctcaggaggctgaggcaggagaatcgcttgaacccaggtgttggaggttgcagtgagctgagatcgcgccattgcactccagcctgggtgacaagagcaaaactgtctcaaaaaaaagaaaaccacaaaatctaacctaaggaaatgatttgcagtgcacaaaatattaagcacagatatttagggcaacaattttcatagtagtgtaaaattggaaagcaacttgcattctaatagtttgggaatggttatataaattataggagcaaattgacagaaattgtctagccataaaaattgttttacacaaagatttgaattttaaggctaaaagcctgtggtctgatattaagggaaagaggcaagctattaagcgttttttgttttgttttgtttttagctttttctttttttgagacaggttctgttgcccagactggagtgcagtgatgtggtggcctaataatggcctgctgcagcctcaacattcctgggctcgagcatcctcaagctattaagtttgtaaaagtaaaaaaattacaggatgagcccagtcaagtgaaagcaaatcagtaacaaaaaaaagtctttaaaaaaatgttaagtatacacacacagaaacacacaaatttcaagagtgtggcagattaatgaatttttaaactaatgtgacctgtataaccagtccttatatcaaggaaagttattttcagagctttctttataatctttataatactgcctcatgtctcaaaagtaagaagtttgtttgtttctttacaggcaagtgtcaattgaggagggagagaggaaagccaaagagctgaatgttatgtttattgaaactagtgcaaaagctggatacaatgtaaagcaggtaagttgagttgaggttaccaaattgaaaaaatatgaaataattgtgtgagtattctattctctggtgtataggtttccttccacctggcaagagcaggccttacaaactagcagtatattttcaaacagtgaaaaatataaatgtggcatagtttttggaaaaagagaaaagacttgcaaacttcagatcgtggatagaactactgcaaagtggtaaatctaccatattgtcactacattcctactacattgctttaaaggtaaattttcttttctttttttttttttttttcttttttgagatggagtttcgctcttgttgccgaggcttgaatgcaatggcgtgatctcggctcactgcaacctccacctcctgggttcaagcagctctcctgcctcagcctctcgggtagctgggattactggcatgcgccaccatgcccagctaattttgtatttttagtagagatggggtttttttcatgttggtcaggctggtctcaaactcctgacctcaggtgatccgcctgccttggcctcccaaagtgctgggacaggtgtgagccaccatgcccggccggtaaattttatttcagagtttgatgccaagactgagataaatgaaagcaagtatttactgtcagtaatggtgttccacttcttgttgtaaaagtaaattctggttactttatccttaataaaatgctggtgtttgaacagtgtttacaacaggtctttttgggggagggcaggaaaatatagggagatgtcacattatcaagccattttctacaagataggtcagccagagactcacatgcttaactcttcaaggctgtatatcatgtagggtagtggtcccagatttataagatttatggaccaataattttttttttttttgagatggagtcttgctctgtcgcccaggctggagtgcagtggcgcggtctcggctcactgcaagcttcacctcccaggttcacgccattctcctacctcagcctcccgagtagctgggactacaggtgcctgcatcacgcctggctaatgtcttgtatttttagtagagacggggtttcactgtgttagccaggatggtctcaatctcctgacctcgtgatctgcctgcctcagcctcccaaagtgctgggattacaggtgtgagccaccgcgcccggcctagaccaataattttcttaattgagggtgatcaacagagggtaacagtaacatcatttaaatagttaaagctttaggaagaagtctttatattgtttttatattttttaatttatttccctccatgccttgaatcataatgtaagtaatattgaatgatcactgattctttcctcattaacatattgtttcatggtcatggtttgatacctgtgctcatgcttttgtttcctttgcttagaatgttcattttttttccctttcctaattgtactccttataagtttcagtttagatgtcagctcctcagcaacattttctctgacatttcccatcctacctcctgtctgtgacacctgattctcttatgtgttttcaccgacctgatctcagcaaaaacagtatcattacttaccatagtatattgaaaatctctctctctctctctctctctctctctctctctcatcggaattatatattcccagaacctagcaatgtgtatggaacgtagtaagtgatacgtaactgaacccataggagccacagacagttaaataatttgtgtaataccattatattagccatatgccactattctaagacaaagcagtgggtagcttcatctggctttctcttttctatttcttatatatattttctcttatatttatttatttttttatttgagacagggtcttgctgtgtcagccaggctgagtgcagtggtgcaatctcggctcactgcaacctctgcctccagggttcaagtgattgtcatgcctcacactccccagtagctgggattacaggtgtgcagcaccattcccggctaatttttgtacttttagtaaagacagggtttcaccttgttggccaggcttgactcaaactcctggccttaagtgatctgcctgcctctgtctcccagagtgctggaattacaggtgtgagccaccacacccagctggctttctcttttagagacattttgataagggtgtgagctagttgcttatatatcctggtacaggctgtccttttcctggttaatagctaaagaaggcattgctgtagtcccctagccctgaccctaagtagtctcataggtttagaaactctagaattatcagatagcatacagtaagcaccactgatgtctagtatcttcataatgtttgattgcttccaattttatttttattatttttgttatttatttatttattatttattttcgagatggagtctcgctctgtcatcgaggctggagtgcagtggcgtgatctcggctcactgcaagctccgcctcccaggttcacgccattctcctgcctcagcctcccgagcagctgggactacaggcgcccaccaccacgcctggctaattttttgtatttttagtagatagggggtttcaccgtgttcaccaggatggtctcgatctcctgacctcgtgatctgcccacctcggcctcccaaagtgctgggattacaggtgtgagccactgcacccagactatttttattttttatttatttattttttttgagatggagtctcactctgtcgccaggctggagtgcagtggcacgatctcagctcactgcaacctctgcctcctgggttgaagtgattctcctgccgcagcctcccgagtagctgggactacagtcgagcgccaccatgcccagctaatttttttgtatttttagtagagacggagtttcactatgttggtcaggatggtctcgatctcctgacctcgtgatctgcctgcctcggtctcccaaattgctggaattacaggtgtgagccaccatgcctggcccttcttatttttatttttttgagttgtggtcttgctctgttgcccaggctggagtgcagtggcatgatcacagctcattgcagccttgacctctcaggctcaagtgattctcccacctcagcctccagaatagctgggactacaggcacacaccaccatgcccagctaatttttaatttttttccagagaataggttcttgccatgttgcccaggctagtcttgaactcctagactcaggtgatcctcccaacttggcctcgaagatttcgagattataggtatgagcccctctgcctggtcgatttttagtaaatttatagcattgtacaactattaccataatctgatgttagaaattttttttttttttttgagatggagtctccctctgttgcccaggctggagtgcagtggcaccacctcggctcactgcaaccttgcctcccgggttcaagcagttctcctgcctcagcctcccaaatagctgggactacaggcgcatgccaccacgcccagccaatttttgtatttttatatgatcctgacctcaagatccatccatctcggcctcccaaagtgctgggtatacaggcgtgagccacggcgcccagcccttcttacttttaatttagattgtttttgtttttgttttgggttttttttagacagtcttgctctgttgcccaggctggagtgagtggcacaatcttggctcactgcaacctccgcctccctggttcaagtgattctcatgcctcagcctcctgcctagctgggattataagtgcatgccactgtgtctagctaatttttatattttttgtagagacagggttttgccacgttggccaggctggtctgaaactcctggccttaggtgatacgcccacctcagcctttcaaagtgctgagattacaggcgtgagccactgtatctggccagaaattttttaattgtcagtttattctgcctccccactaaacaacaaactccataaatgttcattgaatgaatgataatatactttatttttttttagcagattcttagagctgcattgttttgccataaaaataagatttatttcatgtccttggttctgtcttaagaattttcttagctagactgaacaagccctagagaagccaggttacttggagaattgcccttcatttgctgttttgactacaccttagacatagatacatgttcatcttccgtttctttgcattcacctgaacccatgttgaattttttttttccaattttttttaattaggccaggcatggttgctcatgcctataatcccagcactttcggaggctgaggcaggcggatcacttgaggtcaggagttctactaaaaaattaaaaaattagctggatgtggtctcatacacctgtaatcccagctactcgggagtctgaggcaagagaatcacttgaacccaggaggcggagattgcagtgagccaaaatcacaccactgcactccagcctgggtgacagagcgagactctgtctcaagaaaaaaaaaaataataatatatataaaattgagataaacatttatgtacagtgaaatgtatacatcttaaattgactattagatgagttttggtaaatgtatttacaggtataatgaccacagcaatgaagatatggaaatatgttgttaatttcccaatgtttagggacatttctagataatcttaattgttactggcttctaatttaattctgttatagtcagagaatacactctgtaatatttcagtcatttgtaatttattgagacaagttttatggcctatcatatggtctatcttattgaatgttcttatatgtactggaaaaagaattttttttacagttatcaggtatactagttaacatgtttgacagcattctcaaaccttatatagcctggctgggcacagcggctcatgcccataatcccagcacttcaggaggtggatgtgggaggatcacttgaggccaggagttcaaaaccatcctggtcaacatagtgaaaccctgtctctacaaaagtagaaaaatttttttgaaaattagctgagcatggtggcatgcacctgtagttccagctactcaggagactgaggcagaggattgcttgagcccaggagttcaaggctgcagtgaggcatgattgcgccactgcattccagcctaagcaacagaacaagactgtctcaataaacaaaaaaacaccttatatatccttactagttttttgtccagttctgtcgataactgagaaggggatattgaaacctataacaacaacgatgtattgttcgctttgctgattagttctgtcagctgttacttcttgtattttgaagttatgttagtaagtgtatacatatttaggatcattatgtcttcattatctgttgactttttgtatgtaaagaactgtccctcgtgggctgtgtgtggttgcacaggcctgtattcccagcgcttttgggaggccaaggcaaggcaggctgatttcttgagcccagcaattgagacctgcttgggcaacatgacgaaaccctgtctctacaaaaaaacacagaaattaacccagcgtggtagtcccaactacttgggaggttgagctgggtggattgcttggcccagggggtcgaggcagcagtgagctgagatcacaccactgcactccagcctgagcaatagagcaagaccctgtctcaaaataaaaaacaaaaaacacgaaagaaaaaagaaatgtccccatatccagagttaatcattgctgtatgtacaagagtgttagtcttatacaagctgctctgctattaccaaagctaaagtctgcactgaatttataggggtaaaaattaaaatatctgataaaggaaataaaactgattatcgtgaaataatctctgatctcttctgagttcttgctatgtaggtcagtcacaattcagaagttgtgctggtattcaggactttctgaggtaaatttcacagtctagtcactgtcttggaaaacattgagaatcacagtcttacatgcctgttattaccgttgtgtgttttctcagctgtatatgtttgtaagcagaactatttttgatttttgattgtactcattttatttgacaaaatcatgcctttttaccagaagatacacagaagtctttctgtatataaggtatatatttatcagtactataggtaccatgtagttctacttttccatatacagagttgtttcctagctttctgctaatctaactggattcctcttccccatttcctcatttactagattataatgcacatcacataataaaagcttaaaaatgggctttcacagttactgttttctttttaaataattgtgagagagcttttacatcatttattatctaatcatgattcaagtgactaggctgtagcacccaagaaccttgccttaaaacagtttattttacccaataatactactttgccttcttacttaaaaatgtcctgtgcttaacccttttgctctttattttgatttaagcacttgaccctaaagtcctgcttctgtcttacagaagattgttgtcatttaaaaaataaaacaatcagtactagaactagcataaatagtaatatctaacatgatcatttgtattatatagcatatttaagtaaaatgtgtttcattccattcagtatttcataaaaagacagcctctgaaaaatagttttactccttagatttctcatccactaccctcctccccccccccccacacacacacactttttttttttttttttgagacagggtcttgctctgtcacccaggctggagtatagtggtatgaacacggctcactgcagccttgaactgctgggctcaagcaatcctcctgcctcatcagccttctaagtagctaggactacaggcccccactatcatacccagctaattatttatttttcctagagatgggtcttgctatattgcccaggcctcaagtgatccaccagccttggcctcccaaagtgttggaattacaggtgtgagccatggtgcctggcccaaattctttttttctaatgcataagtattactttgtttttgaaagtggtatggtgtttaaattgctgaagaaatgataatgataaggtgattactttagccttcacctggcttttcatctgggaattagtacattcttttagtgaagcaataagtgtgtggtgtcaccttattatatattttgtagtactgaaaaatggaaaaagaaaagaaaaactccttgatcttcaacttctaaaatcattagtacttatcataaaaagaagatttgtttgaaagagagaagactttatgagaaactagtgatagctgatgggcatcagctctaacaggtcaatgaaagcttgtgtacatactaaccatggagttgcaatgttatatgtatgggaaaattattttatattggctgaaatagtatatgtaccttatgcattggtggtgatcatatcttttcctcatcactatatctcccatgtctaccacagttggcttatagcaggtgttaatcttgggcttttgtcatgtacctaaatccataggtatcaagtgtggcacgctagaccactgtaggtactttggaaaataaaaagttatgtaaaatgtggttcctaacttcaagaaacttatgatattgttgggaagaagagtcacattctcatgaagactgtgcagtaaagaatgggtcatacatgataaattcctagcaaatgctacagacagtaagatacatcgtaattattgagaagcaaggccaggcgcagtggctcacacctctgagcctgagttgggaggcttgcttgaaagccaggtgtttgagaccagccttggcaaaaaagggaaaacttgtctctacagaataatgaaaaataaataaaaatttaaaaattacctagctctggttgagtgtctgtagtcccagctattcaggagcctgagagagcctgagatgggaccgtcacttgaccccaggagttggaggttgcagtgagctattagcacgccactgcactccagcctggatgacagagcaagacccttgattcaaaaaaattaaaaaggagagaagcaaaacgaatgctggcacaaagaggtttattgactaattgaatgatatcacatatagttagaatggttgaggaatgctttgtttaaaaaacagcattatcggcctggcgcagtggctcaaacatgtaatcccagcaccttgggaggccaaggtgggtgaatcaccggaggtcaggagttcgagaccagcctgaccaacatggtgaaactctgtctctactaaaaatacaaaaaattagctgggtgtggtggcgggcgcctgtaatcccagctactgggaaggctgaggcaggagaatcacttgaacctgggaggcggaggttggagtgacctgagattgtgccattgcattacagcctgggcgacagagcaagactccatctcaaaaaaaaaaaaaaaaaaaaatcgcaaaaaaagtatctgagctgaactgagtgtacttgatttggataggtaactggggatgcttctaggaagaagaaaaattaacatatgtatgatacaagactacctagcacacatagtgtaaatactatgccatgaacgttcacttaaaatctttcatattgccttcctagcaagcactttatatacaatatctaggtgcttagatacttgtcgaatacaagaaggaatctatgtaacaatcctacgagtcaactgctattgttggtctgattttagagagaaaatctgaagcgtagaaattatataactttcctagaattgcctaaatactatctgctagatccatttaatgtaccaagtgtttaacttaattctcacaatatccctatgaagtagataagtatattcatttcactgatatgaaaccaaagttttagaggccaagtaacttgcttaagattataacttaaactgcaatgtgagcccaggtctatttagttccaaaatctgagatcttaagccttatattctgcctctctcaaatttaacctcaccccaatttatccttttgtgtttcatatccttaacacagtaggactttattttttatttttatttatttatttttttgagagtctcactctgtcacccaggctggagtgcagtggcacaatctcggctcactgcaatctctgcctccagggttcaagtgattctcctacctcagcctactgaatagctgggattataggcatgctccacctcgcctggctaatttttgtattttttagtagagatggagttttgccatgttggccaggctggtcttgaactcctgacctcaggtgatctgcccaccttggcctcccaaagtgctggggttacaggcgtgagccaccatgcccagcccacagtaggacttcaatataactgaatggtcagaaatctatatgtataatgaatatgaactgacagagaaattatattgatcaggttttattcagtcattaattaactcagatatttgttgatcacctcctgcatgcctagttatgttataggcactggggatacaataatggaacaaaatacctaagtctgtgccattatggagcttacattctggtatggagagttagacaattagtgaaatataatccttaaggaggttatagattctatagagaaaaatgaagtaggggccaggcacagtggctcatgcctgtaatcccagtgttttgggagactgaagcaggcagatcacttgaggccaggagttcaagatcagcctggccaacatagtgaaacccgtctctactaaaaatacgaaaatcagccgagtgtggtggtgctcacctgtaatcccagctacttagaaggctgaagcacaagaatcacttgaacctgggtggtggaggttgcagtgaggcggaggttgcagtgagccgagaccatgccactgcactccagtctgggagacagagtgagactgtttcaaaaagaaaaaaaaagaaaagaaaaacagaaaaataaagtagggtaagaaggataaagaatactggtgaagggaattatgatatattgatgtcttataaaaggagggaaagcctgtctgataaggtgatatttgagcaaagaactgaaggaattgagaaagtgagccatttatacatccagggaagagcatgccaagcttcaagtgcagtgacaaattcaaaggaacttgtcatgtttaaggaatagtaaggaaattagtaaggttacactagagtgaaggaaggggcatatgataagaaaagagctcacagagatagttatggagaacagaggccttaagaccatgtgggcagtagtgaggatttggcattttattcccagtgagagaggaagccattttcatgagagatttgacaggatctcacttaaaatttaaaagtaatcaggccaggcacgatggctcatgcccggtaatcccagcaccttgggaggccaaggtgggaggactgcttgaaccctggagttcaagactagcctgggcaacatagggagagtgtgtgtctgcaaaaaaaaaaaaattctaggcatggtggtgtgttgactgtagttccagctactccagaggctgaggtgggaggattggttgagcctgggtggatgaggctgcagtgacccatgatcatgcatgggagacagagcaagaccttgtctcaagaaaggaaagaaatcactggctcttctgtaaaaaatgatctgttaagagtaattgaaaaaataaatacaagtaataaaataatctttcatttaagaaatactaccaaaattaagatggagatctagcaaaaagtcaaaagcagctgggcgtggtggctcacacctgtaatccctacaccttggggaggctgaggcgggaggatcacctgaggtcaggagttcgagaccagcctggccaacagagccaaagtctctactgaaaatacaaaaattagcttgatgtggtggtgggcgcctataatctcagctactcaggaggtcgaggcaggagaattgcctgaacccaggaggcagaggttgcagtgagccgagattgtgccactgcactccagcctgggtgatgagaacaaaattccgtctcaataaaaataaaaataaagtcaaaagtccacaaataatgaacactcatctaagaattcagttatgtataaaacactctttactcttacatttactttcataatggaattttttctgtaagttggtaaaactgagtagcttagtttgctctttgaagggtggtatttctgcctataaactacttagttaacttcataaggtaagaactggtagtcatagtgattttattttgaaatctccttctccagtgtatctctttacattaaaattatccctaaaaaaatttttagccctaaaattatggcctgaaatattcaacttgaaagtttctacagagaaccatattcagcttgtcatcatccctgaactaattactgtactagctgtcactgcaacttaaatatgtctgttgcctcctagaaattacaaataaaataccatacacctggaggtcagcgtggacttaataagtttcttagggaaagaagctgttccagcaaagatgccctagaatgtcttctagaaagtggattctcggctgggtgcagtggctcacgcctgtaatcccagtactttgggaggccaaggtgggcagattatcaggtcaggagttcaagaccagcctgaccaacatggtgaaaccccatctctactaaaaatacaaaaaaattagccagacatggtgtcacgcgcctgtaatcccagctactcaggaggctgaggcgtgagaatcacttgaacccgggaggcagaggttgcagtgagccgagattgcgccactgtattccagcctgggtgacagagcgagactccgtctcaaaaaagaaaaaaaaaaacaaaaaaactggatacttagtaaatatgaggatttttttttaagtattacaaactgtactagtctcatacttagtcatttgtgattcctaatatggcagaagcctttgttagcatatcattggcatttaagaaataggtttttcttttttttaaaccaagaagtaagtttgaatttgaaaacctttgtaaagtttttttggcccactttgggatgtcctgagttgagtttaggttagtgacactgattcttttaatctaattggagtattttggagaaagcaccaagtttgttaaatatatagattaaaactatagattaaaaaaatttggatatatttttatttttaatttttttttattttttgagacacagtcttgcgtgttgcccaggcttgagtgcagtggcacgatctcagctcactgttacctcaatctcctgggttcaagcgattctcgtgcctcagcctgccgagtagctgggattgcacgcgtgtgccaccatgcccagctaattttttgtattttttggtaaagacagagttttgccgtgttggccaggctggtctcaaactccaggcctcaagtgatctgcccaccttggcctcccagagtgctggaattataggcatgagccactgtgcctgacctggtatatttttaaattaattttctgtagagacaggatctccttattcccaggctgatctcgaacttctgggcccaagtgatcatcccatcttggcctcccaaagtgctgggattacaggcatgagccactgcacccagcctaaaatttttgtcgtaaaaaaatggattagctttttgtgtctgtcatttatgtgtaatagtattttacaaaacaaattcttcttacccaagattattagctgtttcttcacatagccctttcacagtgctttccatataaaaaatactccatttatactaggcagcttaggtattataaaaaatacgagctttggaatctcagctctgccatttatttggtctatggcaaattctttagccttagatttgtttaaaatggggttattaacattttcctcacaaataagaggattaaaatgagaaaatacgtaaacattccaacagagtaagtactcagtgtcttttcttcccttctttgatttgattgtttcacacccttaaaaattgttactacagcattggttcttaaccctagctgcacattagaatcatccagagatatttgaataaaacacgaatggctcagccccaccccacatcagttgaatcagtctttgagggtgaggcccaagcatctggagttttgtttgtttttaagcttcccaggtaattctgataccgcataggtattgagaaccactagtctagagggaaagacttcacacataacctttcaagaaagctttcctgaggtatttctaataactttcaaagttaaaaataaggatgggggagggccagtgggatcactttaacctattactcttacctagcttttttttttttgaaacagtctcaagctggagtgcaatggcgccatcataactcactgtagcctccatctcctgggttcaagcagtcctcctacttcagcctcccaagtagggactacaggcgtccaccaccacacctgattttttaaatttttagtagagacgaggtctcactatgttactaggctggtcttgaacccctgagctcaagtgatctcctgccttgggctcccaaagtactgggattatatgcataagccacagcgcccagcctgtcgctttcttttctttcttctttaaaaaaaaaaaaaaaaaaaaaagatggagtcttgctatgttgcccaggctggtctcaaactcctacactccaagtgatccacccgcctcagcctcccaaagtgctgggattgcaggcgtgagccactgcatctggccctgttgctttctttaaacacatatttctctgattcatgtacctactggttaatcttttggtctcttaactttcattcattccaattatatttgcttatgttaattaaatccttaaatcctttatttatttatttatttatttattttttggagacggagtcttgctctgtcatccaggccggagtacagtggcgtgatcgcagctcactgcaacctctgcctcccaggttcaagcagttcttctgcttgagcctactgagtagctgggattacaggcgtgtgccaccacgcatggctaatttttgtatttttagtagagacggagtttcaccatgttggctaggctggtcttgaactcctgacctcaggtgatctgcctctgtgcccagccattaaatcctttttttatatttaattgaagatactcataattggctttttttgttttttgtttttttgttttgttttgttttgtttttgagacagtctcgctctgtagcccaggctggagtgcagtggcgcgatctcggctcactgcaagctccacctcctgggttcacgccattctcctgcctcagcctcccgcgtagctgggactacaggcgcctgccaacacgcccggctaatttttttttttttttttttttttgtatttttagtagagacagggtttcaccgtgttagccaggatggtcttgatctcctgaacttgtgatccgcccgcctcccaaagtgctgggattataggcgtgagccaccgcgcccggcaggcatttgtttattatcaagttgacgttcatctaatttagtcagagttttccctcactgtaaccctcttatgcatgtaagtttgaaatcccttttatacttctttttccattagaactgaataaattgatttcctttttctttcctttttttttttttttttttttgagacagagtctcactctgtcgctcaggccggagtgcagtggcgcaatctcggctcactgtaagctccgcctcccgggttcacgccattctcctgcctcagcctccctagtagctgggactacaggcgcctgccaccacacccggctaattttttgtattttttagtagagacggggtttcactgttagccaggatggtcttgatctcctgacctcatgatccgcccacctcggcctcccaaagtgctgggattacaggcgtgagccactgcgcccggccttgatttctttttttgctctgtttttgaggtcaggaggattcagtgggcataagtattgccagattttctttgacttgatatgaaaataagctctctgaagtctgtgttggtctgctgagtagtattgtggatagttatacccaaagaattaatctgacaattaacgttcaataggtacccaacagccagcaagtaaaggcactaatataaacatttgtgctgcactttttgctttcttttttttttggagacaagagttttgctcttgtcacccaggccggagtgcagtgatgtgatctcggctcactgcaacctccgcctctcaggttcaagtgcttctcctgcctcagcctccctagtagctgggactacaggcgcaagccaccatgcccagctaatttttttgtgtgcgtgtgtatttttagtagagacggggtttccccatattggccaggctagtcttgaactcctgacctcaggtcatccgcctgcctcggcctcccaaagtgctgggattacaagcgtgagccaccgtgcctggccactttttgcttcctaatgtgttttcacaccccttaattattgttgtagctaacattttgaaaaatatctactgcatgtcagatactgggataacaaagatgaaatgagagccttgctctccagaagtttaaagtctagagggaaagagagagaagtaaaaataggctattacaatcagtgcagtaaataactctgaaagaactactggtgctacttggagtatatattttagtgctgggcatggtagctcatgcctgtgatcccaacactttgggaggccaggagtttgagaccatggcaatacagcaagacccccatccctacaaaaaataaagaattagctgggtgcccaggggatgctctggcgagggcagaccccaggagaaagcaaaaggcgtctcagggaacccccacattctctcactgaagtttcccaccaggatgaccccacagccagagtcccttggcagcccctcaccccagagcccccttctaaggaaaaaagagaagttcagggcattggaccttcattaacagtggcctggctggcgtggcaggcccaaggcccactcactgccatcccctttctgtgtgtccctgtcccctagttctaaggcccagggcctgagctctcttccccagcatcgcccccccacccccgaaaaaccccgcctttggagagttaattttctgtgtgaggtgcttaacctatcaggcctgagaacacaaagcagtaatctttgttactgagatgcggctgttcgtgttttgggtttttttttttttaatgtttcctaataaaagaagctgcattttgttggtttttatttttaattttctacacatttgagctgagtccagagacacttagcttccctgtcccccatacccggacccttccaccccactggacccaaccatgggctcagaaccctggaattccgtttgctgatttgtttgggtttttttttttttttttttaagatgttacatggtatttcgaagccagcaagttaccaccctccggtgtctcttctctccacatctgtaacttctttttccaggttttattttcagttttaaattcctaataaattatttgaaaatgttaaaaaaaaaaaagaattagctgggtgccttggcacatccctgtagtcctagctactcaggaggctgaggcaggaggattgcttgaacccaggagttcaaggctatcatgagttatgatcacattttcattgcactccagcctggcaacacagtgagacagtgtattttttaaaaagattttattagacaggaggaagaagatttaaggaactggggagtgagttagagaagcttttaaggagttatcaaggaatgggtcctgaaggatgagtgtcagctaggcaaattgaactgggagggtattccaaggagaagcatcatcattgtgtcctttgaacttcacaactgtatcccctttttattagaatgaatctaagaattagagatagtaaatatccttgagattacaaagctgtaataatggggtagttaatagtagagtttctttctgggcttgtattctatgctctttctatatgcacattaaatgctgtattaaattatggaaataggcttttaccctttctgccttacaccatgtgaaaagaagttttcccctcctccagagtgttgacaaaaaaagccaaactgtaaaatatttaaagaggtctattttgagccaaatatgagtgatcatgcctgagtcggtcttttttttttttttttttttttgagacggagtctcactgtgttgcccagactggggtgcagtgttgcaatgtccactcactgcaacctccacagaggcacagtcgagattctgagaacatctgcccaaagtagttgggttacagcttggttttatacattttagggaaacataagacctcagtccgtacatatgacatagacattggtttggtctggaaaggtaggacaacccaaagtggtggtgggggttgaggggaacttgtaggtcataagtggattcagagattttctgagtggcaattggttgaaagagttatctaaagacctggaatcaatagaaaggaggagtgtctaggctaagataaaaggttgtggagaccaaggttattacgatgtaggtcaggggtccccaacccttgggccacagcccaatactggtccgtggcctgttaggaaccaacccacacagcaggagatgagcagcaggtaagccagcattacagcctgagctctgcctcctgtcagatcaatggcaacatgatattctcctaggagcatgaacactattgtgaactgcacattggagggatctaggttgcacactccttacaagaatctaagtaatgcctgaaaatcacaggtggaacagtttcatcccaaaactatctgcaccccagtccatggaaaaattgtcttacaggaaaccggtccctggtgccaaaaaggttggggatcgctgatgtaaatgaagtctcataggtggctgcccttagaagcaatttttttttttttcttgagacagggtctccctctgtcttccaggctggagtgcagtggcataatcacagctcactacagcctcaacttctgggctcaaatgctcttcccacctcagcctcctgaatagcttggactacaggagcctaccaccacacctggctaattttttatagagacaaggtctccctgtgttgcccagggtggtctggaactcctgggctcaaatgatccaaccacctcggcttcccaaagtgctgggattacaagagtgagccactgcctggtggcaagtgtttcttatttagacctttaaaagttgctagactctgagttaatctcttcaggattgggagaacctggaaggggaaaaaatctacttatgtaaatagaaatgttttacagatgcaagttttctcttcacaaagtggccctttgcagggctatttatggcaaaaagaatgttatttgggggtaagatattttgatttcctttatctgtaatgtgatactatactagagtcaggtggtaaatccttagcagaagacccagggacaagatctcttaagagttcaagatatagaaagtacacagaatggcaccaactcattagcaattctcttatttctccggagccagaacgtgatggacacagagactaattcattgtattttatatatcatcaactaggctcaaatctgtctctctcttcctgggagtctaccccgctgttgagactgcaaactaagccttccagagatggtaaataggacttcaagagacagagacaggcacaagaggcactgcacagccctactgacccagcctagatccagagttcagcagaccatgagacaatgaaaggatatttagtaatcttttttcagaagtcacagtaatgatttatttgggcaaaaatcaccaattggtattaaaaccttaaagtgaaaatttgacaaagaatgataagagatatacataattgcagagaatctcctctcatacttattaatcacaaaaggaaagttggtaatttggcagtgaagaaacttgaccagctctaccttaatttaaccaagtggctaaaattcacttcaccagtaagggcacaaaccagcataaggtgcctcctgatatgatacactaagaaagacactatctcttctgtagtattactgacaaaaagtgagtaaggtaaaactaaacattaggaagcaacaagcaaatccaaattacttgacagtctacaaggtaacatccgtgacttctttttttttcttgagatggagtttccctcttgttgcccaagctggagtgcagtggtgaaatctcggctcactgcaacctccgcctcccgggttcaagtaattctcctgcctcatcctcccaagtagctgggattacaggcatcggtcaccacacctggctaattttttgtatttttaaaagaaacggggtttcatcatgttagccaggctggcctggaactcctaacctcaggtgatccgcccacctcggcctcccaaagtgctgggattacgagtggcatgagccaccgtgcctggccccatgtacttttcaacaatgaataatgacaataggaatggagaaaaaatagactagtccagaaaatatttagcgagtgcctctcttgagctgggcacagtggctcacacctaaaatcccagcattttgggaggccaagatgagaggattgcttgagcccaagagtttgtgcctaagattgtgttcattatcctaagattgtatccattttccgtagacaaaataggatttttttaaagtacattcacactatagtgcaaaaatcactgctatccatccagaacccttttcattcttgtaaaattgacattctgtacccattaaataataactcctcatttcccccttcccccagccattgacagccagccattctactttgtgtctgtgaatttgattactctaggtatctcatataagtgaactcatacaatatttgttcctttgtgtgtgacttgtttcacttgcataatgtcctcaagatgcatccatattgtagtaggtgtcagaatttctttcctttttaaggcagaataatactgcattttatggatatactatgtataatatataatatatatttacatatatagcacgtgggttgtttctaccttttggctattgtcaataatgctgccatgaacattggtgtgcaaatatctgtttactgctttcaattcttttgaatatatactcccaagtagaactgctggaccatatgttaaggaatgttaaaatagatgttatgaagcagtatatgtatatatataatgaaaataggtagatatgtgaatatagcagtacttgccctggaatactttgttagttatgtacttttcactaaagagaacctattttcattatttaaaagtctgaaaacttgtaaacctaattttattccattttcacaagctctacttagaaagtagccaaacctttcctatgcctccctcttgaaaagattttcggttttcaagctagctgataataaacctggtttttgttttgttttgtttttagacagagtctcactctgtcatctaggctggagtgcagtggcgcgatctctgggtcactgcaacccccgcctcccgggttcaagcgattttactacctcagcctcctgaatagctgggattacaggtgcctgccaccacacccagccaatttttgtatttttagtagagatggagtttcaccatgttggccaagctggtcgaactcctgacctcaaatgatccccccacctttgcctcccaaagtcctgggattacaggcgtgagccactgcacccagcctaaatctggtattcttaagagccgaaaagattatgcatcttgaataggcaagcagtttaataaatatttcatgtcagaagcaagttgtaatattatgaggacaatttctagatattcctaagtaaggaagtttcagctctgctgtaatatttttaaaaggtctcccccaacccccacatctttcccaccagttttttatagttcctttttaaagcagaattgagcctgtgggtgttttgttctagtcctagaattcactgcagaattgtataacatttggcaaaattctctgttccccaagcctgcaggcccatgagttcatttatctctgatagagttattgtctctggtagaaataaagctgctttttttttttttttttttttttgagacggagtttcactcttgttgcctgggctggagtgcagtggcataatctcggctcactgcaacctccacctccccggttcaagcgattctcctgcctcaccctcccaagtagctaggattacaggcatctgccaccacacctggctattttttttttttgtatttttaatagagatggggtttcaccatgttggcccggctggtctcaaactcctgacctcagatgatccacccgtcttggcctcccaaagtcctgggattacaggcgtgaggcaccgcacctggtcgctactttcagtccgggcgtggtggctcacacttgtaatccagcactttgggaggctgaggcaggcggatcatgagctcaggagatcgagaccatcctggctatcacagtgaaacaccgtctctactaaaattgcaaaaaatttgccggcgtgtggcacaggcacctgtagtcccagctactcgggaggctgaggcaggagaacagcttgaacccaggaggcagaggttgcagtgagctgagatcgcgccactgcactccagcctgggcaacagagcgagactccgtctcaaaaaaaaaaaaaaaaaaaagactttctatatagcaggtcagtactaaaacactttgcataattatttcccttaacttacacaataatctaatcaggcaagtatactattattttaagcccatcttacacatcagggaacagaggaacgaagattacatgatctgtcacttaagtggcctacctagggcccaagcccaggctgttaactactacactgtactgctatccacactttaccttttagttttttgctttttgccattctgcttaatacctttcaatttcactatgtgatttgtatatctctttagccatattaagacaatggaattattgatggaagtctgagagcaaactactatttttagtggcttcctttacccacaggatgtgagggaaggtctttctcagtctggcctccaatatgtatatatccttatcgtaattattttacatattctgtgctccaaccagtctggactacataagcattcttaagtataccttgtacttttctatctgtgaacatgtgttcaggaaactcttccctgtgaaatctttgccacttcttttcctttgtcctcatctctactgaaagagaaatgtgctgaatatacattctgactagatggccaggtgttaaaatcattgaggccaaaactgcatacaggtgtacctcggagatactgcagtctggctctagatcactacaataaagtgaatatatcaataaaatgagtcacatgaattttctggtttccaatgtgtgtgagttatgtttatactatactgtactctattaatagcattatgtctgtaaaaacaatgtacatatctggccacacgtggtggctcatgcctgtaatcacagcactttgggaggccaagatgcgtggatcacttgaggtcaggagttcgagaccagcctggccagtacaatgaacccctgtctctactaaaaatacaaaatttagccagatgtggtggccgatgcctgtaatctcatctactcaggaggctgaggcaggagaatcgcttgaacctgggaggcagaggttgcggtaagcctagatagtaccactgcactccagcctgggggacagatagcaaaactctgtctcagaaaaaaaaaaaaaaacaacaatgtatgtatcttaattaaaaaatactttattactaaaaaatgctaatgatcatctgatcgtagccttctgcaaatcataatgtttttgctgttggaaggtcttgccttgatgttaatgtctgctgaccgatgagggtagtagttgctgaaggctagagtggctgtggcaatttcttaaaataatactattaatacaatgtagttttctgcattgatcgattcttttatcacaaatgatttctctgtagcatgcaatgctgtttcatagtattttacccatagtagaacttctttcaaaattggcatttcagtccagtcgcagtggcacatgcctttaatctcagcactttgggaggctgaggcaggtggatcacctgaggtcaggagtttaagactagcccggccaacatggtgaaaccccatctctactaaaaatacaagaattagcccggtgtggtggcgcacacctgtggtaccagctacttggaaggataaggcaggagaatcacttgaacccaggaggcggaggttgtggcgagctgagattgtgccactgcactccagcctaggtgacaaagtgagactgcatctaaaaaaaatagtgccaccaggtgcggtggtgcatgcctgtaatcccagcactttgggaggctgaggtaggcagatcacttgagctcaggagttggagaccaccctgggtaacatggcaaaacctcttttctacaaaaaaaatacaaaaattagccaggtgtggtggcatgcccctgtagtcccagctacttgggaggctgaggtgggaggattacttgagcccatgaggtcgagacctcagggagccatgattgtgccactgcactccagcttgggtgacagagcaagaccatatctccaaaaaaaaaaaaaaaaaaaagatgggtctatatcgttattatgcagtgaatttctgtatacaaaaataaaaaatgtatctgcaaaatgctgttaacgtttgatagagtgtcacattgtcaggtactagattgtttctgtagtcactatacttactgcctatttgtgataataaatagattgtgattttcaagttttcagctgatattggtgggagaacacttttgactcaatttctataaaatatgttttccttcataccctgtattctttatgtcttgatgaaaggtggtttattaatggacattggagtttttcctaatgcatgaaattttgagctgacaaagtttatattctgcttttaattcattgtttaatgctcataaaaaagatcaggattgcctaaccttatattattaaacttttagaaacccttgctggtttaaacggggtataatagttcatatctgtaatcccaacactttggaatgccaaggtgggaggatcacttcagcccaggaggtcaaggctgcagtgagctatgatcatgccactgtactccagcctgggtgacagagcaagacccttctcaaataaagatttttttctttgagatggagtctcgctctgttgcccagggtggagtgcagtggcaccatcttggctcactgcatcctccacctcccgggttcaagcagttctcctgcctcagcttccctagttgctgggactgcaggcatgtgccatcatgcccagctaattttgtgtatttttagtagagatggggtttcactgtgttagccaagatggtctcgatctcctgacctcgtgatccacccgcctcagcctctcaaagtactgggattacaggcgtgagccaccatgctcggcctacttatttttttgttcataaaattaacagctttcacagtcattaattgttgcagcattcactcttagaatgttttttgtttgttttttaaaacaaggtctctctgtgttgccagtggtctcaaacttctgggctcaattgcttgattttcccaccccaggcttccaagtagctaggattacaagctcgtgtcgccacactcagctagaatatttatctatgtttcaaacctaatattcacatattaatccagatggacccaccgtatataattaatgttatattgatttgacatgatggtaatttatacagctacatgatctttgatggtgtaccagaaatgatgttaaggtaagtgttccgcaattcaaagtcttacagctgatgtggattgaatattggggtaaagcctaattttggtacatctctaaaaaagctactgaaccttatagaaacaagacaattagagttttccccattttcatatccctgcacctaccctatcaggcttttgtctaccagatcaaaattttacaatttgctcctttatacattttttttgtgttgtttttccagacagagtcttgctctgtcgcccaggctgcagtgcagtggcaagatcttggtccactgcaacctccggctcctgggttcaagcgattcttctgcctcagcctcccgagtagctgggattacgggcatgcgctaccacgcctggctaatttttgtattcttagtagagacggggtttcaccatgttggccaggctggtctcaaactcgacctcgtaatctgccttccttggcctcccaaagtgctgagattacaggcgtgagccaccaagtctggcctgatacatttttaaacatattagttgtagttccagtctcttatctctgtccttctaggcattctgttctttcttcgtttaattcagtaatacttatagagcacttaaaccctgagcattttatgcatgtatttcagccaagtgaggttttaagactgcctttaaatctcaactcagatgttacctcctaaaagatttttttcagcctcctgagttggaccttgttacatctgtattctcagagcattttaaacttactttgtttgtagcatcacattgtaatataaagaattgtttgagtatctcctttaccagattttgagctccttgaattaaaaaactgttttttcttgttcatttctgtgtctcaaagacacagaatgaggctgcctgatacactgcctcaagtaagcaagtacttggtacaaaggagttacagcacatatgcatttaatttatgggtttacactgtgtgcttaattaaaagataaataattgaaataatcaggcagtttcactggctgttgtacccagtgggtgtatgcctaagattgggacaatataagaagtataaactgttgttccagtatctgttctcatatgcctctcaaaagtaaacatctcaccaggcttgagtgcgtttctcctgttgaagataacttttcatagcttcatacctcaaacacaagccagccactcccactgacactcattccaatgatggaagaaaagccagctgtgttggacttgaggggtggtgtattaatctctaacatagtgcttttctaatgaacgatgaaggataattttgactggactgagtttcacaatatattatacactgacttcagaacctaactctcccccccacacccccgccaagaagaagtcttgctgtgtcgcccaggctggaatgcagtggcgtgatcttggctcactgcaacctccgcctcccaggttcaagtgattctcctgcctcagtctcccaagtagctgggattacaggcatgtgccaccacacccagctcatttttgtattttctgtagagacagggtttcaccatgtccaggctggtcttgaactcctgacctcgtgatccacaccccttggcctcccaaagtgctgggattacaggcgtgagccaccgcgcccagccctgaacctcactctttatatgaaagataggaatgctactatacagttttgttaaatgaatgatctgtcctttttctgcgtttctgtaatactttattattcaaatgacatttttgctgcttatttcatagctgtttacttttgtcttatcccaccagttaaaaaaacaggaatcatgtctttatacctctttgtatttggtatattgctttttatataatactcgtttatagaatgaatagacattttattttattatttatttatttatttatttaaagacagagtctcgccctgttgcccgggctggagtgcagtggcgtgatctcagctccctgcagcctccacttcctgagctgaagcagtcctccaggttcagcctctccagtacctaggactataggcgtgtgccaccacgcctggctaatttttgtgtttttttttgtagagacagagtttcaccatgttgcccaagctggtctcaaactcctgacctcaagtgatctgcccacctcgggtgggtcccaaagtgctgggattacaggtgtgagccactgcgcccagcattagacagctcactgtacagtgatcataaacctcagtaccctttgctaaatgttccctctcagttatcacttttctctctttcccacagctctttcgacgtgtagcagcagctttgccgggaatggaaagcacacaggacagaagcagagaagatagtatcctttttatttcattggaaatttttcattattaacactagtctttagagccctgcttgcttggctaaagaatattgtgccattgccttttacaaccaggaactgatgacttaaaggcatagaaattcatttgttttctatagcaaatgaggtctggttatccaagtgcaccctttgcagcctgcttctcgttgttaatcagtgagaggttttgtgtttgtttgcttgcttttaaatgagcaggaaactcttagaatccctgtgtccttgcctcttcattttgagtcccattgactctaggctttttcctcatggaatatcaaattttcatttctttttctaacacttgagctttctacttgacacaggcaagaaatagagtggagctttattgtagcctctgctttcagaaacaggacataatattagttcatttccaaggattgggacatctaatattagttaattctaaggatttttaatttgatgttttcagtgtttcatattcaccttctagtgtatttccatatgcaggcatttttattaagccatatagtttgtagcactttgtattcagctcttcccacttgtaaatgttatatgttttcataaaaaacataaaacaggccgggcgcggtggcttatgcctgtaatcccagcactttgggaggccaaggcaggtggatcacctgaggtcgggagttcgagaccagcctgaccaacatggagaaaccttgtctctactaaaaataaaaaaattacctgggcgtgatagtgcacgcctgtaatcccagctactaaggaggttgaggcaggagaattgcttgaacccaggaggcagaggttgcagtgagccgagatcacgccattgcactccagcctgggcaacaggatcgaaactccattcccccccccaaaaaaaaaacacaacaacaacataaaacataatatgtttcaaaaacaaaacaacaacaacaacaaaaaatgttctattgagttgaagtatgtccccgcgcccaccgccgtttttttttgagatggagtctcattctgtcgcccaggctggagtgcagcagcgcaatctcagctcaccacaacctctgcctcctgaattcaagtgattctcctgcctcagcctcccaagtagctgggaatacaggcatgagccaccatgcccagctaatttttatatttttagtagagatggggtttcgccatgttggccaggctggtcttgaactcctgacctcaggtgttcggcctgcctcaacctcccaaagtgttgggattacaggcatgagccacggcacccggcctgaagtcccattatttactaaatgtttcctctgctgttggaactatcttgtaggctattttcagatttatattatagatgattctatgaggaacatcatcttcatatcacttcttgccactgtagaataagttccttaggatagatacccataaatagagcttgtacctcattctgacccttgttgcatatagtagatataaacaagtttattccatttgagcaccttatatggtgaggcggctatgtagaaaatagtgagtgtgtaggctctgaagacagataggaatataagggccatcccagaaatgctagtgtttggaagaattgaaattgtactttcccatttatggcttcttaacttttgtttcagtgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgatataaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagattttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaacttatacttaaagatgggatggagttgtaaagtgcttttataatacaatataattgttaaaggcaagggttgactctttgttttattttgacatggcatgtcctgaaataaatattgattcaatatggcagatgggtcatattctttatttggaagaagttgtgactt

SEQ ID NO: 14689 - DNA, 39754 bp, Human
  misc_feature (1)...(39754): n = A,T,C or G
atctgattgtctaaaattctaaccatgcttttaacttattatttttacccagctctgaaggtcattgttcttgcctgtgtttgaataaaatcatattggtgtttgtaatctgtgcacaagtgtttcgctggagtggggatgctaggaattcgtgtgtgccctaactgccagagagaaagattaacaaccatacaccccacgcagacgaagatcaatcaccatgagacttctggctcctccagaatcaggttggtccagatgacagtgacacccagtatttcctttgctgatgcttgaaatccatcagacaaagccccgtggggaggacaagaaaagggccatggatgggtgcagtggctcacacctgtaatccaaacactttgggaagccgaggcaggcagatcacctgaggtcaggagtttgagactaccctggccaacctggcaaaaccccgtctctactaaaaaaaaaaaaaatacaaaaattagctgggcgtggtgcacgcctgtagtcctagctactcaggaggctgaggcaggagaatcacttgaacccaagaggtggaggttgcagtgaaccgagaccacgccactgcactccagcctggacaacagagcaagactccgtatcacaaaaaaaaaaaaaaaaaatggggtcgcgggagccaaatgtgcagagtgagcagtgtggctgggcaacaggctttcacccccaagtacatgtcacttcactcagtcctcaaaacagctctctaactctagatattatgatatctagagtttctgtaagttcagtgttttgcctctgtttgtgtagttaggaagtgattaaccacacaagaaatcccagaggtattgcaaggctactgctttcagtaatcaaaacaaggtacagccaataagtgctctgaatttagggacttcatggagaaagaccatgtgggctggggcagtcagggaaggcttcctagaagagacaggtcttggggtgagcacagagaattggcccaggctgtggacagctatagagagagagccaggaaagcctgtgagcagtgtgcagctggagatagagaccagtctcactgcgtctgagcctctgtggcctcgtctgtaaaacagagataatcaccccagcttcatggggttgtgaggaagatcaaatgagatgacatttgtgaaagtgcttcgcctacttttggcacatggtggaagcttaggaaatgtcagccccacccactctcctgactttcgggagcaaaccagtagagaggcaagcatgcagccactggggcaggcagagcactcctgggcctcagagggtgcaaaatgatgcgggaacctcaaggaaggagtgggtgctgccttcttggtgacaagccctcccgcttctatttatctctgctccgacgcctgccagcccacccctccccagcaccacagaggccagcctccctctcaagtcaccagcacagagcattcaaggcccagggccccacttcccttggggcccaggggacctaaagaggggcagtcagggcccaggcctgagggggaaagccccaggtaaagaatattcctccaaatcccactccagctcccgcagacaacctgatcggggtcaggaggacacactcctaccccaggctgagagcagcctctgataacacaaaaggaccctgagggtggagacctcccacctccacttcaaaacagtgtgttatttatcaatatcttatccccggaagttgaatctatctcccagtgccaactccgagataaatgacttgaccaggcgtgtggcatggattaaggcatgagataggtgttcccaccaccagaacgagccagtggctgcctctcttccctttgagccctccctccacagagacctgtgaataggtgtttctgatccctaggctggttgcatcccaacccagagcaggcagccttcggacttctagcatgggctggcctcaggacatggagccaaagcaggcagacctggccctgccctcaagctcccaagctaaagagagcctggccctccctcccactaggtttctccagagcctgctgcctcctggtttgggcttctactctattcttcccccacagactccctgcaatttactgcatcacctctagactagcaattacagatggagctcagaacctacttcctgagccttcctaatctcagcagccctgacagccacttccctcttaacactaatgcagctgcttattctgctgacattaaggtcagggcctggtccaaggaagaggacaggtacagcccaagctttgcacttgaacatccatgcttctgaccacctgccctgtgacgctggctctgtgccccagtccagaaaagacttctgcctactcctcctctgccctacccagttaactccctttccttccctcccttctgcttctcactcctcccctcccttctcttcttcttctccccttcccccatcacctggggcccgattcagctgtgcccagcccttactctgagtgcccacagatggagcctccagtagcttctgtggggcacccttccaccaggtcccagctcccttggctccagcagtgtccatgctaaagcctccaagtgtcatgttggagagaatggtggtcacagtagataagcccaaaatgccttacagtttacaggctggagtcaggccccgccacgtgctggctacatgacttccctgagattccatttcctcctcagtaaaataagtggtaagattttaggatccccagcactaaaaagaaacgaaatactgatacaggctccaacatggatgaattttgaaagcattactatactaagtgaaagaagccagtcacaaacaagcacatattggatgattccatttctaggaagtgttcagaacaggcaaatttatagagacagaaagtagattgattagtggttgcctgaggctggggagcgggggaagggaggtgactaccaatgtgtatggagtttttccagggtgagagggtgatgaaaatgttctaaaatagattgtgttgatggttgtgccactcagaatatactaaaaaccatttgaattgtgcacttgaaacagatgaattgtacggtatgtgaattctatatcaataaatctgtaatttaaaaaaaaaaaattaggtcgggtgcagtggctcacacctataatcccagcactttgccagactgaggcaggaggatcacttaagcccaggagttcaagaccagcctggggaacacagcaagacctcgtctctactaaaaaattttaaattacaaaaaaaaaaagtaaaaaaaatagaatcctaatagtacctatctcataggattgtggaaaatagtagtaatgtatgtaaaatatttagcacatagtaggcacaaagaaatgacattattattaagagacctgggagagctgtgcccagcctatcgtgggaggccttgacctttggactcaaaagtggcagcaggtccacccccccatacacccttgtcaccaaggaagcgtccacagcttaaaggagctatattaaagcaccccaagtcaagaggactgaaccagatctggaactcactcacctcccctctcacctcactgccctcaccagccagcctcttgtcaagtgatcaggctgtcaaccaacttctctaggataaggtttcaggtcagcccgtgtgtataagaccagtgccaagccagaagcagcagagacaacagtgaatgacaaggaggggccatccaatccctgctgccacctcctgggatggagccctagggagcccctgtgctgcccctgccgtggcaggactcacaggtaagacccctttctcctccctcatcccttcccctctccctctcccttctccttgttctccctttcattggaggctttcagagagcagccccgagcagtcagggctcactagctgcagcttgtcagacctgatagagattcagtccagccgccaccttatgaaaagggagctgtggccttgatgagggtactgtggcagggctggggcttgaacccaacacccgtgtcactcactcaagactcacaccccctttgccttgctggctgcctctggtgggattttgcaaatccccatagacaggaagtggctttcttctttgcctgccccagaatctctgcgattcctccagagcataaatccctctctttccatgaggaccctggggccctcttcctgagtagggatgacaggggcacttctgacctgaggcgtggtccaggtcatttgctgggagctttacagagcccatggtctctgcccagacggcttcttcagtgggctgctgtgaaggctttgccgggagggtgggttggagttggggaggcaactggtgttgggtaggatgtctcaaaatggggtcctcttcccctgcttcagagctaccacagggagttttcctaatgcagattcctaggccccaccccagacctaaatcaggatctctggggctgagagctgagaatctgctctgtaaacaagcagctcaagggatccttggctctccctgaagtctgagactctctgggcagtgaaacaggcgcagcttcagatgtcagacaaacgtgggcaccaatctcagctccagcacttcagctgtatgactagcaaaagccctggaagcctcaggtccctggtttacgaaatgagaataataatagcaactacttgtagccttatgaagggatcaaatcagtcagtgtctgtaaagccctcagcacggtatctggtgcaagaagcaaccagcaaacattaatggaccatgctgactagaacatcccatccctcaggagccccagcagagctacagtaatgagggttccacttttgacttcttcctccactggccagtggcaaaaggctgccggctgctaggggtctaggagagtctggagtgaattgggaagaagattggggagtgctggcctcaaggcacctcctacctgtgcccaccactgtggctttccctcctcccgcagcttgactactgaaagttctagagccccaaggtgggcttttgacctgagtctgtgtccatccattccattttccatgagtggctaagaactgcccctcttgtcaagtgatcacgctgaggccaagagttcaagaccagaataggcaacatagagagacccccatctctacaaaaaataaaaaattagctgggtatggtgatgcacacctgtagtcccagctactcgggaggctgaaggtgggagggtcacttgagtccaagaggtcaaggctgcagtgagcctggattgcaccactgcactccagcccaggtaacagagtgagaccctgtctcaaaaaaaaaaaggaggcagtttgatattggggagaacagatgcctgagcctcggtttcctcatgtatacagtgcaggtaccactatcagctctgcctacccctggtaaggaggggagggagagggtcaggaggaggattgcaaaattcaagggataggaacgtgacctgtttttataggccaaattcatgcagcttaagtatggcaccacccaggcttctccctttctaaagcccctcctgggtaaggaagagttcctgggagccaggccagacatcactccatcagccttctctggcctgtctcctgcagccccaccgctgcactgaagcccagggctgtggagcagcctctctccttggacctcctctcggccctaaagggactgggcagagccttccaggactatggttggactgaagccttcagacgtgcctcccaccatggctgtgaagttcctgggggcaggcacagcagcctgttttgctgacctcgttacctttccactggacacagccaaggtccgcctgcaggtaggtgccctttggccaagggtcattgatcacatggaaggaggggctagttctctcccatatcccccatgacgtgtgcccacatgcccttcctcagaaccctgacaaagactctcactccactgcttaggacccttccttgcctcctcccatcaccatccaccaggacaaaaaaatctaaattctttgcatgatgtgacagggccctttatgggctaggccctactttgtaaagcatgcagtgtgaggtaaaagtaaggaattaactgtgtgaccttgggcaagccacgaagcacttataaaatgggaaaaacaatctgtccctctgatttactctgaggatcaaacaccaagccatgtgtataatactgctttgtgaatggtaaaatgctgcgcagacaccagtgatttctactgtgaccagcatggttgttctcaggcccagcccaggcaggcccagccccagcagggttcctgtgcacgcagccccttcttgccttcccatctgagtcctcaccccctgctattgtccctcagatccagggggagaaccaggcggtccagacggcccggctcgtgcagtaccgtggcgtgctgggcaccatcctgaccatggtgcggactgagggtccctgcagcccctacaatgggctggtggccggcctgcagcgccagatgagcttcgcctccatccgcatcggcctctatgactccgtcaagcaggtgtacacccccaaaggcgcggacagtgagtgaccaggtccctgaacaccaaaggggtggctgaaagtgtgtgggtcaagagaccagggaagtctagactcagaggcagagccaggggcggggggaagctggtaccggacgcttatgaggaggctctgagtggacatcaaggaagctgcaggggcagccccgcagagaacagcatgtcccagaatgctgcttagtaggggacactggcccactctctctgcccctcccagactccagcctcactacccggattttggccggctgcaccacaggagccatggcggtgacctgtgcccagcccacagatgtggtgaaggtccgatttcaggccagcatacacctcgggccatccaggagcgacagaaaatacagcgggactatggacgcctacagaaccatcgccagggaggaaggagtcaggggcctgtggaaaggtaggtctggactctggacgcaggcggtcttaggcagagctttccctcccctcaggctggggcagggaccccagtaaggaggggactcccagcatggcgtgttccagtgattctgaaagaacatcacaaccaaagatacttcactgacctgccacagcccctcaaactcagttcattttaccagccctttgccatgtgcaggttgatgtgagggagccagaaatgaacttaagacaccttcacacgcccagggcatgaggacagcagaggagataagatgcagctacaccacaggcaggatgtggtaggggttgccccagaggtggagctccagaggcgggctctgcagagaaggtgacacctaagctgggcctggaagactgaacaggctctaggtgtgtggagacggaaggggaggggccctcaagcagggtccggaggaaaaagaggagcatcagaaaagcacagctgtgaggagtgggcgcagggagatgcaacgaggaagcgcttccttgggagcaaagctggagggctccctatgtgtccacatggcagccactgcgatgaatgcaggactctctccgcatgtgaaccagaggttgcaggaacgtttgcagaagaaactgacccagtgaagtttaagggcaggacacctcttaagttggggctcttcactcacttgttgggcacccttcagagcttgtccccttacctgtgaaaccaggggtttgatcctgacagtttcctagggccctgctggcaccacattctgtcactgttccaagagctcagcctctcgctgaatgactttcttttctggctgcagctgggtctccaggaagcatattttaattttgacagctattgcagatcaccctccaaatgtggccaaatgaacacaagtgggcctctctgttctctgtctctgaggaaaacatggataatctgagagttgttaaccctagaaaggaaaatgtggaatctgctcagctggggtgggatcctctggctgagaccattggaatggggcactatggccccaaaactggggcctgtggccttgcagccagggcatccatttctcccatttcccattcctccctccccacccatttcacatccctccccaccgccttcctaacaggaactttgcccaacatcatgaggaatgctatcgtcaactgtgctgaggtggtgacctacgacatcctcaaggagaagctgctggactaccacctgctcactggtgaggccctgggctccaggcaggcagctctccctcagcagggagggaacccagaactccgtggagtgggcaccacccagaggcaactgggttttagaaggagcagagagagaagcagtgcctagtaaaaagtgccaggtacattgtggtgacaagcaggaaagacccctgggctgggaggctggagacttgggttccagtcccagcaccacctctcactatatagctttaagcaggggtctctcaccttctccgacttcagtttcctcaaacagcctgcatgacctcccacctctgggtcagcccaggcctagtttgccagtacttaccaagagcttagcccagggcactgtgagagatatggaaaatactgtcctatgctcagggagttcacggttgagttggggacaaacagtgcatacatatggacagaacacaaatgcactccttgatatttgcttgtccttcctctgcagacaacttcccctgccactttgtctctgcctttggagccggcttctgtgccacagtggtggcctccccggtggacgtggtgaagacccggtatatgaactcacctccaggccagtacttcagccccctcgactgtatgataaagatggtggcccaggagggccccacagccttctacaaggggtgagcctcctcctgcctccagcactccctcccagagaacaggggcttctttcttttcgaatgtggctaccgtgggtcaacctgggatgtagcggtgaagagtacagatgtaaatgccacaaagaagaagtttaaaaaaccatgcaagtaaaagaaaaaaagtgaaccatacctgatggggagggttagggaagcctgactgagaacaaacactccaggaataggtaaaagtactgcctgtctccagaggaagttagcaatcctgagacctcctggacctcctgccatggccattgagcaccacactgaccatggccagtgccttcctcactgtctccacacgctccacgttttcttgcacttactgctccctctgcgtggaatgcctcatcatctacaggctgtcaattttagccatccttcaagacgagttcaaatgccacctcctccctaacactctcaggtgtaaatttttcctcctccctgggaacttctgcaatgccatttgataccatttttatggtatttatcacctcctgccttgtattatagtatttgtaagcttaaattattcctcatgcaaagagcaagttcctgacagcaaaagtggctcagacatcttttatctcccacagtccctcacacaaagtgagcactcgataatgcaggttgtttatgattatcacaatagctaagtcactctatattaggcctcgtgctgagcactttacacacgttatcccaacagccccttgaactgggtagtattgtccacattaactaaggaaaagactgagtgtcagaaaagttaagtaacttatccaagatcacaggttaaaatggtggagccatggctcaaaccctgaccgtcagacaccacacccaacaatgttgtttatcctactggtaagctcttagcttggccctttcacctcccactgctgatgtcttcaacagagagttttttggtgcccagtgttagaatggacccaacaagtgaacaagagctgctataggttctcaagcctgggaatgacgtaataaaactatactgcaattgacagactgttcttccaaaaagtgcctctatcattacagtcttcagctgtagccacttgtctcagttactgctttcacttgtccaacatttctggagcatcttgtaggtgccaggccctgggttatgcctccctcaaagagcagcagataagttggtggtatttactgagcatgtattgatgctgggccctgtgctgagtgctgtccaacattaactcacctaatctgcacgactaactccacaaggcagatactgttattttcctcattttacagataaggaaactgaggcttagaaagattaagtgatgtgtccagattgtaaagctagaaactgggagagcttggatttgaacccaggtctgactccagagtttacatttgttgtcacagtactatcgtccccacaagagtcaagaaaacccatggcatgaggtcacagtgcccaaactgagtcctccagagcaaagagcaaccagccagggaaggaggagaggaggggacagtccaggcagagggagcaagaggagcaaaggcatggagggaagagggcctggcatcgtcagggaatgtgactagctgagtctggtgggagcaaacgggcccaggaggtggttagtggagggacaggctgagagaggggcaggggccagctcgtgggcttctccctgagttggtgagccacagctgaggtggggacactgtgctatgccatcacagcacagccagcctctctggagaagagctaaatctggtgccacactgtattcaccctgcaaagcccaagcttctccatgtcctggcagggggccatgttagggctggccacccggggtgtaactgagcccagaaacacccagcagcagggtggagttagaaccgcacctctgacacttactagccgcgggtctttggttgagctcttaacctccctgggcctcagtttgtgaaaaagagcctggcagcaacatggctgccttatagaactgtgagaattcgctgcctaacacagtaacccgtctcaaaacgtgagtttttttttcttttccttactccgacttctgcctaaatccccttagcagaaaaaaaaaagagagagagagactgaaaggattcagaaaatgcttgtgatgaacagaagtctggatcctctggcactaccactgtgtcccgggagagcacacgcatctgttgtggtcccctagcactccacctgatgtgttggttgtttttcttatcagatttacaccctcctttttgcgtttgggatcctggaacgtggtgatgttcgtaacctatgagcagctgaaacgggccctgatgaaagtccagatgttacgggaatcaccgttttgaacaagacaagaaggccactggtagctaacgtgtccgaaaccagttaagaatggaagaaaacggtgcatccacgcacacatggacacagacccacacatgtttacagaactgttgtttacttgttgctgattcaagaaacagaagtagaagaggaggagggattctggtcttcactgccatgcctcaagaacacctttgttttgcactgacaagatggaaaataaattatattaatttttgaaacccattaggcatgcctaatatttaggcaagagaaaataaaccaagatagatccatttggacaaaatggaaggttggagacgtgtatccccgtgaaatctggttagataatgaatgataagcaggaaggatggcaagcacgggacaggaggggcccacaatggagtgggagatcagccacggagcctggagggatgccacccagcaacacagagctggcgactgcagctgcaccatcacacatgcatcatcagcctatttgtaatatgtctgccacagagagtcctttgggattctaggaaacccaaggaacaagagaaaaaactagagcctgtgctaaagaagccctgctgggcccatgtgaggctggggctcgtaaatattccctgacgacactgaagaatcaagagggcagcccccactttcctacaaaatggagggagccatcccttccctgtccacctcaccaggggtgctatgacatgcaagtgagaagctgggcatgaacgcactttataaaagcaaaagctctgtgtaaatctaactacaaggacaatgccttgggagagattttgtcgggacagagaggagttgccagggaagaaggtttgaaagatacggttgtctagaggtgagaccaaaggatccagagacttggggaccagaggtgacagtggatgacgtgaagccacaggagccccacccccatgcagcctcttccccacccccccccaccacgcgctcaatcatgagtacctcaaaggattgttgggcttgggggaaaagaggtggattcctgggcaagaacctaaagtagcaggactcggaattctcgggaaattattatgactcaataaaagaattcacaccttaggtgtgggagtaagaacagccacttctctgccttttctttcttggaattttcctttctcacttctatttcaggctttctatgtgtcagggcagggccagatccagccccacatgcctacacttcatctgccccctctcaccctgtttaattgcaggcaagtagctttatttttttagggttccagctcctgcttctgcaaaaggcagggttgaaccagacgaccgacttccaagcttaagactgtacatttttcgaattgataatggggacccaaaatgccactatctttttctacttcttggcagccttgcgtagctctgatgattgtcaggactgggttcaaacctcaccccattctaccttactaaccacctagccacagggaatccttgcaccttggtgtgctaccagagaagtgggaataacaatcgctgcttcacaggcttgttgtgagggttgacctaaaactccttggaaagcagacatgtggtgtgcacctgctacctgggaggcttaagcgagaggactgcttgagcccaggagttcagggctgcagtgagccatgactgcacctgtgaataatgactgcactccagccttggcaacagagcataactccttctctgaaacaaaacaaacaaaaaatcgttggcatacaggaggcactcggtaatgtcatttccctgcttccctgctcctacccctccagaccctgggaaaaagcaaatatctattcatcctcagcactttcctaaatttaaattataacttgagatcatctatgtatacaaactggagagttcatacaaaagcaaaaaaaaattattttgatttaatgtctggcttggttttcaaataaaacccatattttgaaaagtttccggttggtgcagtggctcacgcctttgggaggccgaggcgggcggatcacttgaggtcaagagtttgagaccagcctggccaacatggtgaaactctgtctctactaaaaataccaaaaaaaaaaaaaaaaattacccaggcatggtggtgggtgcctgtaatcctagctactcgggaggctgaggcaagagaatcactcgaacccaggagactgaggttgcagtgagccaaaaccacaccactgcactccagcctaggcgagactctgtctcaaaaaaaaaaattaaattgaattgaattaaattaaaagtttccctttttagccaggcatggtgacatgcgcctgcggtcccagctactcggggggctcaggtgggaggatcacttgagcccaggaggcggaggttgcagtgagccgagcttacaccactgcaccctagcctaggtgacagagtgagaccccatctcaaaaaacaaaaacgaaaaaagaaaaaagagtttctctttcttttgacttgactgacatgtgcaaatcactctcaaactcctggtctcagtttgtaagtttctagggccaggaactatatcttccatgaatttccatatggcaatattaacacaccacctacccagaggatgctattcaggtgatgattctgagaaagggaggataaaatattctaagagatattttgactgggatcaggagcctactaactgccaagtccagccttttggagaaagaaaaacgagattggtgagtcttgtgaggtttctaggccaaaatactagatctctttctccactgttttttttttttttttttttttttgagtcaaagtcttgctctgtgcccaggctaacacaatcttggctcacagcaacatccacctcccaggttcaagtaattctcctgcctcagactctcgagtagctgggactacaggtgcgtgccaccacactctggctagtttttgtatttttagtagagatggggttttcactgtgttgaccaggctggtctcaaactcctgacctcagatgatccacccacctcagcctcccaaagtgctgggattacaggcgtgagccactgctcccagtctctttccccacttcttaaaggcagagattcaaccagatgacctgaagctctttagttctgtgattccaaggactgagagacagtttctcccaggctacggtgtgaacaccttttcaacgctggcctcaatttatgcttccaggaaaccagggatgtgaattcatgagaaggtcagattaccagctgaggccagtttctaagttctgtgcatccatttccccaccacactcctagagacaccacctccagtcaagtgattcaaaagaaatctgctttttctcaaactcttctactacgtcaggcagaaataagatagttagagtcctgactcagtcccatttgtgacataatggataattcacataaatgttctaagtaatggtaatattttttaaaagaatattttattcagaaggaatgaatgttaagtaaggaaatattattatagctctgtagatgagtttgtttcagggcactttgaaaagcacagtgtgctacatgaatgaaaatattcattgtacatacattgtaagccatatgttatgttaggtgctggggtgaacaagaccagtcctgtcctcaaggagctcactggggtggaggatggtggggcaggaaagacaaactgcaaaccatcagtcaccatactgggtgatcaaagctacaaatagagatgtatacaaagcacccaagagcaggtacacagataagggacatctgacgtggttggggggccaggaagcttcttggaggaagacacctaaaggtcaagtaggtgttatgcaggtaaagaaagtgaagtgaaagtcatcctaggcaaagggaatggttcgtgcaaaggcccagaaacaagataaaaacattcaaggtacatccaagggattgtcagctgtcagtatgtctgggttgcagacttaaagatctactggggagactgaggcaggaaaatcgcttgattgcttgaacccaggaggtggagctcacagtgagctgagatcgcaccactgcactccagctgggcgacagagcgtgactctgtctcaaaaaaaaaaaaaaaaaaaagaaacctcctttccatttttttaggtatatacccaaagtgcaaagtggaatcatggaatcacttggtatgggtaattctatatttaattttttgagggaccatcatactgttttccatagcagctggaccattctcattcccagctgcagtgtataagggtttgtttctccacatcctcttcaacacttattttctggtttttgatagtagccatcctaatgggtgtaaggtggtctctcattgtgattttgattaatgattagtgatgctatggctcttttcgtgtggttattggccatctgcatatcttctttggagaaatgtctatttaaggcctctgcctatttttgaatgaaaattaaagaactacaattttatgtaacttggatgaatctcacatagcgttgagtgaaagatacaaaatagtacatatagtatcattccatttatataatgtttaagaacaggtaaaacaaatatttggtgttaaaaatcaggatactggttattctttgggtgaatagtgactgatggtagacacaaaggatcacttctgggtgttagtaatgtttcctcatgtgtgctcattatacagggatgtttgctttataaaagttattcatgctgtatacttaggatttgtgcactgttttatatgtgttttacttcaataaaagtttactttaggctgggagtggtggctcatgcctgtaatcccagcactttaggaggctaaggcgggagggttgcttcagtctgtaaacagattttttttttaagacagggtatcactgttacccaggctggagtgcagtggcgtgatcacggttcactgcagcctccagactcctgggcccaagcaattttcctgcctcagcctctcaagtagctgggactacaggcacctgccaccaggcccagctaattttaaaattttttatagagacaggggctcgctttgttgcctaggctggtcttgaatttctggactcaagtgatcctcccacctcagctgcccaagtcattgggattacaggtgctagccaccatgcctggctactcttgctggtttaatgatgggaaatctttcaccaaaagtttgcaaattttcatatgagcgtctggacaacttttttaaagacctacaaaacgttcaaaacactggtgaaaaagaagtacagaatagagagaaattttgatcaggcacttactctgaaaagcacaacactgtgtctgtgtctcagtgatgtggtcacacaaccaaaacaacccaactgtggttttcttctcagtatcttacactgtgaaagccttcttgatttggaacctgtgacttgcagcagagttctaaacaagaattgtatattgcttgtttcatggctcctctcaccaatgaatccaaatccatcagagtagagctcctcagcatattagaccagttatccagaagtcatccccagaagtcatatccccgtttcttttactttccaaaggtacaagatctcaaaaactgtcaagatatatttcaccattgttattcttgctatattattattatgtcttggagttatgatccttgaagtaattcatgcttcacatgtgcttacaatgttgaatgatgggatgagagaaatcttttccatttgataaaataaaaccacaaggagggtttgcttgtgtcgtatgggtgcccataaagcattgaaaatattaaggagcaaagtggatttgcaggatttctgtggatatgtcactatgctgtaccatctcatcaacgcaaacagaaagtgtggtgatgcttctgatgaaaaaggaaaacctgatttgacttcctgctttgagcagatgagaggacagagtcatttgaaatggtcattgaggaagcaaccacagattcaacaacataacagaaatcttaggttgctacaacagaaacagactgggttcctcttgagctatgcttgtaattccactgtttagctctgaattcaatgagtttgtaggaaaacagtcacactacaaaccttgcagaaaagaaagccttcaaaaactcttactttccagtagaaaactatatatgttcttaactttattcactcattctaggaagttgctttaacactagatattcacattcaggctggtttttccagttttctttacctaaatcttaagttctacttcttgaaaagaatgtaatgtgtagagatggcatcttatcagaatggagagatggtcaccttcctcacttctctctgctaatcttcattggtattaattttttcacataacttgttattcacactttgtgtcttttttcttaaatacctttaagaaaaaagcttttataaagcttttataaagctttatactgccaggcactaaaaagaatcctgctggtgcagaataatttaggcttaaattatgttcaaagtgtgttgtgttgtagtttgggtaacatttagtattgtctggtgtcttgatcattataacacatcctaattcaacaaagagctttttagcaaaaagcacttactatattttttaccttgagacaatctgcatttttttataaatctaaggataaactttatagactttatgataactgttaatgtaatgtcattatgaatattggtgattttcagtgttagtttgtcaaacgtatatctggtttaattttatattttgttacctacactctggaggataatggagattttattcttcctgtgaaaaggcttcttggtatttaaagtagcaaaagtataaaataatgaacatccagtattgagaaatgatatgatggaacattaaaaattcctgtggatatttataaattatatgtcagttaaaccttgtcaaaggtatgcaaatcagcataccttaagcttgttttagaaggtctcaactcagactatgaagattcactgacatcttataagaagccttggaaaacattctcttttttttttttgctgagacggagtctcactctgtcacccaggctggagcgcagtggcatgttctcggctcactgcaacctctgcctcctgggttcaagcgattctcctgcctcagcctccccagcagctgggactacaggcatgtgccactgcgcccagctaatttttgcatttttagtagagacagggttttgccatgttggccaggctgttctggaactcctgacctagtgatctgcctgcctcggcctcccaaagtgctgggattacaggcatgagccactgcccagcccagagcctgtaccttttatttctggttttcagtgccttgaaccaagcctgatgcccacagaagctattttcaataaatatcagttgaaaaaaggaaggaaatcaaaggaggaagggacaaaattgtagaaattgttaaatcctgcaacagagagattgtgtgattctctttggatatctttaaggccaaagaaaagcctgtttagaaaggtcatgatcaaaactacataacnnnnnnnnnnnnnnnnnnnnctctgtctcaaaaaaaaaaaaagagagagagagagaatgctaaaatggtctaatttgcattttggtttttttccttttattttttagagacagagtcttgctctgttgcccaggctggagtgcagtggtgtgatcacagctcactgcagcctcaacctcccaggctcaacctcctgagtagtttgggtgatcctcccacctcatcctcctgagtagttgggaccacaggaacacaccaccatgcccagctaatttttttttaattgtttgtagagatgggggatctccctatgttacccaggctggtttttgattcctgggctccagtgatactccctccttgccctcccaaaccactgggattacaggcatgagccaccacacctagccattttctccccatttttgttaacagttttattgaaatataattcataatagcatacaattcatccattcaaagtgtacaattcagtgatttttggtgtattcacagagttgtgcaaccaccaccacaatcaattttagatcattttcactgcctcaaaaacaagcccccatacccattagctgtcatgatcaatctccccattccctgaagccctaccatctgtctttatatatttgcctgttctggacattttatatacatggaaacacaatgtgtggtctttcatgactggcttcttttacttagcataatgttttcaaggttcatccacggtatagcatggatcagtacttcattccttttcttctttttttttttttttttttttttttttgagatgaagtcttgcttttgtcacccaggctggagtgcagtggcacaatctcggctcactgcaagctctgcctcctgggttcacgccattctcctgcctcagcctcccgagtagctgggactacaggcgcccaccaccacgcctggctaattttttgtatttttagtagagacggggtttcatcgtgttagccaggatagtctcaatctcctgacctcatgatccgcccgcctcggcctcccaaagtgctgggattacaggcgtgagccaccatgcccggccacttcatttcttttcattgcttggatataccacattttattagcatatatccgttccgcaattgatggatgtttgggttatttccatttttttggcaaacgtattttttaaacaatgtttatatgtaagtctgctgctcactttgggtttttcttttcacagaattttttaaaacttttttagagatgtggggtctcactatgtggtccagactaaactcaaactcctgggctcaagtaatcctcctgcctcagtctcctgagtagctgggactataggtgtgagccactgtgcccggcttcttttcatagactctttatggaaaaatagaatttgtttccatcttggtagcaatggttactgcataccttcactctgatttgagaatttttggaccaagctctgcttcttctctgagtatggagaaggcaaaaggcagggagtggacctcctcagagaagtcgagggaagaggatcagcaggcttctaatcaaccaaacacaattgctttgccaggaacatcagcaaagggaaccaaaggacaaatttctgctaaaggtgaaaaagcgctctgcccaaagaaggcagcagagtatagggacaaccccaaacctcagaagaagatactaatcccttcattaccctctaaaccgcaacctgttaatcggcttcaccgggacattctgtgggcctggtgtctataattaaaggcaaagccacacaggcctttggtgccagaaataagctcctgtgtgcctttgcctatccaaatcaaaagaattttcctagcacagcaaaagaggccagaatccggaaatcattaccaaaacaatcaaaggtggacaaaggggaaattaccccgaaaagccctgaggagacacatcctcctaaagtagctcttccccctggggaggggttgcctgacctagaagagtctgctgctctccttgagggagttaatacagttgtggtgacaacttctgccccagaagcttcgctggcctcctgggccagaaatgcagccagggagaaggcaccagaagcagtgggatctccacatgaggcccatggtgtcaggtggctagtgtccatgggagaagactccctgcagacacagatggttggcttcacctccagtttcatgctggacaaggctgggttccagaaaagcaagaagggagagtgagtgcactctttttgcttcctgcctccaattttccaccccataacttgaagacaatatgttgtgccccaaatgcgttcacaggtacaaggtcttaataaaaagcctccggtgggaatagaatatcaggaaaaagaccacatctgtggtaattaatggcagaaaggctggacagttgattccgtggtgctgctgacaggtgaactctggtcctctccacacctgcttatgggccatgcagactggtggggtggcagatgttagcctaagacccctagcagtgactgctgcttcgtgggtggacataaaagactcttaagtttaaaaatggaaaaacattttacaaattaccataaattctagttaacacgtagaaaaactcattcatactacccttctaaaatagaaatgacttcagcagctcttttaagtgggaacctcttcagctgagcattgtgaaggagttgagaaaacaaacagcagtttgctcctgtgctcaatttccctgacccaaatgctgactactttaggagctgcttcattccaattgcaattacataaaatgtaaagtattttaaggcaaagaaaggctgttaattctctccttccccaaaacacgtgattttcaatattcaaaacaatatttttcaaagttctcttaataacctgcgatttctacaggttggctccaggataaaaacacgaggcactttgtattacttcgcttataattcttttgtttatttccagtatttaaaatgtttaaggttacttcccgttcatacatacataatacattgaatagaaaatgtgtttattagcagattctccataaacaaaaataagatgtgtttataaaataattcatctattgtatttagggaactgtatgtattgcatgcaaattattgttagtgttcttaaagtaggattaaaccaaaaagcatgacttttcttttgcataactcatttgtttgtttctttatcagttggtggtatgggttggatcgtttgtttttatttatttattattattattttgagacagtcactcaagctggagtgcagtggcgccatctcagctcactgcaacctccacctcccaggctcaagagattctcatgcctcagcccctggagtagctgggattacaggcgtgtgccaccatgccaagctaatttttgtgtttttagcagagatggggtttcaccatgttggccaggctggtctctaactcctggcctcaagtgatccacctccctcagcctcccaaagtgctgggattacagatgtgagacaccacacccggcccatctcatttgtttttaaaaccactttatttaggtatgattgatgtacaaaaagctgtatatatttaatgtatccaattgagtgtaattaatttttaatattttttgtacttcctaaatgtatagtcccatgagtctgggaagagatctgtttttcacttgtgttttaatggcagtttccaacattgttttgttattacaagtaggtgatttttttcccctttaattaagatattaaaaataatgtgctgatggccaggcatggtggctcacgtctgtaatcccagcactttgggaggctgaggcgggtggatcacttgagatcaggagttcaagaccagcctggccaacatggcaaaaccctgtctctactaaaaatgcaaaaattagctgggcgcagtggcacatgcctgtaatcccagctgctcgggaggctgaggcaggagaatcgcttgaacccaggaggcggaggttgtggtgagcggagatcgcgccactacactcaagcctgggcgacagagcgagactccatctcaaaaaaataaataaataaaataataataataatagtgcactgaaaggagtggcggagttgggaaattcgtaaccatcataatatacatgtaataggtttgggaaagaatcctcaaaaatgttaaagcgagggaggaaagtttgttgagaagcaagatgttttcatggtctcatagtgttgttccctcccgccccctcttggtggtcagaattgtttagtgtaataaataatatggacatttaaaaaattgttttttgcttagttgccgtacgaattaatataaaattgaatttgatgtttacaaaccaaggattttgattttaggttagaattacacttagaatcattaaggctatgtcttcagatcaaaacattctagtgataaacctacgatagggacatactctggacaggcatggcggctcatgcctgtaatctcagccctttgggaggctgaggtgggaagtattgcttgagatcagcctgaactacatagcgagactctatctctacaaaaaaattttaaaatgagctgggtgtggtggtgaccgcctgtagtctcaactactctggaggctgagatggaagaatcacttgaactcaggagtttgagactgtaatgaactctgatctctgattgtgccactgcattccagcctgggtgatatagcaggaccctatctaaaaataaataaataaaaataaaataaaagatgtaatcttaggcaaactgatcttaaattatgctagtacacttttaaaaaataattgaataagtttcaaaggttgtcttcggtcattaattcgtttagtatctcaaatgttaattagaataattggtatcactttttagattttttgagttaccttccttaggaagtctgtgccatgttataatttaatttagttcttctatagtataattgtttactagtttaaaactgtaccctaagtgaccaaataagatatctggcaaacaaagaatttgagaatgttattacgtaaatactttcgctgactttttcttctttataaaactagttgtagccaggcactacacatagtagctacaggcacggttcgtgccttaatcccagctactcaggagggtgaggtgggaggactgcttgagtccaggagttcaaggctgcagtgagctatgatcataccactgcacgccagcctcggcaacagagcgagatcctatctctaaaaataaaataacaaaacagactatgtgtggcttaacttctataaatatatgtcttccttaagagtgttaatataagcatgtgttcaatactatggcctatatataggatttaatatttttcaccaggttggcattgtcagtgctgtgtttggggtaaatataatagttttctactttgtcttacatgaggtacaaactaaaagtatgttataaagatttgtctatataagaaaactagggtcaggcatggtggctcacgcctgtaatcccaacattttgggaggccgaggcgggtggatcacctgaggtcaggagttcaagaccagcccagccaacatggtgaaactctgtctctactaaaaatacaaaaattagctgggcgtggtggcaggtacctgtaatcccagctgctcgggaggctgaggcagaagaatcgcttgaacccgggaggtggaggttgcaatgagcccagatcatgccattgcactccagcctgggcaacaagagtgaaactcggtctcaaaaaaaaaaaaaaagagaagaagaagaaagaaaactaggtggagtgtggtggcttgcacctataatcccagcactttgggaggccgaggtgggtggatctattgaggctaggagttcaagatcaacctgccaacatgacgaaaccccacctctactaaaaatacaaaaaattagcacggcgtggtgtgtgtgcctgtaatcctagctacttggaaggctgaggcaggaatcgcttgaacctggggggcagaggttgcagtgagccaagatcttgccactgcactccaggctgggcgacacagcacaactctatctcaaaaaaaaaaagaaaaaacaaaagaaaactaatatatcaaaataatttctagttagttggattcactcacttattcattcaatgacttattgaattatcatatattactagtgctttttaatacataccttctacaatttttcaactgaaaattacttcattgatcagggctctttaaactgatctccatttgcattgttttactaactatagttattattcatgtattagcactctgagcctactgtaatgatgtgtaccttaataaagaactgaatatttgtaatggctggcagtgaatttagtagttcttgaatttagagctcaaaatatgggagtaatttgctgctttatttcctttgagaggtaatagaggaaaaacagaatctaataacaatcacagattttcgggaaagcactgtaaaaccatatgatcaattctagcttcttatgtaaacatggaaagattgccagctgaacacctgtcatgctctaagaagttggggagaatttgcatttttagaactgtgagcaaaatgagaacgactgctatgttcatgctttgtgaatttagctttatttcattcacacaattcatgggaaaaaatgcatcttttaactcggtgtttttcaattcaacttttaaaatacaggagtgggccagacccggtggctcacacctgtaatctcatcactttgggaggccgaggcaggtggaccacaaggtcaagagatagacaccatcctggccaacatggtgaaaccccatctccactaaaaatacaaaaattagctgggcatgttggcacgtacctgtaatcccagctactcgggagactgaggcaggagaatcgcttgaacctgggagatggaggttacagtaagccgagatcgcgccactgcactccagcctggcgacagagcaagactccatctcaaaaaaaaaaaaacaaaaaaaaaaaaaacaaaaaaaaaaccaggatgtgttaccaaggaaaatttatttacaatggttaattacgtgacaaacatgtcaagtaattccatctggctttgtgtcaccatttccccacccttttttcagaaaccaaaaccaagaagaagaacaaacatcaaaatggacatggaaattaacaaatatatgattcaatttaatctcctaagaggttttttaaaattattttattttgagacggtgtcttgctctgtcgccaggctggagtgcagtggcaggatctcagctcactgcaacctccatctcccaggttcaagcgattctcctgcttcagcctcccaagtagctggaactacaggcaagcaccaccacacccagctaatgtttgtatttttggtagagatggggtttcaccatgttggccaggatggtctcgatctcttgacctcatgatccacccgccttggcctcccaaagtgctgggattacaggtattttttattttttttgagacagggtcaccctgtcacccaggctggagtgtagtggcacaatcatggctcactgcagcctcaacctcccaggctcaggtgatcctccatgtcagcctcccaagtagctggaactataggcgtgcaacaccatgcccagctaatttttgtattttttgtagagacagggatttgccatgttggccaggctggtcttcaactcctggcctcaagtgatccacccgtctcaacctcccaaactgctaggattacaggtgtgagccaccgtgccccatctcatctgctaagtgggtttaaagaaattcagtttcatgtcaatttttaaaatgtatggttatcaaattcgacttctttttaaaaatgcaatcagataactgtatgcttgtttgatgaggggaggaaagttaatatagccaatctactcaatatttttagcagaaattatcagagactaaggaaatgtttaagtttttctcatgttggttttaattacctaatgttttcagttttctctttcattcttgtgtctttttttcattttcagtgtttcaaatacagtttgtatttaaagatttagaagttccaaaactgtaagcacagtggattgtttcctgggatgatgttaaaattatacaacaaaatatatgaaactttgtcaatttggttattggcacatacaaaatatttacaaataaacgtgtgtgtgtgtgcgtgtacacacaattcaatgaaatagatgtgaaacaagttttcttttttttttttttgagacagagtcttgctctgtcgcccaggctggagtgcaatgtcgcagtctcagctcactgcaacctctgcctcccgggttcaagcgattctcctgcctcagcctcccgagtagctgggactacaggcacctaccaccactcccagctaatttttgtgtttttagtagagacagggtttcaccatgttagccaggctagtctccaactcctgacctcaggtgatctgcccgcctcagcctcccaaagtgctgggattgcaggcgtgagccacctcacctggctacaagttttcaaaatacatttatctgtacccatacattctccagtttgtccacaggacatcttatgacttgagcaagctgctaaaaatccaagggtgcagcgtttgtatgtctataggattgctcagatctgcccccaccctgaaagaatttaagagaatttcttgaggccaggcacagtggctcacacctgtaattccagtactgtgagagtccgaggtcagaggactgcttgaggccaggagttcaagagcagcctggacaacatagggagacctgtcactacaaagaataaataaattagccaggcttagtggctcatccctgtggtcccagctactagggaggcagaagtaggactgcttgtcccaggaggtcaagactgcagtgagctgagacccagccacctgcattccagcctgggcaacaaaaagagaccctgtctcaaaaaataagttaaataaataaataataaaaatagtttaaaccctaaacacatcttctttttcaaagaggacttcttaaggacttcatgctgcgtcctgttgatctccacttccctttttcagcgtccacacttttaacagtctcttttgccaaggataataagtatatagtttctggaatccagattcttccctgtttggacagccagggggacaatttttggtctgcaggcctttgcatctgttctgctgttgctcagcaatctcacagcaaatttgccgagcctctccggaatgcacagccagacagagctcagcgcaaaagctagagaacctggcggagggagactcacagtgccacaaaaaaactttatcttttctttttttttttcttttctttctttctctttctttcttgtctttctgtctttcctctctctctctctgtctttctttcctctctttctttcttttttcctacatggcaagatctcctcatggcagaaataatctgccttgacttctgtttccacgctgcttctgccaggaccatgcgctcggcgtgtttttctttccgctataattatccaggcccatcccagctctggtcccctcagctgttccctggcagtcccttctgctggtgaaaacacatatggcgccggcctgaccagggtgtaagtgtgtgaatatcaggaagatgactgaacgtctttgggactccgtttcctcattgtaaaatggaggttaataccagccttcttctactccccaaacgcacgtgtttgtcccggccagagggcccaattgttggctgttcacgcgtcagttacccccacaggacgggtcagccaattaaaggcgaaccaggcccggtccatctcctgacgccttttctcatcccagggctggacaggcagctggcctgggcccggctctgccttgtcacgtgcgggggccggcccgtttgcttgtctgtgtgtaggagcgtgaggtcacgctgggtgctcccgccccgccggggcctttagtgtccctggtccctaaacgccaggccgctccaccgggggagaaggcgcgaaccccagccgagcccaacggctgttgtcggttgccgggccacctgttgctgcagttctgattggttccttcccccgacaacgcggcggctgtaaccaatcgacagcgaggccggtcgcgaggccccagtcccgccctgcaggagccagccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggtgagcctggccccagccctgcgccctttgcgccccccacgcttgttctgcgtgcgctgcccgctcttccatttaccttctctcccacccaagtttgtactcttttctttctctcggttttattttttgtttttgtttgtttgtttgagacaggctttcgctctgtctcccaggctggagtgcagtggcgcgatctcggctcactgcagcctccacctcccaggttcaagcgatccgcctgccgagtagctgggattacaggcgcccgccaccacgcctggctaatttttgtgttttgtagagatggggtttcgccatgttggccaggctggcctcgaactgctgagctcaagcaatccgcccgcctcggcctcacaaagtcctagaattttaggcatgagcctccgggtccggcctgtgctaatcctttctgtccttggttctttatttctcttctctctttttcttagtcccttttgttctttccctctcccgttcagttggctgtcgtttgagcctccaccttttcactccctcctttccaccacgatgccgagccctgccttggatggggaccatcagcgatgaccacaatgacctctcccttaccaggcagctccaggcagtgttcctgcaccgcctttcccagggcttgggggctttttctagtgggctttgagctgctcaatctggcctctgcagggccggctcccagcccttccaacctcctcacagcccgacctgggacctagccaattcccggagagtctctgtcccatcgtgaccccctcacaactctcccactcaccaaagtctgatgactgtgctagggggtgcttatatagagtactgagtgttacaaaagcagaagtctggatgagaaccaatttgtgatattaagcaggtggggtgggggtggggagtgtacctaggttcattttccgccctgcttttcccctttccagtgtgtgcacttaaccagtccctgggccctgttccccatccccctccaaggcatggattgggtgggcttgtgtgtcttggggcaggtggccctttctaaactctctgcctttgctcacccacaggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccgggtaagagtccagtccaaggaagaggtctcttgctgcctcctaaccctgtggtctaggggcaggagtcagcagggcattaacaaaaataattaccatccccacccccgacagtgaagtggctctttccagttcacagagcactctcacacctccccgctctcattctggcccttcagctgactcggacaagccaaggatcttggtccccattttataaaggagaaaactgaggcccacgtgtaacagtgattggccccaagtcatcccgggagccagcagaagagctaggacaggaacctattgttctaacttcatattgatgctagcttttgactatccctgaaaccgagattggtaatcagcccggctctgaaactggttatttgctggggactgtaaaataggattaactatttctagtcctgcattttaattgctgttagtagggccatcttacccaccctctgaaggacctgacttggcaagcccaaggcaacattcagaatatggcagctgaacctctgtgcacttgtctttgggcagcagctgggtcttattcttctctggccttcacaacatcctgcaacccagctcaaggtcaggaatgtgacagactcatgtcatcatatctctgatgcccagagaagggataccatttgcctgagccttctcagtactgtttaatcagcctgtgagaactttccttgtgaaaggccctgtctgtgcctggggctgataaaacagcaagaacgaactgaggagctgggcagcagtgcaaagcaaatactaccagctttggtgcctgtaagtgtggctcttactcatctcacatggaaataagggcagccaccttgcagggctgctctgaggattgagctaatacagtgccctgggcgttggggtggggaaagttgtggagcacctcctgggggaagggggtgtcagagcagggaatctggggagtccgagggcaccttcatcaacccaatctgtcatttgagcaccagtcttcactgagcctcgtgggcaagctggagggaaacaggaataaggtcaggccctgttctataggtcccagtgtagttgctatggtgagtatcttcatttccctgcttgccccagccacctggagtgagaagcccaagaggaagctgggtgagctgtttgtttccatgggtctctgtgttcacagctgactcccttcaccagccagccctttcacctgagccccagcaacaaaggcagtcaggcggggctcaaagcagctgctccaatgaagtcaaagaaataagctcaggggaagaagcaggtcaccctcccccactagggtgctgggctcacttcctcctggggcagtggaggagggtgtggttccaactcagaacaaaatggggcttttggtttactttatcactcttcacagctctgacctggacccctcatccctgcctgtcttgtggtgtaagtgcggatccccctaagttggaggaaaggaaactggcccaaacaaaaaggagagcagttttctctgcatcacatggtaggccaggaggagtctaatgccccagagtttactctcagcccccaaaatcacctagctaaatgttaccttatctaagaagtccttaggttttttggggtttgttttttttttttttgagacaaggtctcactctctcacccagactggagcacagtggcacaatcacagctcactgcagcctcaacctcctgggctcaagcaatcgtcccaagtagctgggactataggcctgcaccaccatgtccagctaatttatttttatttatattttttagacagggtctcattatgttgccctggctggtcttgaactcctgggttcaagcagtcctcccacctctgcctcccaaagtgctaggtttttttttgtttgtttgtctgttttttgaaacagagtcttgctctgtcgcctaggctggagtgcagtggcacgatctcagctactgcaacctccacctcctgggttcaagtgattctcctgcctcagcctcctaagtagttgggaatacaggcgtgtgccaacacacccagctcatttttgtatttttagcggagatggggttttgccatgttggccaagctggtctcaaactcctgacctcaggtgattcgcccgcctcagcctcccaaagtgctgggtttacaggcgtgagccaccacacccagcccaagaagtcttttctgatcacccactcttccttctctcccaatggcattagttgttccctcctttgcattttgagagtatgtcctgtaagccccaaatgcagcttgaatcatctgcccatccaccccctgtgcccaacagtaagcctcctctagagtagatactatctcctgcatctcagtgaaccactgcccagcaaagcagtcttgctaaaacaatgactctagagatcctaagctgtgtgagagctggaggagagaattagactgatggtctgggaagggattgaattagtcatcttgtaccttttcttcttgacttaagttccagacctgtagcaaccattcctgcttagacatccagaacataagcctatgggtctgtgcctgttgggtcttagtctgggtgaaacttttctctacttctgtcagctctccagatgaaccacagaagcaggaatgtgggcatcatcagtgaaatctctgcatacagcagacaaagggctggtccagtggctgtttatgaggcagcgctaggagagctctgatccagactctccctgcagtgaaagggagggagcccttcatgaagtattgactgcttgagcaggaattgcttcaccagcacctaactgagtgcctctcgagctcacatcggttttccctcatgaggccacttggagtcttgctgagggacttggttctattagggaaggtgagtttggggatggtgagcagggagggcctggggacattgtggctaatggggcttttctcctcttggcttagattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacaggtgaggggatgaagcctgggagtcttgatggtgtctactctgttccctccccaaagacacagacccctcaagggccagtgtttggagcatcgagatgactggaggtgggaagggcaacatgcttatccctgtagctaccctgtcttggccttgcagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcgtgagtatggagcaagggtgtaggccccttggcccttttttctcagtgatgattgatcttagttcattcagccatatagttttttaggccccacgatccctaggaagatcaggggaacagagaactggaaggggccctggtcctccacatagttcctaagcacctgggctataccaggctctgagcagggcgtcatcccatcacagtcttcaacaccaccttgggagtaggtagtatcatcccagtgttatagaagaagagactgaggtgggaaggcagtgggtagagtggggacttggccaggggcacacagtagagagccagaaaacacacagtagagagccaggacactcgtctctaaggccagcgttcttccctttcacctccttagtatgccatgccaaccctccattttacacatgacgaaacagagccccagacaaaaggttgtctttcccagatcacatggcaggaagaagtaaagctgacctgagatcccaagtcttaggaatcccagtcctcagaaagccacttctctctgagccttggttttcacatttgtcagatggaaatgattgtgatttctcagggctgttgagcaggtaaatgaaaatgttttatgaaagaaagcaccaagtttcattttggtcttagcccttgctatgtccctagcaagaagtagatattcatagggatattttgtttgatgtgaggagttcttacagcaagagcttgtagaaggccaaaagcttctggattctattcccaaaagcaggagatgacagtgacagggtggttttggtgaggagagatgaggtagaaaatgagtgcaagcccgctggccactgaccccatggctcgcccacagatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaaggtgtgtaccagttgttttcccttccccttttcctcctccccgatactctggtctcacccaggatcttcctcctcctacagggacctctcccaatgttgctcgtaatgccattgtcaactgtgctgagctggtgacctatgacctcatcaaggatgccctcctgaaagccaacctcatgacaggtgagtcatgaggtagacggtgctgggtctcacccttcccccatgccaggagcaggtgcgggggtctagctgacaccagaagaccacatcttttcatcctatttgccctttgcagggagagtaagatatctcttacttgccatattgaagccaattgggatgaagctcccactttgcacattgaggaactgaggctagattggcaaaatgactctttcaggtcctcagaagatgtctcagctggagtccctgtctgtttttgtttttttgtttgtttgttttttgttttttttgagatagagtctcactctgttacccgtgtaatctcagctcactgcaaccttctcctcctgggttcaagcgattcttgtgcctcagcctcccgagtagctgggatgacaggtgtgcaccagcacactggctaatttttgtatttttagtagagatggagtttcaccatgttagccaggctggtctcgaactcctggcctcaagtgatctgcccaccttggcctcccaatgtgctgggattacaggtgtgagcctctgcgccccatcctcttgtttgttttttgagacagggtcttgctcggttgcccaggctggagtgcagtggggtgattaatggctcattgcagcctcgacctccctgactcaagcaatcctcccacctcagcctcctgagtagctggggctgactacaggcatgcacactgtgcctggctaatttttgtattttgtagagacagggtttttgccatgttacccagtctggtcttgaactcctgggctcaagtgatccacccacctcggcctccaaaagaagtcctggattacaggcatgagacattgtgcccagcctctctgtctctttaaaatcatgaaaactcgtagctacttaagtaattctcctgccttctggaatgatgggtgaagatcttgactgccttgcctgctcctccttggcagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggtgagcctctggtcctccccacccagttcaggcctcttggctatgcatgtctattgtgggtgggagagaaccacctggaagtgagtagcagccaagtgtgactatttctgatcctggtcctggcatttcaccagcattcacctatccccttaattccttcctcccagaattgctaccatcactgtttattaggtgttaaatggagactcaaagggaattcatgcttatagccaagcagctgtgagctcagttcattgagtcctcccagcctcctttgggacagagcaactgggttggattgaataccaggcccagtgagggaagtgggaggtggaggtgcccccatgacctgtgatttttctcctctaggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttggcgtctcctccctctcttgtagctcttaccagaggtcttggtccaatggcctttttggtacctggtgggcaggggaggaaccacctgactttgaaaatgggtgtgatccaccttccacctccagcatccaatctgaagcccgtgtaggtcatctggtccatttctctctagacccaggccctgtactaacatggggagtgcaggagccacctgagagacagcagtgcctccccttcctttgccgggccacttgagctcttactcagaatctggtactctagtgcctgccatcccaaccccccaccccagccgcaggcctgtttatctgcacaacaagagtgctcctgtgtgccctgcatctcctgcagttccagaggaacatgagactcttagatgctgttgactttattttattccattttacaaatggaaggaagacccacctcccccaaagtcccagaccttgtgagaacaagtcagtcagcctccttccaccctccacagccacagccacacccacagaggaaatgttactgaactgggtggagcaggccctgactccacagagggtgggtggaggctgcagggcaaacatctggtctctgcctgaggatactttccatttgtgttttttgttgttttgagacagagtctcacttgctgtcacccaggctggagtgcagtggtgcaatcttggctcactgcaacctctcccaggttcaggcgattctcctgcctcagcctcccaagtagctgggattacaggcatacaccatcatacctggctaatttttgtgtttttggtagaaacggggttttgccatgttggccaggctggtctcaaactcctgacctcaagtgatccacctacctcagcctcccaaagtgctgggattacaggcatgagccactgtgcctggccaggatattttccatttggagtctcaccaccacaacccccctccacctgcccctgccccagctaggcatccaaggaggccgcaagaagccagggccttggctgcacaggggtctccgcttctctgtccctgttcttatcacctgcactcagaggcaggtgggcaggggtactacaatttcaaggagtggagactgtgaggtcctggaatcccaaggcatctcctgtagggctgggcccttagaattatgtcactcagacccagtttgtaggtgtctgaagaaactgaggcctgacacaggtgatgcaggcaagaacacccagaaagtccactactgaactgggaccgggacccagtcctccttccccttgtggactcccccagagaccagtgctggggtccttggggaagcctgtttggcagctgtggagctaggccctgagaacacgaccaccctccctcttccctcagcctcaagccgctgaagccactgctgcttcgccgcctcgtaagcccaatggtcagagctggaggctagacccttcagtgcttgggttgagggccagggtgttagattggtttttggagaaggaacgagggcccaggattcttcagcttcttagtttttgacaaattgagctgaggccccatagtcctcgggagggacagggttgagtgccataagtcggcaaaccagggtaaaggtgacaggcagctcagccaggctgcagggggtggcatatacagaggacctggccactactttatgtaccttc

SEQ ID NO: 14690 - DNA, 15499 bp, Human
  misc_feature (1)...(15499): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctggcccttctgcagtttgcttgttatgacctaataactataatatcgtagttgcttgctactattctgtgggttgctgctatccacacaaataaaaatgctgaaattggcagaaatatgggataagcatttaaaattgccctcatgcctctaattgttggctgggttttttgttttttgttttctttctgatcactaaaagtgcatttgggtccttggctcaggatggtgaaccccgtggaggtttactaagagtacaaaaccatccttggaatgtaagtgctgctgcttggttgtttctttagcaaggatagccctcagattctgatgtctaagactgaatttagcccagaatcattggaccttcattttaatagaccctttttacccagttctggactgataagtgctgttctgatacctgagatttgttaggacagcacataataaagggctcaagtttattctctctgtaagactcagtggtgtggtggctcacacctgtaatcccaacactttgggaagtcgaggcgggtggatcacttgaggtcggaagtttgagaccagcctgaccaacatggagaaaccccctctctactaaaaatacaaaattagccgggcgtggtggtgcatgcctgtaatcccagctactggggaggctgaggcaggcaggagaatcacttgaacctgggaggtggaggctgcggtgagccgagatcgcgccattgcactccagcctgggcaatgagagcgaaactccgtctcaaacaaacaaacaaacaaaaagacttagcaattctgtagagggctggataaattaattttaacttttcttttttattttcctcttaggattttgaactacatataatattttaactaggtgctttatagttaaggctaatcagtcactacctcaggtccttagatgtatcctttacccaaataagttaacatctttaacttatgccttgttacgaacttattttcttattgttgaaaatgaactaaaaaagtgacagggaatagtggatgatctgaagttttaatagcaaagttgcataaagtgttggaatttagatttgcattaggtagatgactatttttccctaagagtaaaatacttgtagttactttaatgttatttttccctcttagaaatgcagttttagatgctgaaatgtaaataattttaaagctagagtaaattattgtttggcataagatttatcagttggaatataattatcaagtaatttaggcataagtttcctgtactttttcggtattgtctgtttcataagttttatatataaatttctcaaagtaaaatatggttgatgtatttttgtatatcgcctaacttactttttttctaggtccataacttagtggcaattgaactggcttatatcaacacaaaacatccagactttgctgatgcttgtgggctaatgaacaataatatagaggtaaatataattcttaaatgctttttcacaggtagaaaaatctgttgtaactcagttatatcaaacttatttagcatggagtaactataaaatagacatgtgccacattagtgcctgctgcatgtcaggaaatatgctgaggggattacattgttttcttaattctcaaaaccacctgcaggcattattactttctgcttatgaaattgaaattcagaaagaatctgaaaattcattgatttggtgtgactggctctattttggtaacttatagtttatacaggggaagtgtgtacaacaaagtatttaaaattcttttcatttggctttgaaagctgtgaaggaaacactcaagaattaaccaacttagcataaatttggaaaagcagagtgcttttttcaccactactggggtggctgcatttcatggatcttttctttccttttgattttaatgtaacaaattgaataagatctcagatggagccaaggctggtggacagagcaatttatccagaagccattttttttctctgccgcttttctccaaaaatagtacatttttctgctactccctaattcagtaagacctgagtcccctgctataccaaatttcctcttctgcatatccatggtgagaaaattgtaaacatgcaattcagaagctggaagggatcctgtgttattgacttcaactctggttaaaacagatggggtggccagacgtggtggctcatgcctgtaatcccagcaatttgggaggtcaaggcaggtggatcacctgacatcaggagtttgagaccagcctggccaacatggtgaaaccccgtctctactaaaaatacaaaaaattagccgggcttggtggcaggtgcctgtaatctgagctactagggaggctgaggcaggagaatcaacttgaacccaggaggtggaggttgcagtgagctgagatcgcgccattgcactccagcctgggcaacaagggcgaaactccatcttaaaaaaaaactggggagcttgaggcttacagatagcagttattcctttggtgcttattttgcagggcactattataggaagcaagcaccttcttaacacaggtatagggaactaatttttggttacatagctgggggtgattcctgttatcagaaaaaattccaaaatgcatacatgagtaggcacttcaaaacactcagaaagtaggccagatcacagttatgttaaaaattagcatgtagacacttaaaggatttagttttttttacattgaaactaacatcatgaaaaacttgtgtttgcggtagttctgttacactgacaaggtcatatgtgatatgatttcagattagtatttttctacaaatgaataggtttctggttttaatgactgtgccagagaactttatgtggatattttcatttaatctttaccataccctgagggcagatcatgtcattaacagattaggacactagggcttcaaaatagttggtaagctgtccagttagcaaagcaggtactccacatctgctggggtccaggagcagctcagatcataactggttagtaacagactagggtgagaattctagataccgtggccttttgctttgtatccctgttcaaaatgtacattttatcatgctaattttttattttgaagattgttaatatctatacttttattatctgttattttttattactgaatacccgcccatgaaaaaataaaattgggtcaaatttctgtcaaaaaaaattattacacatgaaacatcactgtgggctgtgtgcggtggctcatgcctgtaatcccagcactttggtaggccgaggcaggctgatcacctgaggtcaggagttcaagtctagcctggccaacgtggcaaaactgtctctactaaaaatagaaaaattagccgggggtggtggatgcctgtaatcccagctagtagggaggctgcagcagggagaatccattgaatccaggaggcggaggttgcagtgagccaagatcacaccactgcactccagcctgggcgacagagcgagactccatttcaacaaaaaacaaaaacaaaatcattgtgaggctttaacttatatttttttgcaagttggactgtgttcatgaaatacttcctacttaggagcaattgtgactttaacctaaatagtttctactttatctgatgctgcctgtgagagatccatcattaattaacatctacagatttctatatcttcataatcttttttttttttttttttttttaagacagagtctcactctgtcgcccaggctggagtgcagtggcatgagctctgctcactgcaacctctgcctcctgggttcaagcagttctcctgccgcagcctcctgagtagctgggattacaggtgtgcggcaccatgcctggctaatttttatatttttagtagagacagggtttcaccattttggccaggctggtcttgaactgccctcaagtgatctgcccaccttggcctccccaaagtgctgggattacaagcatgaggcactgtgcccggccaatattttcataatcttttacctatcttggtgcttggatatagcagatgctcgggacattctaatttgaatttgtcagtttctttagctttgtacaagttactttgataatattagcaaattagaacagtaggcaattgatcagtgtgttaaattagccaggttacagaaaggactagcagttgtcaacactatttcctggaggaagaaatggaacatttttataggataacctcaaccacagatacttcttcaagatacggttttatgaggggagttgtttgagtttaacacaaaggtgttcaggttagagtgacttttaaaggctttgcggagttttctgtgatctctggacttcaaattccacatggttatgttgaaggcttaccacgttccacatttatgtgaggacagtttacatcactgtttcttagtgggaaagggggagaagatggcagtctgttgcccctcatttgagaatccccagtacagggagccactgttactgacagtgtattgtatccttcaggtgtgtgggcagaaaaaaaaaagattaagaagctttgggttaaatgatttcttatttattttaaaatatgataattatggcatgagtcccaacagtgagaggatgtatctgtaagttactccacacttttcaattaacatgaacattttttagtaggcatatatctcaatacttggataatcacttttgttttgcttgtgtttcttaggaacaaaggagaaacaggctagccagagaattaccttcagctgtatcacgagacaaggtaaaaaaatgtttttaatgcatattcccaatacctaaagatagattgatgagctcagaatattactcagtcctaggagtaattttttcttcttttcctccctttaacactccattggaactaactgagtaaaggcatacaagtttaaaatgggttttgagtgatttaaagataatagtattttgaattcactgacataaatgcttaaaagtagatttaagcatttatttaagcatttaagcatcaagctttttaaaaaaattcagtcagtgactttatcaactttgcacatagctgaaatgactcaagattttattataataagagggtttcttggaaaaaacagtatgcacagaacagaggttttaattactagtaataattaaaatagttgtaatactaaagtgtgtataaaaatcttttaccttgaattctttgccagaaaagaatcttattaaataccaaaaataaaaatgaagcttttggatttggatttttcttatgtattcatctgaaggaaacttttaacaaaggtgacaatggtgaaggaaataaggcagaataaacaatctcccatgattattttcatttttcatgttattttacgatttcattacagaagggaaaaattcatttatagaatgttcctgaatgcatttttgcatccttgattttttttcccccctggattttttgcctttagtcttctaaagttccaagtgctttggcacctgcctcccaggagccctcccccgctgcttctgctgaggctgatggcaaggtctgttctgattcttaatctaagcctgcatgccttgttctctggtacaacataatcttctggaaacaatacactgaatagaagaatattaatatgggatactgtgctaaggtcagatcactttagtctaatatatattttaaaattatataacaatgcaatgcatagtttatattgttgacatgcttttgcttgcaatatagaagatgcacacagaaaaagtaatttaaagaggaaattatcctgcactttttgaatttcaacccattggtatttaaattttgcttgttaaattgcatgttttaacatatcttttaacagttaattcaggacagcagaagagaaactaaaaatgtgagtctcttgcttcagaatggaaatgttggtacctttggttctcactgaaacactgtctataccaccattaaagaacctgtttgtgtagtggtatctatctcttgtctgtgttatgttcttaatgttccttttatctaacctgtggaagatggcattaaacgttgttttaattagtaacaataataggctttctcactgttttgttaccttcaagaatagttttaaatttagtattttggtaggaaattcagagatttcctagatttcagagatggaattgtatttttggacatttcctttcctctttaaagatcttgagatctgttcagtactaatagatctaatgcttctttcttatgcttccagttagtttgcacttgttaccctatatatagcttcacatatgcttcagaagcttaagcaaattaaaaaaacaaatggggactgtgagagtttgagactgttttcaattcttgataaccattttagaggaaaattaaataatgtataaattattcagactcatcgctatttcaagattttctgccatttagctcctttccttaattatccagatttaaagttctgaacttcaaataaaggtttataaatgtcttatcttctctcagcccactgtgctcagatattaatcaaaccatctaaatcactgcacaagttttatttcattcatgacgtcacactgaatgtgctctctctccttaagatttcatttggtatgtcattcatgtatagttaacaaacatttaaaaatctaattactcatttttaagttaatgtgtaacataaatatactacttatatttaaatgtagttcaccttaactgacatactaaagacagattttagcaaatattttgattcagaatgatacctcaaactaccatttttctaactgccataatcctctattaaacttatataatccatttttagattgtaagatcttaaagaatacctaaaaaaaaccctcttaaatgttgatgaattgtttttccattataaagtcatttttgacttttagaagtcaagactaatacattttctagaaaacaaggtacaaaagcacttgtgattaatggtagcactagatttctttcagcaaatccttaagagtacagaggttgaggggacttctgttgtttgtcacattccgcatttgaaacaactcacagtgactgtcagcctaagaatagcaaatgtagtcttgctttttgttaaagagttcttacttataccttatggcatttttgttgactattagaaatgtaaattgagaaacatataaactcttaagttcagagacgtaagttcatggaacttttagagtttaacagtgttaatgattacttaagaaattaaactgaatagcagttctttgtgcttttaacgagtagttttgtttttaagggcagcatatacttttcctacaatttagtgtttgaagggtgggagaagaggaacgattttgaaaagttagcgaatgataaagaaaaaaggaattaaatagaacataagttggttgatgccttgcaaacaacttagagcagaacttctttattatttagataggtcagggttccagttatacatgctacctagtgtctccttctgacctcattatctgtctgaataaacttcagatgggtactggatgtatattgactactgtcaaataaaatgaactttgttttagttaaggtcagatatgatgtggttggtatgttttggaacatgttttttcaggttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtggtaagccatgacaatttggtttaggtaataaggtaggtgaccaagttagtaggaaaacgattagacagaaagaactaaaagtctcaaaaacttacataactttcagatgttaaagctgccattttagtgtcacaaaagtaatattttttccccctcatccctatttagccagttcctgttgcacgaaaactatctgctcgggaacagcgagattgtgaggttattgaacgactcattaaatcatattttctcattgtcagaaagaatattcaagacaggttagtattacttaatataaatgacggactttaatacttctggatgattctgtgatctgttttgaaaaatacatgtatttttacaattttaggtttttattctaaatcatcaagtggattttctgatagtccttgggtaacttgtagcaagacccattttgttaacatagaatgactaggacctcatgtatcagctagaaaaagctattaaaaatgagagattcttttgttctatctggctgccacattttgagtcatttaagaaaatctttttcctaaattttaatttagtagtttcattaattattttggctagtaacactgacttgcctttttaatttaacttggttttccaaagtatcaaaacgaatgtcttttactaggaaatatgtgtattttttctcgttcagaatgttttttcatgtgtctagtccctactgcatcttctccttcatgttgcctggtatgtcatttcatgcagtaatagggagaatatacatttagttgtgtgaagtgatctattagaaaatattctgcatccagtttttggtaatctgtcagcagctaagatgaattttactgcacagagtaataaacagtctaatacttcatattgaaataaatgatttttgtctgtagaaccatttatcttttttgcttgtagactttttaaacccgtagcttgtagtagaaataacagttcctagtgttttacactgtgggcctgaagaaaaaaattccatttgtttccttccttgcccccatcctctgcagaaggtgtttttgagatggagtctcgctttgtcgcccaggctggggtgcagtggcgcagtcttggcccacttcaacctctgccttctgggttcaagcgattctcctgcctcagcctcctgagtagctgggataacaggtgtgcaccaccatgcccagctaatttttgtatttttagtagagacgggtttcaccatgttggccaggctggtctcgaactcctgacgtcaggtgatctacctgtcttggcctcccaaagtgctgggattataggcgtgagccactgcacccggctcacttaatgtttttaagcctcatccatactgtagtatgaatcagtatagtcacgcaccacataacattttagtcaacagaccacgtatttgaatgtgttcccgttagattatgataccatgtttttgctgtacatttcctatgtttagatacacaaatactattgtgttacagttccctattcagtacagtaacatgctgtacatgtttgcagcctggagcaataggctatcccatatagcttaggcgtgtcataggctataccatctacgtttgtgtaagtacactctgtgctgtgcatgtaatgaaatcacctaataatgcatttctcaaagcatatccgtgtcattaagtgacatatcttttgtgtgaataatactagattatgtagatatactgtgtttaagcattcatcagctgatgtttggatttttctcacttcttggctattatgaataaatgcttattgaagagttttgaaataaagatgatgaaaagaaggtaaagtatcaagaattgttgcttttgtttttttttttgagacagagtctcactctgttgcccaggctggagtgcagtggcgcgttcttggctcactgcaatctccacctcctgggttcaagtgattctcgtatctcagcctcccgagtagctgggatcacaggcatgtgccaccacactcagctaattttttatttttagtgcagacggtgtttcaccatgttggccaggctgctgtcaaactcctggcctcaagcagtccacccgcgtcagcctcccagagtgctgggattacaggcatgagccactgcgcctggccgagaactgcttttcttaatgtttaattacagttaagcaaaaatctaaagggcgattatgccattaatgaaatatccaaagtagtagtgttcttacttaactttatttcatgaggttagcatctaagcccaaattgttaaaagtagaattttggctaaaattccataatttggttgtgttttgcagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggtattgtggaccttttgattttttatacttgggtagtagatagaaacatagaaatagttttaaatgcagtttgattcttggatatgtatagtctttatattctagctaggcttgtttcctgttggtacttgataagaatctttttttttttttttttttttttttgagtgggagtctggctctgtcgcccaggctggagtgcagtggcacaatctcggctcactgcaagcgccgcctcccaggttcacgccattctcctgcctcagcctcccgagtagctgggactacaggcgcccaccaccacacccagctaattttttgtatttttagtagagacggggtttcaccatgttagccaggatagtctctaactcctgacctcatgatccgcccgcctcgacctcccaaagtgctgggattacaggcatgagccactgcgcctggccggtacttgattagattctaattccagagaagatattggttagtataaactggttagttataaacctaccacatatatattggaaaaattaccctgcgtaattcagattaatttcataactttataataagcatttaaaattttttttcctttaatgcaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaaaaacacccaaggctgggcgtggtggcacacgcctgtaatcccagcactttgggaggccgaggcaggtggatcacctgaggttgggagttggagaccagcttgaccaacatggagaaaccccgtctctactaaaaatacaaaattggccgggcgtggtggcgcatgcctgtaatcccagctactcgggagggtgaggcaggagaattgcttgaccctgggaggtggaggttgtggtgagctaagatcgtgccattgcactccagccttggcaacaagagcgaaactccgtctcaaaaaaaaaaaataaaacaacacccagatagatacacatactccttcagacttacagacctaagctgcatttatggggtagtgatgaggtttagaacatatacatattttgttaaaattccccagatgattcttggtatgaacgactatattataaattttaagatgtacttagaaatccttaagacatctagccccgtctctaatagacaacacatttatattgcagatattacttttttttcagtttatgaccaggtatttatgaaggactattggcagggaaaatatgaatatgttaactttagcttatggcatcaatttactaaggaacaacaggctcaccaactgatgtcaaacataaaaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgacactaaagtttgtcaaaaaatgaattcttaacttttctcccagagaaagggagacaaaaggagctttttaatacctaatctactttggaacataaccgtatagagtacgaaaaattttacgacttttttcctaccagattctgacagttcaccaaggtattataacatctccatttttgcgtatgaagacagtgacttgctccaagtaatccaggtagtaaatggctagaatttgaacactaaagccatgctctgctgcctgtaaggttttcaaaagaaatctgattaatcatttcgtatgtgattcacttgatcctcaaggcaacagggatgccattgccttgatttttcagatatggaaatagttctggagaattaatttgcctcatgtttgaagagctgaactcagtcttgattccaaatcctttaagtttgacctgaaaactttccttacctggatactttttgatattctcatatgattgcatatttggtataattggctttatttttggggggttaactttttaatttacctcaagttgcaatctgcttggggggaaaagctgaaacttaaaaccaatttaagtttctaaatttataaaacattgctaccttaggaatccactgacaacaaggcttaatgtgaacagaattatactggaacacaggcaaggaaccagaaaactgaattagaaactttctgaaaagtcacgtactgatttttgtactattatttgtaaagaaactacttactgtaatttctcaaagcaaccatggcctcatctaactttttctcctttttaagaactacatttgctctctgaactacaaaaaaatcaaatttctattcaaagtttctaatactagttttcccatttctaatgtggacactagaggccctgatgattttataaacaactatataacattagtgacatcggtgctccatacctgatagaaaagcagctacaattccttttttttttttttttttttgagacagagtttcactcactactcatgctgtctcccaggctggagtgcagtggcgtgatctcagctcactgcaacctccatctcctgggttcaagtgattctcgcagctcagcctcttgagtagctggggttacaggtgcctgcaaccacatctggctaatttttatattttcagtagagacggggtttcgccctgttggccaggctggtctcaaactcctggcctcaagcgatttgcccaccttggcctcccgaagtgctgggattacaggtgtgagccaccatgcccagcctcacaattccttacactacctctttttcattgttcctcatcactacaaaaaggagagcaggaagggtaagataggaaagcagcatttctttctcttctgaagtataattttaaaaagagattaaccctgaaaatcatggttttctatggtaatcaagctttgtacatcagaaaataaaacatcccattattaaacaaatatttattaaccggcccataaaaataatgaagttactcacactgagtcctagtccattctgtttttctgatttgcataagcaaaggtctaagttctggagccaacccttcagaggtcttgagaatgaatgatgggtaagtttatttggacaaccagaaggacttttcatcacaactg

SEQ ID NO: 14691 - DNA, 15499 bp, Human; identical to SEQ ID NO: 14690
  misc_feature (1)...(15499): n = A,T,C or G

SEQ ID NO: 14692 - DNA, 15499 bp, Human; identical to SEQ ID NO: 14690
  misc_feature (1)...(15499): n = A,T,C or G

SEQ ID NO: 14693 - DNA, 85122 bp, Human
  misc_feature (1)...(85122): n = A,T,C or G
tccaccattgtcaaaagcaaaaaatgcccaaatatgttctggaattaagaattttttaggtgatataaggtagtacactgtatccatcttacagccattaaaatatcttgcatgccttagcgatactgtctctgtagtaaaatgtattaatatttctcttgcctactacagtacaagtgtttatattgggaattggatacaatgtgatctgttaaaagaaatattctacaacacagcctgtttgattgggccccacgagtgactagccatctttcagttcctctaatgtttcctgttcccttttgtcatggggcttttgtacatgttgttctccctgcctaatatgtatatctcatactcaagtttgagtatgagacacatcctcaggggagcctttcctgaaccataaatttaattcagataaatgaactttctagtttggaattatgcaaactcatttgcattatggtttgattaatgtctttttcttctactagactctgaactctgctagattaggaatcatatccttttttttttttctgaccatgttatcctctgtgcatagttcagtgtttggaagtacatttattagaagtaggtgaacaattaataggttatcagttaatagatgatcaactactgtttgtatcaatgaagaaataaaataatgagggaagataaataagaaatgctgtgctgatgttagtgctggaaatgataagaaacgaaaggcttatagcttttgagcaaaagccagatttaatcacacactggatttgcacagtacaattgaagttttattgatacacatgtacagtattgaaaatacttgcataaaattcccatgggaatgtattattatgactgttgtattatagcattcatgcccccatctcctcgtatttttattatgtaagtctgaaagcactaggtttttaaaatgacacagccatcattcagaacatgacaaactatatcatttccagtcatcctactacacagaataaatggaataaaaaacgcttgaaagattttttaagtcttgaaggaaagcagacttaaaatttatacacacacacacgaaggtgctgtggtttattctaccaagggaaattgattttcacttcatctggaagtgcaaactgaatcttgactgataaggaggtgttcattaaatggccaaaggaatgtttcatttaaatgcatatttttacgaaagtatatagtggctttgtgaattgacaaatagtgatttggctggaggctagggcaatttgcaagaatttgaaaagacagattggggctatccagattagttcattgtttggtatggaggtcatcagaagtttttaaggatattctgtgttgtgaagaacagaagtgctggaaccagattccctgagtttataaccccaagctctgccccttactacgtgaccttgggcgtattgcttaatttttctgtgtctcagtgtctctatttataaaatggaggtaataattatagattgctattaggattgaatgagttaagacatgtccatgcttaggaaaatgtctagtacatagaagaatctcagtaaggcttggctcttgttgctattattgtatacattgagaaaacctcaaacattattgttgcattagtttaaccagaactagagacacaaagagattcaagaggtattttaggggtaaagttaacaagacttcaacttatttactaattttgtataaccagaaatttcaactaataatgctgtgtgcagtgtaaaagcaaatttgaaatttgtataacacttacatgatttgtaaacttacagattttaaatcttctaatttgtgttttcttttagatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtaaatgaaaattttaatttatttaattgatatgaatattcttttaaaaaaagaacataggacagaatggttgggtttttcttaaacttaattttaagtctaaatatttttagttacagactaaatgaaaaattctaacaatcataaaattgtatcttttcatcatctgctttaaagagacttccttattatagatatatgtcaccaaaaatatagatactcaaaagtaaaatcaccacaatccccaccattaccaatccattgtatagatttctcataagatatttagtcttctatgtatttgattatatatttgactgttagtcttttttatattgattatttttaagttatcacatctgtttttataattagctaagttaactataattatcagtgaatgtgttctagtcagttaaattttctggttaaccaatatgtaatgagaattttttatacttattgcaaatatttttaaatttatatatgtacctcagttttaattgataaaatatattgaagttattttatggtaccagtgtgggtaaatccttacagattcaaggtaattataatgatgctggtatatgaagaggccagaagttttaagtgtctaatgttggcttaacaaactatggtccatgggctggccatctgttattgtaaataaagttttattagagcactgtcatgctcattcatttacatattgtctatggctgctttcgcattataacaacagaattgagtagttgccccagaaactatatggtccataagcgtaaaatgtttactctctgacacttttagaaaaagtttaccaactccttagttcagaagaaagaaggaaaaataatttcatagcatattataaaggaactactggagagatgctatctctgggaaagttgcgtatcaggagaagtttcaagaacaagtggtttcagaaagtttaccaggaacagaacgaaactgaagatgtgttctgcaaatctgagtagtaattcactggaatatagatataattggagataaaactcaactgagcagcctgtaaggaagttggtgggagagatgagggttgcccatagactgaattaaagaggaggccctggtttcaactcatgaagattgttcaacaaagacataaggcccacacagtatgattcattatgaaggttggtacaatagggaagattggtaaactatccatgctattattccaaaggaatcattccaagcaaggctgcaaattatcttcccttcacaatctgaggattatgaagtgtagaggaggcatagggacctgcttcatggatatatgcagtataaatataaaatagggtttattggggaataacatacaagcaaagaactggaggacacataaaattttcgagcccttattattccatagatagtcgtgtttaaattggacatagctaaactggacctacctatggaagggattcacatttgtagagagaaagagcagctaggaatgtgtaggtgacggtaatggaactttttgagttgaggaaatgaccttgttgaaaagatagatactgccactaagcaactagaatgaggctgttcttacgttggacttagctgctgtgtcagcttcttgcctagctgccaaatggggcaaggactatctgaatttctgtctcagataattttggcaaagattggagaaaagacataaaagaaataattggacagtttatttttcaggttaaattagacacagaaacaatttgtcacaaactaaaagagtatctttattgattttagaatttgattctgatttaaaagtttcatgtttcttcatgaaagggagaaaaactgtatctttgcagaagaaaagagatgtcatttatttgtccagattcagatatatactatatcccaagagactgtgttaggtcctggaaactcactaaaaatatatagcctacataggagatctaaatatgtggcaaatagaaataatatcagatactgggagagtttatagaagaaaccgctaacttctgatggagtggtttagggactattggttggaggaggtagtagcaaataagagttttgaattacaggtgtgaactagcaagataaaaatcacacttcattattggaacagtacacaaataatcttgcaggtggtggaggggtgacagtatcatagacttaaagagctgcttcactttacttccacttagaagcctctggtgaaaccttatgtttgttcttccttatctagaacacttttaaaaaagtaaaccgtattaaagtataagattaagaaaaattcagaaatcctaagagtgtggttcagtgaatttttgcacaaagaagaagaccgtgtagccagcatatcccagagcaccacccgagaggcactctatcctgtctcccagttgtttccccctgccccaaggaaggtcattatcctgacttctaacactatagattaattacacctgttgttgagtttatatgaacagtgtgtcttctttcgcacaatattacatttgtgaaatttatcagtggtattgttgcatgtagatatatgtaagtatatcttgtacattttcattgatgtataatctattgtgtcagtagaatacaatttatgtatttacttttttctattgtaaatggacatttggattgttttctactttggtactattatgaagactgtaattttgaatattctcgatagtatacgtgaacacttgggtaaataggagtgcggttgctgagtcataagggtatgcatttggttagtagttgacggaagttttctaaagtagttctactggtttacactctgctggcagagtgtaagagttctagctgctccggtcttgagcaatactgggtactgtccttttcattttagtcattctggtaggtgaacaatagtaatttaatgttaagtttccatgatgtctaatgaaggtgctcactttttcatatttttattggccatttagatatatatcttctgtgactagtctgttcacttcattttgttttcttctaatgggctgcctgcttttttcttattaatatgcattctatataatcaggtgagtgttttgtccatgatatgcattataaatattagctctaaaactatggcttgccttttcactttcttttttaaaaattttattttagagacagggtcttgctgtgatgcccaggctggagtgcagtggtgcgatcataggtcactgtaactcaaacttttgggctcaagtgatcctctcatcttcacctcttgagtaggttggactacgggcatgtaccactagggccgacccattcttttatttttttgtagagatggtgtctcgcctagactggtcaggaactcctggccttaagtgatcctcctgccttggcttcccaaagcactaggattacaggcatgagccaccacaccaggcctacactttcttaatgttttaaaaaatcaataatattttaatggtttcccatttacctttttttccctttcctttatgagtagtgccttttgtgtcacgtttaagaaatctttacttaccataaggccataaagatattcttctatgctttcttctgtaaggactctttttttttaacctttcatgttttagacctgttatccatttggtgtttatttttgtgtttggtttgaggtgtaggggtcaggatttgttattttccagatggatatttagttgtcccagtacaatttattgcataaaaccatcctttcctcactatatgacagggttgcctttatcatgagtcgagtaaccatatgtgtgtgaaactgtttctaaattctctgttttgttccatttgattatttgtatatccttgcttaattctgcactgttttaattactataatttgatatctggtggtgtagttctgcaccttttttttttttttctcagaaccagctgactattcttgccctttttcagaatatccaaatgaaaccaagtgtcattgttcacttaagaaaacaaaaaacctactggaatttagatattttttttccactggatgtagggatctatttagggagaattgaaatctttacagtgtcaagtcttgtaatctatgaacatgtttgtatttcatttggttttcattaattctctccataatggctgatagttttcaaaataagtcttctacatttttgttatatttattagtagatatttgattttctaaagcattattaacatttcttctcaaattttattttctgcatatttgctgctaagtatataaaagtatacttaagaattgctagatgacatggtaactcttaagtttaacattttgggaaatgccagactgccaaagtggctgcaccattttgctttctgcctgccatgtgtcagcattctaagttttccacatcccagccaacacttgttattgtctgtctttttttttttttctgtgtaagacggagtctcgctctgtcgcccaggatggagtgcagtggcacgctgtcggctcactgcaagctccgcctcccgggttcatgccattcttctgcctcagcctcctgagtagctgggattacaggcgcctgccaccacgcccggctaatttttttgtatttttagtagagacggggtttcatggtgtcagccaggatggtcttgatctcctgacctcgtgatctgcccgcctcggcctcccaaagtgttggaatcacaggcgtgagccaccgcccccagccctgtcttttttattgtagccatcctgatgggtataaactggtatcttgtggttttagtttgcatttctctgatggctaatgatgttgaacatcttttcatgtgcttattggacatttgtatatcttccttggaaaaatgtctattcaaatcctttgcataatttttaattgttttttagttgtatgatcattttgaaagctgtttttattggttgtagaattctagattggcagttttattctcttagtactttgaagcagttgtcttccaacttccattcatttctgttaagaggccagcttttgatcttaaaaaaaattttttttttaaagataatgtgtctttcttttcttttgttgctttaaagccttttgcttttcctttgttaatatacatttttactgtgatggacccacaaggggcatgtgtcttcagatattgcttgtgtcccatttttttccttctctgggattctagttacatataacggttttgtatcccatacatttcttatgtattttgtcctcctgtattttttactctttttttctctgtacttcagtttgaatgttttctagttattttctagcaatctattttctagtaagcctttctcctgctttttaaaattaactgataaaacagcctagtacgttcttaatttctgataatatagtttcaattctagaattttttgatttttcatttttatggaaatggcccatcttgtcatccattttctccatttttaagcttttttttaaatattagccatagttatctttaagttcatgtctgtgaatagctatatctggattacctgtaagtccatatctgatccctttttctctttgttctcaattatacgatgcagtcttttgacatgtctagtggtttttaatgagccttcagaccttgtatgtgaaagagattatagaatcttagcatctccagtcttcctgctttagcagctttctgatgtctttaaagaggtatttgttgtatttcatcctgttttactagttgatttcagtgggttctttggtcttccaacaactactccctctaacctaaaagcagacatcctcatatacttaaaaaaaagaaagaaagcagtttaaaaataaaagttttttccaaaggttccaaaggtagagtacagagaacgatacttcaaggtttgctatattcattatccagaagtaacatatgtcagtgctgacacatttgttatatgtatttttatttttattcataaagtgaaaaaaattagagatttactgtcctctttataatttttcctggtctcttcctactttccttctcataaccactatcatgaatttacattgtgttttctttatattttttaacaggtattatttaatattgtttcaacatgggtttaaagttttacatagtgacgttttcatttgcacttgctttttcactcagtgtagtgttttgagatccatctgctctcattcaatacagctagttttaggaataaatattcttaattcatcaatacttctatcaaagaacaactatgttgtttctaattttttactgttataaatggtgttgcagtatacatctgttgacctgtctcattatacatgggtaaaagttgctctgtgatagtttcagaaggaattgctaggctgagtatgtccatcatcagctttaccatgttttcaagttgctttccaaagtgattgtactagctacactgcagtaagtttgtatgataattcctatttgcccatatactttgcctttccttctttctgtcttgtctgcctttcttttctattttttctgtctttgtccctttttaaattttattttattcttttttctggtcttaggaaagtgaaatgcaacctgtttttgtggtttgcttattttgtgctgggttgttggttttggtttttttctcttagaagttctttacatattctggatattaattctgtatgtattgtctctgtttcagatagtatctttcagtctttaccaaaacactttgtaaacacttttatgacgggacttaccatagtgttgtatattgcccttatttcagtagattgtgagcctttttaagtgtgttaagacttgctttatttcctaaatcaagattggtttttttaaatgttccgaatggagttgggtaaatatgtattctttgattgttggatgcatgcatctccatatatctttcagataactctcattgttgtgttctaaccttccgtattctttgtgactttttgttttttgttcattgagacttatcaataattgtatgtaccacaatggtggatttgtcaatttctctgtatattttattgatttaataatactgttttatacattttgggactatttcgttaggcttgcacatatttagaggtgatgtaccttcttggcaaattttgcaatacatattgaccatctttatcctcagtaaggcatgtttgtcttaaatctaccttacctcaccttgatatagctacatatttcttcctttccttttctttttttcttttccttccttcctccctctctccctccttcactccctttctcccctcccctcttttctttcttttctttttttttttttttgagacagggtcttgctctgtcacccaggccagagtgcattggcatgatcatggctcactgcagccttgacctcctgtgctcaagcaatcctcctgcttcagcctccagagtaacatgggtatgcgcaccatgcctggctaatttttgtactttttgcagaggtgaggtctcaccatgttgcccagactggtcttgaactcctgagctcaagtgatcctcccacctggccctcccaaagtgctgggattatagtgtgagccacggcgcccagccagtgttttcttggaggtctgaaactctgtgttatctttcaaccttactgtttccttatgttttaggtatgtcttttatagatagtatgagaggctgcatattggttttttatctagtttgatccatctcttaacccaccagtctagttgatgtttattccctgtgatctcgcacgtatttgcactagtttgcgtgatcccagtcgatcatataaatgggttagcgggtcccagccgtcgaaaaagccatagtgtccgcaaagaactctgattgcagctccacacagagccccccagggaagaggacatcggaagaagatatttcatctacctggcaatccaccaaacgtggaggttctgagtaagaatggttgagaagtcaccctgccagaggttagtcagtttctacctgatgtcttcaactcctatctccagcagagcttttgtactgcccaggtttcattctggagggcgtctgtctgcatcagcatggctgccagttctcttgtgatgtagcaggcattgagtgttccaggcagcggaggtgagaagcacaagctgaacccaaactgctgttttaaaaatttgtcttctcggccgggcgcgttggctcacacctgtaatcccagcactttgggaggccgaggcgggcggatcacgaggtcaggagatcgagaccatcctggctaacacggtgaaacctgtctctactaaaaaatacaaaaaattagccaggcgtggtggcaggtgcctgtagtcccagctactcgggaggctgaggcaggagaacggcatgaactcgggaggcggagcttgcagtgagtcgagatcgtgccacttgcactccagcctgggcgacagagtgagactctgtcttaaaaaatttgtcttctcataatcccactggccgatttcttctccaggctacaagcctccacatccctgaccccgtacattttccagcataccctctggggtttctcactttttcttcattattcctttacagatttattcaacaaatttgtttagcaccgcctcactgccacacagtagctttgttttagaagctgagcgtgcagcattgaacttttttcaacttatgttctactcagatgactggttttttttgtttgtttgtttttgttttttcagcaagtaatgcttgttggtttttttgcccctaacaagggcttgtaggtgttatacttcctgagtttttttatgtttgaaaatgtttattgtctttatacttgaagtctgacttggctaggtctaacgttctaggtataggccctatttcttttccccagaacatcgtagagatttggtcttctgactttgaatgttgccagaattctaacaccagactgagttttttcccttcttaaaagtcactcacttccttccttggtgtacatggtattctttctttgaccttgacattcagtaacttaatctgaatatgccatgaatttgattattccttatcacttttttgagagattgtatgcctttctgtattttattttttaataaatatttttcctttgctaaatgctctgggcttttttggtatcttcattatctgtcaacaatacaaacaacttttttctattcattttagttttctgttttgattctttgattttcattattgtgctaaaaatctctgttatgatttgattttttttctcttctcattcatttccgagccataccagctcacattttagatctgttatctctgacagtttttggcaattatattaagtatgagttaacagaaatagctttcctataaaattattttctttatttattttggtttcaccttccctggcattctacatttagaacaagattcttcacttatttcatgggcttctgatacttgtgaatcttgtagcactaatcagaggatcctctcagaggacactgccacttttgtgaagaactcagtgtgaattctctgaatccactttcattttcttctaaatttcaccaaatctggcagatgaaaatttgtagttagggattcttactttccttgaagaaaacccagtctcttttttagtattatgtatgtgtatgtatgtatgtgtccatgtttttagaggagtagagaggagtaaacatgactttattccattttgaatttaaaactaacttttgtgatttcttttgaagttaatataaagaatttacatcattttaatgtaattgaaatcagtttaaaaatattgtcttagaataataaagttgagtcttgagttttaattatgtagttagtattctgtagcctaattttagattacgttacctctttcatgtcaaatttatgaactgaaacgtggctgtattgtaaaatactaattaacactctactaattagttggcttttactgatttttcacttttagatgtcttagaaagctagtatgtagaaggaaaatctctgtatgacaaccaaaaacttactttgaactgaaaacactaaaatcaagggaaaatgtactcttaacagcttgttttcttgctttgtgacttgttatattttgttataatctaatcttctaggcatatactcatgtcataagtgatagtatttttcattcctttccttattgctttcctccattgtattctattttgtttttgtttgttcccaaatgtatttgtaaaaacaagtacatcaacagatgcggaggtttttctacttgtaatttctgttttatattgagaatttttttttttttttttgagatggagtctcgctctgtcgcccaggctggagtgcagtggtgcgatctcggctcactgcaagctctgcctccagtgttcatgccattctcctgcctcagcctgccgagtaggtgggactacaggcgcccaccaccacgcccggctaattttttgtgtttttagtagagacggggtttcgtagtgttagccaagatggtctccatctcctgagctcgtgattcgcctgcctcagcctcccaaagtgctgggattacgggcgtgagccaccgtgccctgctgagaattttaaagtatcaaatatagaccagtattcaaagatgattcataaaaggtgatttgggtatatgacacaatttacatgtaaatatgtatcatgaacagactagatggtattggctagttaaattttcttgttaaatgaatatttaaagaaccttctcaactctattttcattcagtttactagctaacagaatatttgagcggtcatataatacgtggagtattgtgctttgtgcacttgacaaatacagagaaaacataaggttttgagactgttaaagagattagatctacataaaattaagagggattaaggtgattaaatgctaagatgagtagatgttaaatgcatttggtgttactatagggagaaaacagatactctgcttaaatttagtgaaaaccattgaactactataccactgtttaattttatcatgctacataggaaatagactgaaaaaatacagaaacatcattgaattgtacatgtgaaatgaattttgttgttgttttgcttttacatgtacgtattgtatctgtaatgaaagaggatattaaagtcatgcccgtgaaaaaaatttctagtggtagtaattgcttttcatgatactggagatcctctacttctttaatagctactgcaataactgattttaagtctaggccagtagttaaagtttataggaagaaaatcgtatgataggtatccatggggaaaattgctgaactttatgttgttgcacaattccaaagattattcaaaagtatattcttactgacctttcaaaaactgttttttaaatagactttatgttttagagaagttttaggttcacaacagcattgagcagaaagtaaagagagttcccttgcattcctttcccatcccgtattagaagaagagggatcaagggtaactcttgctcaccccaaggagggttgttgggtggtataatttttgtatggcatgagcttcagagtatttgaagtttttgaaggggagggaaagaaaagtagtgtcgaagagagaatacagagcataaaaagacatctcttttagggccttcagtcaatataaagggtgtaaataaaaaaattttttgggggggtctctgttagagaggatttcaggtaacaggtttcagttaaagaaagaaacagttaaagaagaatttgaggactttggggaatttgctgatcccagactgtgaatttcagtgggtacaatagagaagggcttgagagggaggagaaatacttcagattagtggatgtatttagttgtttagggatcaaagtctggctgatgctacattacgtggctgggatttggggtttctgatggtaacaattttaactgaatgataagggaacactgatcaactgttccttctgtggtgcttcaccctctgtagtggagtggcagccaaggataaggaaatacttccccaggagacagctctgtcggagaacttggcatatacaaaacaaatgtaggactgtagcacaacaggagagggaaggctcatatggaggacaaagctgggaaccttttccatctttgaaatctggctcagtattaagaagaagattcatcttcagatagcccatattcaagtactactaatgcttttaataaaaatataccttttttattgtttaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgaggtaacacatatctagtaatacgtgaattgcaagtaatactgaaatattttgtttaatagcattaactgtcagaatgacttgtacatctaaaacataaattaggtgtatatgtatcttttctctaaatcatttcttagaagagtgattgctgtatggcgactcacttgtgttataaacatactctattcattcagacaaagtaaactatgttgttttaccatgtataccagcataatcttaacatttcatctatgattacttattttgtatgagttttaaaattaatattgtaagagactatcatttttggacagtatgaagttacagttttggtatgtcttaatcatttcattatgtcattgacagctcacaactttaaacacttaagaaaacaatgacaattatgtaaataatatttgctttgttaatagtgttttagttgggcaacaggagaaagtcctcattttctttgtttatctgctgcctatttgatagctctcatagttctcccaacctaattaagtgaaaaagaaaaggatttattattagaatgatcttctcagaaatagtgttttacaataaaaccttcaaaatggaaaccagtatgcttccccctttttatcttctctctttcaagatcttccataagataacttttccatgtgtatttctaatcacattttaaattagcttcatagttacttttgtctcttttgtttatatttggaggttttatatttattcagtggaggaattttttattacttgaaagatgcatattttggcttagtttgtaatagaaaagtattaggcatttctttggtgaaagtactgaaaccatgtgaggattatgtagaacaattgaaaaagaacaaatggagtcctaatctagatggtatttctaatatttaaaattaaagataatttagctgttttgttgtataggaatctaatttatttgcctcctcaagttgttattgttccgaaaatgcattttaaatttcccctatacttctttgccttaactgtccctctttaggcagtgattgataccattactacacacataaaaactattacttgtattttaaaaacagcttttgttactttttagtcattttttcaaatgagaagtaaaggtatagcataattacagctaggactcatctctgttgcttgacttatccatagttttatttatggggctcactgctgttaacctcccctgaattgtatatgaaattttttattttgcttttgttgataactttgattaaactacatggttatatctttagctaaaccccttaatgcagttatatttatgtcatttataaattatattatttagcagttatgttatatgttatcatttatttataatactgtatagtagacctttcccctattacatgtcatgaatacattttgtattgtaatattgtaaattagggtatcattcaggtaagctttgttaagagacttcataactggatttccttgaaatggagagtaaccctgttgtgtttaaaatagcttcttatcttataaatctatatgtctcatcaaaagttacactgcctcaactcaaaccaatggagctgactttgataatgtcagcaaataagtattctagctaatttcattatagaggcaaccacctccttaaccctaactacactgctctttcattgcagcagttgttattcttggtccgtggaggttgagggtacttcacactgcctaaagcttacttccctagagaatacggagaatgtagtctgatttaatcctcatagaattttcagactacctcaatcttcatctctgttgtggacagcaaagtgtaagagagcagatcccaaacatttttttaagcagtctcctatattacagtctgtttcaatatgaaggaaaacttttgcggctcaattacatattgggattttgatgttttctttttaattgcatttcctcaaaataagttaaaatgaatcgtgttaatagttccttgtgaagttctaaattatataaatacagtagatagaagacacattagattattagggattaatttattgtggtaggataaattacaaggcttaattcacacttcttgtatattaatgtcttactgagtcaacttttattaagagagtggttgttaagcttgtgagataggccttttttcacatatgaagatgatgcagcctacatcttcactagtagtgcaattcacatacgagttctttttgccagtagtgtaatggcttacgctaatgcatctatacagtttgctatggttcaaattaaatttacaggataacagtaatgaagttacttacatagagcttcctatgggtcttagtttttacaaagtactttacagttgcctcattgaaggatatttttggaataccattttttccttttcacagtttcctttcaggcagttgtattgatgggaagcaggctttttgatgcccatttactcatttgacaaagatttgagggggttctatgtgctttgcaagttgatcttatttagagattcctaattcaggccagaagaatattcttcctacccatatttttataaaccattgaggtatacttttaccaactgaagattttatgtatatttataagaactttgaacaagttggtgataagcttctggactccttagccatctcatgtggttgaaaacatcaggataaaatagaggcatgaacagttataagtgatctactttagagtgatttctaaagtatatgaccaatatacttaagagtttgtgtcattatgtaagcaataatgacacaaactctgaaaacaacaacttccataaggcctataacctgactccacatatttccgtttgcatatatgttagtctttaaaaaatcagcaggattttactttccctatattactgaaatatgctttgacagagtcttgagtatattaacatggcgtcttcattagatgtgttcctcttctgttgcatccaatacacaagccctttgaggatgtgctgtgaggatgtgctgtcagcctcacctgtgtagtctgtagtacaggacgcacgtgtattaggtctgcggagttagatatagtgtgttttgtgggagtactgtaagattaatataatgtattaaaagtagttggtatttgaatattgttgattataaataggtagaaatggtgctcttatttttctgtgtttcaattttatgtataaacttaaatccatctatctttgttctgcctcattttatattaattatgtttttaaactagttcttaaatttaaaattttaatcaattttttaaactttggttagagttgataaaatttaaaaaattctatacaggtttatttttttaatttgtacttacatattttaaattgcatttaggtattttaaattaaggtctgcagtgtcttgaggatgtatatatcccctacattaagaaagctgaatatatgataaagcagacttacacattagtaaattaagagattgccattagggtaagattcataagagacttcataactcaatttctctgaaatgaagaatatcattgctgtgtttaaaatgtttccacactgcttttcagtagtatatttcttacaaaacatgagttttataactttatttcccatatttcattaggtgacattccacaaagaatgttgtcaaagacacacattttatcttttcaagttattaagcattgatacaaaaataggtggcagacttttgtttggtcctataaaatgtagtaatttaatttaaatgtatgaagaaaatgttataactccttagtttttcttttcagtaaaattaagattaaaaattatgaactatattatataattttacaggaatactaggtatgtcctagagtgtaggaaactacagatggaaattaccaacacaagcagttgccattgttcatacacatgcatatgtgtgtaatttgaatttatactaaataaaagcctagagccaatagaggctttgggattctgcatcaaaagaacaattatgctaaaaggcaacaaatgatacctaaaaaacacctgagaatacttttgtatccatgttttttcctgtcatttggcagaaatattgaaaatactaaatatttctgcttataattttttaaaaatagccgtgacttggtaacattcagaaatcatttgtatggcaattcagattattgtgctgtcatttaaggatgtaaataaaagggtcatggccgtttgtctctcttgttaatatctggtgcactattcccaaagagaggaggttttcaccacaggcatactacggtacttaaaaaaaaaattcttctcgcagtatctcatttaagcttcatattcaaggtaagctttttcagaagcaaaaattgggatgcacattaaaatgacttgcccagagtcatgtagcaatgtagtggcagaaccaggattaggacccaggtctgtgacattaacctttccccttgctccttagttcactgcatccaggggagctctggagcattttaccgtaagtagataagattttatacatacaccaatcatgtacgatctatagcagtcacgaataagttttcctcagtaatgaacagaaaactagtgaggataatagcagtaagaatgataggtattattaagcacttaacatggtctagtaaagacttcatttgaattatcttattgaatccttactgttgcccttatttcacattgaggcaatggagacacagtgataaattaagtcagatgttgataatttggattctgaagaaagagaaaatctgtttgagtcttaaaaatcccttcctattttcaaattacaaaagaatttggaagtaacatctgaaagaaaggaagatagggaatcagtataagatccatctatcaattagaaaataaaagcagatggtagtgaaagtgattatacttgagagtaccttatttaaaatcactggtcctcacaatgtgtagtgccctgaccagcagcagcagcagccccagaggcttcctagaaatgcaagttcttggtcccaccttagaccttctgaatctgcagcttttgagatgaagccaaagcagtcatgaattaatttgaattaacttgccttaagtgcagttatagactaaaagtttccagttaacagtttcttgggagtggttatccagctttttaaacatttttatccccaagaatatcccctgaaataatttcaaacaaagagcaagcacaaactgtaattttttaaaccctctaaaaagtaattcaaactatgcagtatttgtgtgaattgcacctaaggaatacatttctaatgggttacatttcagttcgattccacatggttataagagcttgtgtgagtgtggtttctttgaggggtgcttctttgagaggtgtggtggggatgagtcggaggtggaatctggctcttcagatgaacaaaaaagaaagttaaatgacctatctcctgagatcatctagtgcttgaccttacaaaagtagaagcatgattatgcttggattttctgacagtatcatgatattctcaaagaggctttttgagccagtcctcttttctccccatgttatagacgaggaatggaacagacagggagtatttaagaggcttgcctaatgttttacagggctgcagtggagcatcagggaaagggaaaaaataatgagacatctgaagacaagacaaagctttcctccacctccagtcccctgccctgctcttttattcctaacagagcctgaagcagcaggatgatgattcacagggtgaggcacatagtcctcatggctctcctccgcttcccacatgtcactgcaccatcgcctcacacagcagtcaccatagctcttgtaatttcagttttactacttttattttgctgtgcatgtgaatattatttaatcatacaattattggttttcatttatgtgctttgtataagggactacacgtctctaagtgtggtttttcttgaggtcatattattctccattagaggttcatgtcattgatacacaaatgagagttcatgtggggaggaaaagatgatagatatcacttgtatatataactgaacttttttctgtaatacatttcttgtgattattgatggatacctccctatgtgttctttttatgtcatatgtgtcagggattgaatattttattaatagtacttaccatcagataaagtgttcctttttctccagaagatatttgatgctttggtcaaatttttgaccaataagaagaggagataaagaggatggagataaagttgctctagaggtgatgctatcaccagagttctttaaagcagcagtccccaaccttgttggcaccagggatgggggttgggggtgggaggaatgtggacagggagatggttttgagatgaaattgttccacctcagatcatcaggcattagattctcataaggaatgggcagcctagatcccttgctcgtgcagttcgcagtaggtttcattctcttacgagaatccaatgctgctgctgatgtgacgggaggcagagctcaggcagtaatgctcacttgcccaccacttacttcctgctgtgcaacctggttcctaacagggtctgtggccccgggggttagggacccttgctttaaaggttatggtaggtggaaaacaaagatgctctaggtcagaggggcagcttatatggaaattaggaaatgagacactgcagttagtgtacgaagttgaaatcagccaagtgtcactgtagtatactgtgaagagtggaatagctaagacctgagaagtaaaccaggtccacatgagctatataaggcccttcactttatcctgcaggtttggatagccactgaaagagctgaataaaatagctgcttaggtttctccttgcatttcccaagcagtaagttgtgttagaactgcgtggtaattttttgaagggagttgaagaaaaaggaaaagaggtaaaaatattgaatgtaatagttctacattttaaatttattgtactgatgtttgtcgtactatgtaccaggcattttgctaaacactgggaatatagtggtaactggccctattgctgcctttttcctaataagatgatatgctggctattttattatcttatggcagaagtgcttttgttagatacacttcaatatcgacttaagacccttagaatgccaagatttttatgtttctcatcagatattaatcattaagcatataactattataagataagatattatactgctattcaagccagaagttcatttagggcagaagatactaggtgcttcccgtgtttctcaatgttctgtgtcagcctgtaaggtgagatgtatatagtctaaatgatctttcagttctcttatatatagatgggtaatgcggacatgcagttttgtgaaacctggcacttcaaacacacaatttaaaattaaagagacagctgtatagttttcatatttattttgaagttatttttgtggctctgttctcagagagagactagggatctagattctacagaaagacaccttcttgcatagattagtcataactcaactttttaatttacaattatgcaatcagtgctgtactggtaaaagaaattccaaatgatagtatgaattatattttagaaaatgagacataccttataattttctaggtttttgtttagttggttgattttcaaatttctaacgtgtttcactgattgtgtatgctaagggtattttataaagaaaatttgatatgggattatggttttttcctcaaataatgtttcttgtagttctcattttaattcattagcagtaaaacatgagaaggtaaaccttccatattgtttttaaaatgttagtgatttttaagacttggtaaataggcactacatgcttaagccttctagaataacccaaagctttattatgcacgttggactttatctcctgtaactcagtggagaatatttttctgtcatgctttgtttttatataaattttcttttcaaatatctggtttattttgtggtaatttctgggcttaagtgttatttccagaatgtatctcgaaaactttaaaaatgtttatgctctgaaaaaagaacgtagaagtagcaactagtatttgtagaggaattcaagacattagcttgctttttttgcgccacccacgttcatataggattatcccataatattatataattaaaatatttttattgtggttttccacatttatgtagttgaattaagtttttaaaaatggtttcgttactttggtctcttataaacctatcagttttgtgctgtaggacagtataaaataatgttttagatattttgtgaaagttatttgatattagactctcaaatcctacttaatatgtcacttattagtaaagtagatatctgtatttaatattctaactagcatatatttgctatattatccatttatttattgaatggttagtgtactgggttactaagctcaatgtttaatagggcagagagaacagtattaaaattttaaatcttattaagttttgatgatcagttaaaataatgtatgtgaaagcattttgagaactataggttgcttctggatgcaggcaacagaagacctcactgaaattggtcttaaaaataggggtattgggggacagagcgaggctccatctcaaaaaataaataaataaataaataaaaataaattaaaaaaaaaggggggggtattggttatttcatgtaagaaaaattccagcagcatggtagagatttggctgtgttcaagcgggctccaggtctctgcctttgcccatgcatcattgtcttcacactggctttttcatgtcgataaaatggcagtggtagctctaggccttatatgtgaacacagcatcatataaagcagcactatctaatagaatttgttccatatttgtgctgtccaatatagtagccattaactatgtgtagttattgagtgtgtagtgcaactgaaaaacctgagtttttaatctttttaaattttaatttaaccacatgtggcgattggttactatattgttgagcatctatctaaagtatcagagatcagttgtgtcccagaatccacagcagatgttctaaaattaattctaattgtactgtttaaatcgcttgcctctccatctcccactctgaaaacactaaacacagtggtagagaaaggatagaatatcctgattggcttattgtagctagatgttacacccctgggatttactacaaaactaaagtaattcagtgtggtatttgcatagggataggcatgtagttcaatagaacagaatagagagctcagaaatgtacccacatatacatggttaattgatttttgacaaaagagccaaggtaaatcaatgagaaaaggacagtcttttcaataaatggtgctggaaaacctggatatccatatagaaaaaaaataagcctcagtatttaccttacatcatatacaaaatgtttatggaatagcggctttgcataggggagtaatcaaaggtaaggaagagacaaattgaatatagttgatagatggtcttgaatacccagctgtggtatttaatatttgtcctataggcattgggcagcctttagaggggtgtttaaaagttttaagtagtcaagtcattgttacaggaattaatctggcagcagattagcagtattttaaaagaagtgtgtagcttttaaaactaaactaaattatctcacttattactcatgataggctttagtaatgttgagaattatagaaagaggaatgcaattccatttggtttgaatggagaggggagattaaagtggggggttaggccatgttctaaggaatagaatatattgacacatcatgctgtttaaaaattgatttatagaaaatttgcataattgtaaaacatatatattattatagagagagagaattgacctaataatgctgtgaaaagtggtttgtgtgttataaaacagttaggaaactctgatctggctctctctttcatttaactgatgaggaagccgcgtccaaattgagcaagaaagactgtagatcctttgaggcaaagacttcgctaaggaacattagtatttttcacagtgctcagtaaagattcagcacacagcttaataatgacctataaaatggaactaaaggtagtgttgtgtacttccgcattcacttaatcataaattaagagtatttatgatactcagttaaaacttcatcaaatattacaaaatctagtagggacaaaaatataaaatatgtttaagttgaaggaacactcagtgtgtaggaggtgattctttttactctgttaacactggaaatgataactttatttccttatctccccatcctccacatctactaacatatattacttccagcctttagagaagtaaatgtacttaaaaagataagtatagaggcctctgctgtattgcagtgtatgcattcttgaataatctcataaaccgcaaaacctatgcagctttgtattctgcacatgaacataaatgataattggagggatagcttgaaatgctcagtgaggcatcttagtagctagtggccactatggtgggtcctgtaaatacacaaaattacttgaatagaaatgctggcagcacttgaattaggatgggctagtgcatcttaggacaatatgatatgatttccagtgtgataacttcatgattggagtatacattcccagagctttcagtaacctaattaatcaggttaatactgtagtagtactgtcacattaccttgtatctttataaataattgctccagacatccttaactatcatgtgaaattgaatgcatattttaattgcttattgaaatgtggtaggcatacctgagattaacttttttgctcttcttttaaatgagatataattcgtataccataaaattcaccagtgtagattatgcagttcagtggttcttagtccattcacaagttggtacaaccatgaacgctatctaattctagaacattttcatcaatccgaaaagaaacccagtacccattagcaatcacttaccaactcctccttcccctacatcctggcaaccactaatgtactttctgtgtctatggatttacctgttctgggaatttgatatagatggagtcatgcaatatgttcttttgtccagctttttcacttagcataatgttttcaaggtccatccgtatggtagctgtatcagtccttcattctgtgaccaaatagtattccatttgctactgtgaagtttgtatacaagttttggtatgggtataagttttcacttctcttgggtatctagttagtagtagaatttcctggattgtgtggtaagttctgtgtttaactttttgaggaactgccaaaccctgtcctacatctaacttaaaaaaaaaaatagcaaaaacatcaactaaaaccaataactttatggatattattagaaaatggttgattttttttaaaattttgatattgttgggctaggttatctggatcaactcttctgttgaagacatctaaaaactagataaactgtaaaaacagaacaaaaaaacttttttacgttatcaaagagctcaaggaatatgccaggccaaaatttaagagaaggtaagaacataaaggtaaaaaagtatttaaagttctaaccaccctgaatcatttgcccatctggataaagcagtttgtaaaactgagatttgggttctgatagatttgggttctgatagattcagaatcaaggggaaaatgatcacttctaggtttatgagcctaatagatacccccaaaaccctttaaactggggccttaagaaaagaggaaaatccactgccttctcctgctcccaaaggattccaaggagagttatttagtactgagcagataggggaaagaagagaacacgaaaagaaaaatagaacatatctgacagattgtaaaccaagttaccagcattgtgtggaatcgtagttccaagtcatataataccagacattcaagaaaactagtgccctgttaactgggggaagcaaatttatatcctttttgaagaaagtcaccttattctgtgtatcagaaatctctttcaaataacctttcagaactatagagcatcatacaaagatgaccaagcatacaagaaaacaaggcacagtgaggaaaacacagcaggatacagcagaaaatagctcttatatatttcagatgacattgttattatatgtagattatagaacagtttcactttctatgttttaagaaataagcttgaaaatatcagtaggaaacaggaagttatataggaattgacatagcagagttgaatgaaatacttcaagatgtgaaaaaatacgatgaccaaaactaattaatgcagtaaacatggtggaagtagattttccataaccgcagagagaatttgtgaaccaaagatagaagaaattatctagaattcaatgcaaatattaaaaggcagaaaatatcaagaaaggtttaaagaaaaggaggatcatgtttagaagttctagcttatgcttaattggcattgtagaagacggaaacagagaatcgggtagaggcaatatttgatgagataatgacacaattttctaggattgatgaaagcccaccatccttagatttaagaaattcaaatcccatgcagagtaaatgtgtaaaaaaaaaaacaaacaaaaactctatatagacatagtgaaactgtgcagaaaacaaagacaagaaagacgtaaagaaactatcctcaaaagagtgctatttccaaataacaaatgaaatctggagtcaatgaaatgatatcctaagtgtgctgtttaggaagggagtagaatgcaacctagagttctatacccagagaaaatttcgacagggaaagcataacacctgtatatcagtgttacaatcaaaccatctactgctttggaagaaagggccaagaccaagtcaggctgccatggtaagcagtcttcatcgaatgaccagatgatctctacagtcttcatgtggacgatgatctatgtctaatttatcagtaaatatcagcatctagtagggtgctttcgataaattttgttgaatgaaagaaaaaaggcaaattaaggtatttattcagtaaacaaaaagggatagtgaagaaccaagctccaggacttttgaagatagactttcttgtctgtggtgcactgagaatcagctctatcttagtattcatttacgtgtggagatctagaacagagttacattctttctggtgacaagctgagactacctggctgctcagtatccagctcctgggagacaagggcctcaaaactgttgggattggggggtggggcaggtagggaatcttactaccatttgttaggatttttaccatcaaacctaggagtagcttggaactgggtaagatcttagaatttagagaagccatagcctgaacaccacacacttctcactgaggaagataggggtgataagatcatggaggaactggagaggaatatgaagacagtgcctacaaccaccacatacacagtaaacattctctcttctcagtggttgaagttgttcctgattacagctctcttatctgttctccctttgatttgctgactgatggatgcagtccatttaagaaatgagcatagcatattggaaagagcactagacttagattctagtcccagttctgtcacttaacagctatgtgttgaggtgaggtgagggaagagtacttggatctctggatctcttttaactttaatattctcctctataagggtagaagatgaactagaggatcacaacagtaccatttagttttccgttcagtggcaattttgacatacttttttgagcatacataatctcagaatcctatgcctcaaaactttgattcattggacagatttcaagaaaaatataatttaacaaatgtaataaagaaaaaatagaaaaattgaataatcttgtcaagttttccacaaaactacaagtccagatggctgcataagaaaatactagcaaatttttaagaaggaagtaattccagtatttcacaaacccttccaaagaatagtaaaaacaaagagctttcctttcctcgttatctaaaattagcctaactttgatagcaaaaccagctaggagagttgcaaagataataatcagaagccagtctcactgaacataaatgtgaaagtcttcagcaaaatattagtctacttcgtgttcacatctttcttatgggagacttttttgtttgtttgtttttgagatggagtttcgctcttgttgcccaggctggagtgcaatggcgtgatcttggctcaccccgacctccgcctgggagacatttttattttcagaatgacccattttctctactgtttgggcacaaaactagactctgtattagcctcccctgtggttaggagtggccatgtgactgacctctgaccaaggagatgtgagtgaaaatgatgcaggctgcttccaggtgtgaccagtaagatacttcccacataatcttcgtactctttcttccctgtttggcatcccatgtgctaagaatgggaaccctgaggtcctatatgtggaaccataaggtaaatgtctttgggctctgaatctcacacagggctcactgagaataagaaacatccttcttgggctttgtatgaataagaaagaaataaactttcattgtgttaagccactgagatttatggatttattaaagcatctagcattacttatactaatacagagattaaatctagtgatatgtagaagagataatatattatgactaagttgaatgtatcctagtagagttataccatattcatagatcagaagtctcaaattatatatatctgtgccacataagataatctctgtagagttgatgaaatatcaatcagaatcccaagaaatactttttgaaagaacttcaacaactgattctaaagttcacagagaaaatagaacagaagacactgaagaagaacaaggtgagagggtttgcactgcaatatattgagactaattttaaagctataataatgaacatacagtggcagtggcacaaataccaaatgccaaacgtaccaatggaataatagctcagaaacaggaccatgcatatttagatacttaatatatgatagagtggcagaacaaactccttaagcagtggtatagggacaattgggtatccatgtagaaaactcatgaaattggacttacctcagattttatacaaaattacctccaggatgcttatagacctaaatgtaaaaggcaaaattataaagctatttgcaggataatataggagaatatcttcataattttggaaaggatttcttatataaggcataaaaatcactatcatatggataactggaaaggaaaaaactgataaatttgactccgtttaagaactctgcatccaaagataagcgtttttttttttttttaatgctacataatgggaagatatttttacaatgtataaaattagccaagggcttacattgactacttataaaataattactataaaaataaataattaaaagaactactataaaacaattatcaaaaggcagtagaaaacttagcaaagtacttgaataggtgcctcacaaaagagaacatccatgtggcctatagatatgaaatgtgcttcatttcattagtagttggtattgcaaattaaatcccacaggtaggaatgcatattgatacaattactttaaaagacagtttggcattatctagtataactgaagatccacatgttttatgaactaatacttctattcctaagaatacatacccaagagaaatgtgtgcacattatgcagtagactatctacagaaatgtccacagcagcatttttatagattcaaaagattgaagccactccaatgtctgtctgttgtagaatggataaagcttttttttcaagccatgtaatacagtatttagtgaaaatgagccagctataactctgtgtaactctatggcggaatctcataaacagtgttaatactgaatagtgtactgtgtgtggttccatttacatatcattcacaaataggcatagctaaattatatttttagggatatgtatatatgtggtaaatgtataaagaaaatccagataattgtcatcacagagttaggatggtattaactgtaaaggtgggaggagagggttatgggatgaagggagatagggagggttctggccttggtctatttttttgacttgattgaaatgactgatgttcactttataattatttgttgaattttatataaacttgtacataccttacatatttcacaatttttaaaaattgtttttatgtgttgtcagagtagctagaaagaatagtatatgtttcaaaattggaaataattatttacaatgaggaaagacaacttttctcatttttaaaatatcacaataatctagtttcaatttcctgaaacttaagacatgatttcttttttcctcttttttttttttttgagacagagtcttgttctgtcacccaggctggagtgcaatggcaccatctcagctcactgcaacctccacctcctggggttaaagcgattctcctgcctcatcctcctgagtacctggaattacaggtgtctgccactacgcccagctaatttttttgtatttggagtagagacagggtttcaccatgttggccaggctggtttcaaactcctgacctaaagtgatctgcctgtctctgcctcccaaagtgctaggattacaggcatgagccaccgcgcccggcccaagccatgatttctttattttacaagcacttgcttatacttatgctagatttactgactacttagccggtgtttatggagcatgtactgctcagctgtgtcatagcaatgagatttaaggtgggtggtcaaattttttgtgggtttatttaattgatttaaatcagttaactcctcatgcatttaaaaaccatgcatttataccttttgagtagttttaattccatagtttcacttgtaagtgctatgattctattagcttggaatggaatttggcaataataaagttgagcgtatgttaattttttttttcagttcttggtaggcaggagttaaaagtgcaggcatgggctctagcagatactccagcagtataggctcttcgatccaaaatgtagtgtcatatgtcaagattccagaaaatgcaagtcccttgggatatttataagttcttatttaagagcccatatgctttaaatatttattaaacatatttagaaagataatcctgatttatttactctgtaaacagatgccaaagattatagtaatatgcatttgtgcacgtatatatatgcacacattatatacggaaatggactgcacttttaactcctgactaccaagaactgaaaacacttttaacatatgctcaactgtataattgtcaaattccattccaaacaaatagaatcacatatatatatttaaaattttagacaagcttattttccatggaagtttttatgtatataaaactttttatattttatgtataaaagttttatatttaactattttttatatatgtataacatttccatggaaaatgtggctaaaattttaaatatagaatttcttgctgagtatttaacatgaaagagcataagctaaaagaaacgcattttaaatgagttgccctgcctaattagtaattcattttgaaataaatttttgtaagtttattatgtaaaagaaaacctcaacatacttaaaaaaaagtttatacagtattgtttttgtcctctcaagtatcttttttctttcttttttcacctcttcccttaatcctttccatctctagtttcaccaagaggtttagtatataaaccagaaaatgagaggcagatgtacagggtcagccaagtggtaacatatacccagaattctgtaaatgtttccttgaatttgaaaggtaaggttgtcagtactctataagtagaatgataggacgtatgactttaaagatttttgttggggtagataccattgtttcaatcagttatctttgaccaacaacagtaattaatcatcacttctaggtttgagactctttctggattctatgttgtagaggtactagccagacttattttgagaaatatgtgacttgggtaaagagactaataatgtgttacctaaaggatcactaacagttttcttcctcatgcttctttgattataagggatagaaacccatttaaagtagctccaactaaagaaagaatttgttgaaagaatgcagacagatagcactcaaaggcaagaggcaggagtagctggcttcctgaaggccggacaccaggaacttcatattaagggctccatggtctctcatctctgccaccaaggctggtttgcaaaataactctccttgcaagcacaactgataatcttcatgtagaaatgaattgatttaaaacaggtgagaaattcaaaatgatattgaggggaactgaattggtaacaatttatggaacagatagaatggagagagagaaaagtggaaaaaagatataagagtctagacataagatagtgcaggcttgagtgagtatggggacagtagaaatggaaataatatataaaatttggtattccatgtgaatgtagagagagaacaaagggaataaggtcgactaggttggtaagtccaaaggagagaccggtttaataaaagataatgaattctatggcagttaagttgaaatagaaatgttagtaaaatatccaaatgaaagtgtgcagcaggcagttgggattataaatcttccaagttgcagattagatttggatgaaggcataaacattactatcataaaattataaaatgaacatattagagattttatttgagtcattaatgaatgagggaacagtaagatcataaacagaggagaactcaaaaatataacacatttatagttaaagaatgcagaagtaaatttataaatagaaacaaaagtggccagtatccacagggtgacaatcaatggtattccacaggaaacaatttctggaaacaagaattatttgcagctactacaagttttctataagttaactaatgtccatctctgcagtgttgtaaaatagcctcatcaaagaaacggaagtggatgtaactaacctaaatggaggttctagccagggcactcactaagtttcaggctttcattgtttttccttaaattggtatggaaattttaaactcaagagccttcctactactggagtgtttggtcagcagtagatagaaagaaaaacaagcaatggggaaaggattccctatttaataaatggtgttggaaaaacgagccagccatatgcagaaagctgaaactggatcccttccttacaccttatacaaaaattaagatgggttaaagatttaaacgtaagacctaaagccataaaaactctagaagaaaatctaagcagtaccattcaggacataggcatgggcaaagatttcatgactaaaacatcaaaaacaatggcaacaaaagccaaaatagataaataggatctgattaaactaaagagcttctgcacagcaaaagaaactttattatcagaatgaacaggcagcctacagaatgggagaaaatttttgcgatctatccatctgacaaagggttaatatccggaatctacaaagaacttaaatttacaaaaaaaaaaaaaaaaaaaaaaaagccatcaaaaagtgggtgaaggatatgaacagacactgctcaaaagaagacatttatgcagccaacaaacatatgaaaaaaagctcatcatcactggtcattagagaaatgcaaatcaaaaccatcatgagataccatctcaagccagttagaatggtgatcattaaaaagtcaggaaacaacaggtgctagagaggatgtggagaaatgggaacacttttatactgctggtgggagtgtaaattagttcaaccatggtggaagacagtgtggtgattcctcaaggatctagaactagaaataccatttgacccagtaatgccattactgaatatatacccaaaggattataaatcattctactgtaaagacacgtgcacacatacgtttactgcggcactgttcacaatagcaaagactgggaatcaacccaaatgcccatcagtgatagactggataaagaaaatgtggcacatatacaccatggaatactatgcagccataaaaaaaagaatgagttcatgtcctttgcaaggacatggttgacactggaaaccatcattctcagcaaactaacacaaaaacagaaaactaaacaccgcatgttctcactcataagtgggagttgaacaatgacaacacatggacacggagcggaacatcacacactggggcttgtcagggagtggggggctagtctagggatagtggtagaagtacgtaatgtagatgatgggttgataggtgcagcaagccaccatggcacatgtatacctgtgtaacaaacctgcacgttctgcacatgtatcccagaacttaaagtataataataataataataataataataataaaaagatcagcaaagaaaaaaaaggaaggcttttaaagttcctcttcttttagataaaactggtttaattaatgctagacaacaaagcaaaaccttctaagtttgatttgggcatttacaacacagaaatagtgtggatatgatgtagggattccttttccctagaaatatttttaggcagtatgccctcctctcttcctccaccagcttgaatttcattttagatcttaatagcttccgacagaaaggaaggttgtgggatttgctgttttagacagttaacattcttaatgctgcaatataaataacaatttatgaattaccacaagaagattttgaagatgagtattgaaaggccacaggccctgtcttgtcatatttcatcgatacttgatattataacgaatacagattaatcaaatatttttagaaaattttaaagaacagcatactacttcttccttttaaaaaccaatacttgctccaataataagttctatcgagggttactaggaatctcttcctgagtttagatctgaaatcagtgagttgggtggtttcacactcgtaagtggtaaaatagttttgttttttggtttttggtttttatttatttatttatttatttgagacagagtcttgctctgtcgcccaggctggagtgcagtggcacgatctcgctcactgcaagctccgcctcccgggtttacgccattctcctgcctcagcctcccgagtagctgggactacaggtgcccgccaccacgcccagctaactttgtttttgtatttttagtagagacggggtttcaccgtgttagcaggatggtctcaatctcctgacctcgtgatccgcccgcctcggcctcccaaagtgctgggattacaggcgtcagccaccgcgcccggccgtaacatagttttttataaaggtgattatatcaagtgaacatgagtcaaaaattttaagtaattaattagtgagggagcctgaaaaaaatgttgcctttgtaaattcaaagatcagacaaatatataagcccaccaagaaggccaaatgaatttgcttcataaatacaaaaactggctcttccacagttgagagaggaagtcagttgaacttccaccaggcgggatttgtttgcacatctacaaacacaaattatttgcattactctcacttttctacacattatcttctgtttacagagttggaaaatagctcagaaaccaaggtacaaaccccctagaatcagataacttggcatgtgctctaaacaatacagagttttaagagatatttagttttttgggtttcatttaaaaatatttcagtatccttacataactagcgttgaaaggtaaatattagctaagtttattacttaaatcctgcgttttgtaccataaatgacaatgtgcagaaagtacctgaattggcccaagtcaaaaaaaaaactgttaaaataataatggaatttaactttgttgtgacataaatagaaaaatgattgtttctaacaagtgcttaactgaccctccaaaaataaaattactgtcttctatagacgtgtactgatgaaaaatataggtgtgttaattttaggattttatttaagtaatattgccaattgggacctttaaattagtttggaacatgtatagaacagggtgtatcatcggcttaaattgattaataattactcattaatattgatctttatagcagcctgtaatgtatgttgtagaagacatttctttaagaaaagcaactaggataagtcaacttaaatgggtacacaccattgaaatttgaaattattttggcacaattgagttttctccttaagtttgttggaatggcattgaaaaactcaatcacgttatttacaaggagtaaaatatctttgaagttttatttactttagaatggattataatgactagtaatagctatagagagtactcagtgctagcactcttgatgcatttttctactttttctttatgaggaataagcagatctctcatagtggtgacctttcacactgtgttttcctcattgagcaagtgtctttattgtggctaacttgtgtgtgagaaaactgaagctggccaggatcgtatgtacctgggcctggccttcttaatagattacggcattccacttgataataccagtggcacaggagaaacttctactgttgtgctatttggtaatgtgaagacagaaaaagtctttttatggtagttgggtcctcaaaacaactcttcatggtttagtgataaggagacacaagttgcctatcaaacagaggtacattagcttattatctacaaagctgatagagcctcttaaattctctcatggtgacagaaaccccatctgaagtgaaggcttgcagagctggagataccagagcactttccttcctcataaatacaagtagagttaaccctactcttgtagaataaaaattgcatgtaattgttgaacaaaagctgccttcttttttctctggcaattaaaatgtggtcaaagagatatatacttggtgattgccatttgtgaaaatttcagtgataagcattacagcttactaagaagagcaagactaattaactagtcttaaaatagatgaaaattgaggggaaatatcagagatttaggactagaataagtcaacaactttatgataagatctgtgtgtaggcacctactatatttgttctgtttctagtgctgtgtaggttttaagagttcaatgtgttccagtgttctgagtgtctacattttcactcctcatagctacttggaaagatttggcaagtaaacttgctaccatggttgggggaggataaatgcctttatcctttagtgctcccaacaacaggaccttttatggccaagcacacataaaagtccatgtgattacttaggctcatagagcctagtgccatggagaaaatgttggagaaatagatgttgtgtttgctatatgcacatgccaagtaatttaataagctaacgtatctgtactaatgattgtttatgattcttcatgaaaaatttttaaaaatcacattgaataaagtgaattttaaaaataatttgactttggagaatcaaaaaaattcttgaatcttaatgtactgtgcttatgttctacttcattcaagaaaaaaggagtaaaataaacatccataattattgctaatcatattttaaaggatactaagatctgctatgaaataatcaaaaatatctttagatctaatttaatcgtttattgatgaacttctctgggactagttcagtgatcaagctttgtttcctaactaagctctgttagttaggcttacttagaaattttaacttcctaatccttctctgcagttggtcagaaaatcaagaagtctcagccatttcagtgttgaaccctgtaactctactttaaaatacgacccactaggattttttaaaaaagaagaaagaaagaaataagacattctgaaagtaaaggaatattccatatatcttcaagctcttggtttttaatttatccttttaagtactggacaagttatttcatgatgaatttaagttaaaaataaaaatcagaaaaccaactgttttttgcattatactaagaaaaaaaaagtcagtataatccaggagatattttaatggcactcaagaatattctccagaaagggctgggcacagtggctcacgcctgtaatcccagcactttgggaggctgaggtgggtggatcacgaggtcaggagatccagaccatcctggctaacatggtgaaaccccatctctattaaaaatacaaaaaaaattagccgggcgtggtggcgggcgcttgtagtcccagctactcgggaggctgaggcaggagaatggcatgaacccaggaggcggagcttgcagtgagccaacatcgtgccactgcactccatcctgggcgacagaacgagactccgtctcaaaaaagaaaaaaaaaaagaaaagacagttctccagaaagtcaaatcagtggattaaatcaaaccatgaaatacactctgaataacttttgagtgcaaattttaaaaatatgtaaagtcactgataatttgtacattctacataggagtcattgcagacataaataattatcaagtttgttgtatttcaaagttatacaggaaagtgaataataggaatgaaattattgggatattgtgctgattctttctgttgagtaggataaaaactccgataggcagaaaggaagaatacgtgaagttgctgaaatgttcaatttataaaggtacgataacttctcaaagcatcatttttatagatttctatcttagttctttcatgcattggttatatcatataaattgatcaggctttaatcagatttgagttttaactgtgagagcagtgagtcatttagtattttgagaagtttagaaaggaagaatccaaacaaatattccttttctcttaacatacaatgggagaattaattttacttatatttaatgtttatcttatttgaagaagtaagtacatttgtgatcatttagaaaccgtttcagtggctcttgtataattcagttcattccgtctgtgctctcttaataaattttacagaaaaactcatggcaagttagcattatttgtgtgtgaattttccaattgtatttcagactttaagaaagaaaggccttaatggttgtgagagccctgatgctgacgattactttgagcacagtccactctcggaggacagattcagcaaactaaatgaagatagtgattttattttcaaacgaggccctgtaagtacttttactttacctctactttttatttgttgatcctttttgttaacttcattatttaggctctgaacaagaaggaacacagagggtgcgacagcccagaccctgatacttcatatgtgctaactccacatacagaagaaaaatataaaaaaattaatgaggaatttgataatatgatgcggaatcataaaatcgcagtgagtactaaagtatggtttgtgcttttatcttgtgcatgaagagattgaccaaacatcttgttgcttatttttatagtgggtgatgacaacaataagtagaagggaagaaatgcattttattagtattttttataaaacttcaaaataaaattgctgaaatcttatacatgttcagtatcttaaatgtagaagtgaagagaaaacatgccgatccagactttgctacttcttaccccaatacctttggatagggcacctaaacattttgaattctttctccatctatagtgagttggctctcatgatttttaaggtatcttccagctctaaaattctatgatttatagtatagagtatgtataaaactttccctctactcccatgacttaaaaacatatgtgttcttaaatagatcttgagaaagcaaaatgtaaggtagttaggtttgttgcgaaacttgtttttttcctaaattatcttcaattattttgtatagttgctataatagcagagctaagcttactgctttgcagtttgtaaatgtccccaaatcacttagcaacaataccaccagacttttgttcttttcttatgctgtagatactaaggaagagcagcttggcttaattttaatttagggcaacaatgttcttaaactgattgcaaaacaaatagtgactttacagtttctgtatactcattcatctaaccatagtgaaagagtatttttctttgagctcatgctcctagacttgatagtttttcaaagaattctcactggaagctccattggcaagagctacttaaaacagttattctggatctgatttcctaattctgtatatgtaggtcagccgcccttgaacaaattagtttcaatgctgatatttattttagcatcagagttaattctttcaaaactgtgccctaaagtatgcatgatggatcatttcttcagagtagtcctgtattacaggttgggtattccttattggaaatgcttgggactagaaagtgtttcagatttgggatttttttcaaaatttggaatatttgcatatgtatagtatcttggggatgggacccaagtctaaacattaaatttattaatgtttcatacataccttacatactcatggactgaaggaagttttatacaatatttttcataattttgtacatgaaacaaggtttgtgtacatggaaccatcagaaagcaaagatgtctctgtctcagctacccatgtcataggtcttggctccatgtggagcatcattgggaacctgctgttagcatgtgtagcctacacacgtgccattttattaccctttgtggatgtgcttgtgtgagggaatctgggtgtgcacagaaaagatatattgaagctgatggcagactggaacggtccttttccccttggagacactgaataaactgtgtattgtatgcctgcatttccacatgtcaggtttggaattctctatggcatcatgttggtgctcagaaagttttggattttggattttcagattagggatgctcaacctgtataagaagccagctcacaaaaaaatagccttaaggagttacttttgggcaaataccattattattcttaaaaacaatacagtagcaaataaagggatgttgctgaccttgcagttaatgttaaagctgcaaagatatcgcacaaataaaagtgttttacttttgaaaaaaattgtcatatacccactgtttttatatttgttgatgtataatttttctacatgaaataaactactattgaataaagtacaataaaatatattcttccaactttgaattagcagtgttaccttatttttgtatgttagtcttttaaaatgagggcagagtaaagttgttttattttctcccactttaaattgtaaagagcaacatatatttatcgtggttaacaagcatattgtaaatggtgtgtggaggaaatgcaagatgaaaatagaaaatagaaaaaaggggatatggaataatttggagggagggaaggttagcatttataatatttgtaatttaatctttatacaatttaaagaagataccaaaaactttattacttttattactggcttggttagtagttaattttgttgtttagattagatttctttgcattttcattaaactcaaattgcattgttatgtatataattactttttttttttcttagttttgccctttagaaagttagtcaattaaatcagaatggggaatatttatgatttatcagatttgacatattaagttaataatatgtgtacacacttttctccttccgttatatttgggatctctcagtagaaatgtaatgttattaaggtttacattgaagtgccaatttatgcttacttggtgacagtgatatattttgtaatgtctaaatatgacaacactacttgattatcaggtttatcctcttaaatttgtctttatgaatatttgaaatatagaatatagacattagtatatattaatgtataaagttgaaattgaaaaggctcatgtcagtcatattcatgttcaaacataattctaaagaaaatagctttaatctgtaaattggttaagaacctatccctatcctctacttttagtaacttgagttaccttgccaaattaaagttcaaaagttactttgtagatgaatacgaaaccaacagttttttccttctttttctttatttacagcctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtatgtagtgatacctattatgctggttctttaataaagagggtgaaaaaattcattgctaacataagcagtttcttattttgctattcttttattgctttgatgagcaagaatcactgatacataattggcctcattttaaagtatttttttgaaaatcaattgtgggtgtagcattgtgtcatgcaaagtagaacagtactgagaacctgccatttatatgctttccttctcatgggaaagccatactttgacaggcagaaaatttagttagatatcagaagcaaggatttaaagtagagtgtgagccattcatgttagaaatatgggtgatagactacctgattggagttagagtatcttttacatctcctcctgcctgaattacttcattaattcagcaaaatttatgttacatttattgtattagtctatgaaatgcagtgtctcctctctcttaagtcctagatttaatttagtgatttaatcatactccttacacactgcccccgtttttatcagtatgtactattttggtattgatgcaataccactatttggtattgaaggcgacatcaagcttgaaaggtaaactcatatatatgagatataataactacatcagattacatgttaatgccaacttcagactgagctagtttttatttttgtgtctttttaggattagagtgagagttatctctattcagttcacgttcagttaggtaaagagagctaattcatattcattctctgccctctgtcttctctccgtaacgttgttaggtgggatgttgagcactacagacctcacagtgccaaatggagctggaagcagtccagtgggtgagtgaattcctactcttctgttttgtaggtatctatcctatatgagatcaaaggaatgttgttcctgaaataaagctttctgggaaatttccttctgaagggtactttcactaatacatcaagataatttcttaaggggagactttctctaacttccctgcttaccaaagttagactgttaccaaactactctatcttacaacagcatgaaatgttttcagagagactagaatgaaaagaaatggtgggtctatctacttctacagatagaaagataattaacatatttgtcttggccgggcgtcgtggctcacacctgtaatcccagcactttgggaggacgaggtgggcagattgcctgagctgaagagtttgtgaccagcctgggcaacaccgtgaaaccctgtctctactaaaatacaaaaaaatttagctgggcgtggcagtgtgcacctgtagtcccagctattcgggaggccgagggaggagaattgcttgaatccgggaggcggtggttgcagtgagctgagatcgcatcactgcactccagcctgggcgatagagtgagactccttctcaaaaaaaaaaaaattatggagatgattgaatgacttaataaaaatgatgaggaagaaataaacaaacatcaataaagatattattaagacaagttacaaaatatttaatgacaaagtaggaataaatgcctaattatatctgccacagtattaaatattttaatggaattaaacagataagacctattgtggagtcttacttaacagaaaacaattaaatgtgggaaaatacataaaggttgtaccagttaaacactagggctgctactcttgtatgtgtatttccaaatatttatggttttttttcagctcttgttttagttgtttgtatgcctacatactgtttttgtgtccctttttttttttattcccccaacagaataataagttcagggcctaccaagaattgtgagagcctaatatgcttctctcacattgggttgacaccccnnnnnnnnnnnnnnnnnnnntgcaaacttcacctcccgggttcacgccattctgcctcagcctcccgagtagctgggactacaggtgcccgccaccacgccgggctaatttttttgtatttttagtagagacggagtttcaccgtgttagccaggatggtctcaatctcccgacctggtgatctgcccgccttgacctcccaaaagtttgttaaaattagatcgtagtgattagaaattagatttaggggttccagaatgcccggaaaagcaaatagtctctggaagaataaaataagcctggcccacatggcaaaaccccatctctactaaaaatacaaaaattagccggaagtggtggcaagtgcctgtaatcccagctactcaggaggctgaggcaggagcatcacttgatcccaggaggcggaggttgcagtgagccgagatcatgccactgcactccagcctgtgcgacaagagcaaaacgctgtctgaaaaataaataaataaataaataaataaaataaaacaccatctcagaccttattatttctaacttggcacataagctgaactaggcacacacacaaataaagcaaatgaaaacttgcagaaataaacaaacaatggaatcagcctcctgggaactccagaatttggagttactaggcacagactttgactttaatataacagtgtttactgtgttcaagggtatttaaaaaacaaaaagattgagaattttagcagagaactgaaatttatttaaaaaatggaaattttagaacaaaaaaaccccgtaatgttaagaacttaacagatgggcttaaaaacagattggacaaagcaaatacaagaattaagaaactaaaagataagatagaagaaaattatccagaattttggagacacaaagggatggaaaattaaaaagaagacccagagcatgcaataaaaaggactagcatacgttaaattgaagtcccaggaagcaaagtcagagaaaattgggcagaagcagtatttgaagagataatcactgagaattttccaaaactaacaacaacaaaaaagccacaaattgggaaggcctataaaactcaacgtggaatacagataatgctgtgctttatgagaaatttaaacctttatgaacaaaagactggagatggtgagctaaacctccttctcaggaagtcagaaaaggacagcaaattaaacataaagtaggtagaaccaaataacaaagatacaagcattgaaatagaaaatagaaaattttctatttcaggcatggtgaaacagatgatctcatacgtgcttttgtggtattgtaaatcagtaacaatctttctggaaaggttttggcaagatgtttcagtggtcataaaaatacaagtattgatactgaaatagaaaaacaaattgaattaacaaaacaaatactgattatttaaaagactaataaaatggaatgttttcactaatattcaattcgaaatattttctaatttccattatatctttttctttaacccaacttgtaagttatttagaattatatttcttaatttcaaatacatggagattttccagttatctttgagatattattttctagccagattgttttgttaccagagaacttacctctatatgattaagttctctgaaatttgctgatacttttttataggccagcatgtgctcaatttttgtctgtgttgtgtactggaaaggaatgtttattctgtattataagcatggattgcaaattctacttgttttaaatacgttttatctgtatatatgtcataacttactgtatcagctccagtttagaaactcgtgataggtcagttccagatagttttgcgttacctttaaaccatatcatttttaccaatattgtcattttcaaatacgtaatttgtttataggcgagtcttccatttgccttgttcgtattttaatttttgttgcatcttctgcctgcttccctaaaattggaatacttcaggcccatgtactgctgaaagaagaggcatccttgagacttttaaagcactgaacgaactcaggaaaggcaaagacttcttaaataagaaaccaaagaaagtctaatggaaagactgattgatttgcttgtgtgaaaattggaaactttgtgaatcaaaagcactgtaaagagagtaaaaaggcaagacagaatgggagaatatatatagtatgtatacaatcaatagagaggtttttttttaagaatacctacaaatcagtaagaaaaagaaaactcgacttttgaaaatgtgcatgagaacacatcacttcacaaaagaaatgtctgataaatgtgaagaaatgctcagtctcagtagtcatggaaatgcaaaattaaaccacaaagagagaacactgcacacccaccagaattgctaagatgaaatagatggtataccaaatattgacaaagctatgaaaaagcacaaactcatacactggtaatgggagtacaagttgttgcaaccatttggcattatctgcctaagctgcagatacgtgtattgtgtgacccagcattttcactcatccttatgtactgtagagaaatgcatttgtgcatcacgagtaccaagagatatgtaaaagaatgtgtacaacattatgttaaagtcattgtctagaaatagtacagatctctgtcaacagtagaatggataaatataagagtacattcatatgaaagaatattatactgcagtgaaaatgaaatcacagcagttctcaacatggatgaatgtcaccaaacattatgaattaaagaagatagatacatactcaagattctaactatataaagtttgaaaagcaggccaaaaaaactatagtgtttgggatgcttgtgtagatagatggcagagccataaagaaaaaccaagaaattactgtaaaattcacaatagtggttactttgggtaggtgggactctcggaatattttagggggcccaattatggaaacttctggggttctggcagtattcttaatctgaatggtggttacgtggatcttcactttatgataaatccttaacctatacgtttttgttttgtacattttctgtttatgtgttacattagcaagaaaacagttttgaaaataaaagaatacactagatataataataaaggaactataacaacaaatataaaggcactttttaaattataagagaaaataatgtacattttgtggtatttatactattccaaaattcagagagaaaatgtatagacactcaacactcacattcatgcacaaactagaggtagcctttgagtctttggacattgttgtctgcatgtggcagctggaactcagcacccatcttaagatcatgagacaagtcagtttaagatgacaggtcaaaatgccaaggttgatgaagtgaaaagctggtggccctcagtgttgagctgctgaagcagctgagtctgggaccactcttcccctagtctttttatgtgagataatacgtgttgctcattctccagaggaaaaaagcaagataaaatccaagcaacagataggggaatgtttagtaatgggcatttaattgtaccaaaatacacaattcaaaaaagaaacctaactagtattttaaaaactgaaaaggttgttcatcattggtagtattcatgaaattcaaattaaaatgacaaaaaaaaatactactcttacttactaattcccaactattagcactttttattgtgatattcagtgctaatgaaggcatggtgaaactgatgatctcatgcatgcttttgtggcattgtaaattagtaacaatctttctggaaaggttttggcaagaggttttagttgtcataaaaatgtttatacctccaagcccactaatcccatttttgggaatctctcctgaagaggtaagttagaataagcaaagcttcattgcaactttatttgtagtaatgaataataggaagaaatcaacatattcaacaatatgaaaatgaagtaaatgaaatttcaactgaatttctttttagttgtgatttaaaacgagcaaaaaatatgagcatggaaaacaaaaagggaaaaatccaaagagattataatacttaagatggtgggactgtgtttttcactctttttctagtttcagtgatgctgtattaatacagttacctctacagtcataacatctttattgtagtaaattagaatatttctttatttattacttataacttgttttccattgtcatctgtgcaaataaaacttggcagctttgtacatattgtaatttgtatagatctttcatagaggtaatttgcttatttgtttatgatttactaggtatatttctctatggggagtttaatactgggtttatactatagttcaaatgactttggggactttttactttgggcacactttaaaatatcaagcataaaataaagtcagatatccaacaacttcactttttaaaaacacgttgagaaagagaaaaaacatatatggtactagacatagaaaggctcaagatgctcttggaattatttggggttaaatgaaggtaaaataagggtttgcattgtagcaggcacattggcagttaaaaagaagagatggaagaggtgaaagatatcatgaagaaagcttgattgctctgaaggtggggatgggatggcggaggacagcagtagttgaagtctttagaacaagctgagttgagatgacagcagcatgtctgggtgaaagtggccaccagattattgaatatgtactggaaattaggaaagataaagcagaaacccagttttcagtcattcacatggaggtgatagttgaagttgtatgtgcttcagcattcatgcttcatgaagatgctgaagtttctgaaagagaagaagatatgttgccttttgggggctgcccacatgggatagagatggggaatacagtattcagaaagaaaagaagcagaccccatgagcattgcctatttttgttataaatttttattggacaggatccatgttgtccatcttacaagacatttcattgaatcaagtacacatgcattcaattatttcaaaacctgtgatctttattattttattttattttagactagtcaggtgcagtagtgagaagggggtaaagagtagaacaaggagttggataagttgagataactcactgccttcgaaccagccctgtaatcttttctactttcagaaacctcaaacagttctttgtacaaatgacataattttataactgttagaatgtatttttgtttattgaataatcagctgaatgtcaaattttatgaaaattttgccaaatatgattgaactttgctttggatgagtttttcagaatcctttgaagtttgcacatcagttggacttctgaaatgaattcatagtgaaatattagtgacatcattgtctgcagtttaaccctagaagagtagtatctaaggacacagagtacttgccagctacttgaatgcattatttcagctgatgtgatttatattttgaaatatgagccagactgatggaattgactgacctatcttacagctataggactgtaattgagatcaagttctgttaagtttctgaaggcatgggtatgcggtttgctcaagagcattttttcacatttgtgttaggatagtaaattaccttgaaaactggaaacacattttaacaacattaaattggatttattcatttagtgtagatactgtagttcctaggtttgtaaactgtggcaagatgagttatatactgaaagtatttacctcaaaagtctatctgaaaaatatcttcatttttgtaataaaaattgagctggaggtaagaaggtacatattagggtatatatcactgcactctacaaaataacaagtcgtgcataggagattctcttagcttcagcctggcaagttaccaaacacttacatcatcctttaatcatcatctgctactgactcctgactttacatcaagaaatactgtgcttttaagtcccctcttactcttgaaatttggttctcatgagttaccatcatgtcatatctatctaaagcaccatagactgcacatgggaaaatagtatttgtgcttcttgatgatgtgtggctctgaattatatatttttgtctttgagaggaaattctactttcttcttcagatttgagtataaatcaagtaaagaagaatcttctaaataatatcagaatcagaacacatattcatgccattgtatatttaaaaaattattaatctgacattctcatactgttaacgcaaaatgaagtttctatttaaccttcctatttttgaataaaattatttaataaacatttttaattcttcaactgtctggcttagcggttacctctgtccaagtcatatatgatctctactcgacaggatggcctggtgaagtggttgttttttaaactgcactgctttctgaagcttaacaggatgcaggaaattactctatggggtgtggaaaggatttaattcataccccttcaagataatgaaagcagaatgcaggaaataacctcatgaggttaactgaaataccagtccccacagcaaaattagatcatacatatgaattaaaactgagtgggtcacttggtaaacgttttggaggaaacaagaggaattgggtgagggtaaggaagaaaaaaccacactaatcatctggaactcagaaattcttttgtttgtttgagacaggatctcactctgttgcccaggctggactacagtggcacgatctcggctcactgcagcctccacctctgcggctcaggcaattcttctgcgtcagcctccctagtagccaggattacagacatgcaccaccatgccctgctaatttagcatttttttttagtggggtttcgccatgttggccaggctggtctccaactcctgacctcaggtgatctacccatctcggcctcccaaagtgctgggattatacttgcgagccaccatgcctgggccttttattaaaaaaaaaaaaaaaaaaaattatttcaatagttttgggggaacaagtggtgttttgttgcatggaaaaattctttagtggtgattttggagttcaccagagcagtgtaccctgtacccaatatgtagtcttttatgcctcactccctcccagccttcctccttgagtccccaaagtccattgtatcattcttatgccgttgcatcctcatagcttagctcccacttataagtgaaaacatgtgatgtttggttttccattcctgagttacttctcttagaataatggtctccagttccatccaggttgctgcaaatgccattattttgttcccttttatggcttagtagtattccatggtgtacatatatgtatatatatatattacgttttctgtatccacttgttggttgatgggcatttgggctggttccatattttcgcaattgcaaaatgtgctgctataaacatgtgtgcgcaagtgtctttcatatactgacttcttttcctctgacccagtagtgggattgctagatcaaaccatagttctacttttagttctttaagcaatctctgtactgttttctttagtggttatactagtgtacattcccaccagcagtgtatgagtgtttgcttttcaccatatccatgccaacatctattattttttgattttttaaatatagctattcttgcaggagtaaggtggtatctcattgtgattttgatttgcatttcactgataattagtgatgttgagcatttttcgtatgtcttttggcaatttgtgtatctgcttttgagaattgtctattcatggcctttgcccactttttgatgggattgtttttttcttgctgatttgagttccttgtagattctggatattagtcctttgtcagatgcatagtttgcgaagattttctcccactctctgggttgtctgctgattatttcttttgctgtgcagaaggtttttagtttaattaggtcccatctatttatttttgtctttgtcatatttgcttttgggttcttgatcatgaaccctttgtctaagccaatgtctagaagagtttttccagtgttctagaatttttgtgatttcaggtcttatatttaagtctttgattcatcttgaattgatttttgtgtaagatgagaaatgaggatccagtttctttcttctacatgtggcttgcctattatgccagcaccatttgctgaatagggtgtcttttccccactttatgtttttgtttgctttgttgaagatcagttggctgtaagtatttggctttacttctgggttttctattctgttccattggtctgtgtgcctgtatttatgccagtaccttgcttttctggtaactatagtcttgtagtatagtttgaaatggaaataatgtgatgcctccagatttgttctttttgcttagtcttgctttggctatgcaggctcttttggttccataggaattttaggatttttttcccccctagttctgtgaagaatgatggtggtattttgatgggaattgcattgaatttgtagattgcttttggcagtatggccattttcacaatatttattctacccatccgtgagcatgagatgtgtttccatttgtttgtgtcatctgtgatttctttcagcagtggttcatagttttccttgtagaaatttttcacctccttggttagttatgttcctaagtattttttttttttgcacctgttgcaaaaagcgttgagttcttgatttgattctcagcttggtcattgttggtgtatagcagtgctgttgattttgtgtcctgaaactttactgaatccagtaaagatgtcatagatggcttttattactttaagatatgccccttctgtgccagttttgcttattgacttgtgtatgttaaaccatccctgcatccctagtatgaaacccacttgatcatggtgtattatcttttgatatgctgttggattcggtcacctgttattttgttgaggatttctgcacctgtgctcatcatgggtattggtctgtagtttacttttgttatatcctttcctggttttggtattagggtgatactggcttcatagaatgatttaggaaggattctttcttactctgtcatttggaatggtaaaataagattggtactagttcttctttgaatgcttgatagaattcggctctgaattcatctggtcttggactttttttttattagcagtttttaaaattactgtttcagtctcgctgcttgttattggtccatgcagagtttttatttcttcctcatttaacctaggcgggttgtatatttccaggaatttatccatctcctctagattttctagtatatttttccacccctttactttatgtgagtccttacatgttaggtgagtgtgttgaagacagcagatacttggtggatttttaaccattctgccattctgtatattttaagtggaacatttaggccatttatattcaacgttaatattgagatgtgaggtactattttattaatcattgtgttagttgttgcctgaatactttttttttcattgtgctgttgttttatgggccctgtgagatttatgatttaaggagggtgtattttcaggttttgtttcaagatttagaactccttttagcatttcttggttgtgctggcttagtagtggtgaattctctcagcatttgtttgtctgaaaaagactctctcttcttcattcatgaaggttagttttgctgggtacagaactcttgaccggcaattattttgtttgaggaagctaaagataggaccccaatctcttctggcttgtagggtttctggagagaaatctgctgttaatctgttaagttttcctttgttggttacctgatgcttttgcctctcagctcttaagattcttccctttgtcttcactttagataatctgattactgtgtgcctgggtgacaatctttttgcaatgaatttcccaggtctttgagctttttgtatttggatttctagatctctagtgaggccagggaagttttcctcaattattttctcaaatatgttttccagacttttagatttctcttcttcctcaagaacaccacttattcttaggtttggctgtttagcgtaatctcaaattttttggaggctttgttcatttttgttttttgattttttttttaatttgtctttgttcgattggattaattctgtcacctaggctggaatgtggtggcgtggtcttggctcactgcaacctctgcctcctgggctcacctcagcctccttagtttctgggactacaggtgcacaccaccatgtcctattaatttttctttttttttttttttttttttttttgtagagacggggtttcaccatgttgcccaggctggttttgaactgggctcaagcgatctgcccacctcagcctcccaaagttctgggattacaggcatcagctaccacatctgacccagaggcaaaccattttacgtctcagaatgcagtcttgtcaggatgagattattaggacgaattttagaccagtgttaagcacacagcagacactcagtttttgttagtccttgcacgtgtattaatacaggggtgtgtgggtgtgtgtgtgtatttgtaacacctagtgtctgcttatttttcgtgaattctgaagttttctttttggctttatactagaatgaaaggagcagaacaaatacagctactttttccttctgatggtccctgaagctgtggattatccaggcttatctgctctgccattcctcactcacaccttgttcattcgtgctttaacgtgtttttctcacatttatccataatgcctgccttctcttttcttctgttcttctctcatttcagactgctcagtagttaatcccacaaaggctttcctaattaagctgatagatttgttatcagtgctttctatttcattgtaaattttgtgtggttacctctagtttgcccatattgtgagtataattttggtatattcatgcctatgtgatatgcctgctcttgctaactagatgaaaagctacttgaagacctgtaggctttttatggtttctctacatataccctcccaggggcacagtactgtatacataatagatatttgaatttttttaatttccaaatagtaaaggtacttctatgatttccaattttaggcagttgctagtcttaatgacatgtgaatgctgagtcctccccagagaacttaagaggcctgtttggctcatcaggaacctctggttcactattctgaatattttgttctttgccagctttgtaataaacacttatcttttattcttctctgctttatttgtgatttactttgaaattgaaataccacactgtaatctctgttttataaatgcacattatatgtttctgtacactggttacttatctactttttacttgtcattatctctgctgttggactgcaagctggtgaataatagctgtttctattaggatagtatcagttgcaactaacagaaaactacctcaggcttaaattgtataggggatgtattaacttacatgtaaccgaaagatccagaagtggtacagactacaagcatggtttaatcagggattttacatcatttgtttgctgttctcctttttgtatcagctttttcctcattctggccttcttctgagtctcaaaatgacttaataaaatgctggccggacacgttggctcatgcctgtaatcccagcactttgggaggccgaggcgggcagatcatgaggtcaggagatcaagaccatcctggctaacacggtgaaaccctgtctctggtaataccacaaaaaattagccgggcgtggtggcgggcgcctgtagtcccagctactcaggaggctgaggcaggagaatggcgtgaacccaggaggtggagcttgcagtgagccgagatcgcgctgctgcactccagcctgggcaacagggcaagtctccgtctgaaaaataaataaataaataaataaaaataaaatgcttcctcaggcacagtttagggaatgtgagagcctcctgataatcatggaagagttgttttacccgggttctgattggtcattaccacatccagtcactgtggtgagcgagaatgacctgagtcaaatgcctatcactaagttcatctgggggctggagggagggttgcagagagtcagccccacccagtccacgtggttgctatacatgggaagaagtagaatgactgactacagtattcatgaaaacaggatggtttcatacgtattttatatctcaactagtacccaaaagtattatatacatagagcatatatcacaatgtgcatttttcctcatttcattaagggagatggaaggttctgttagggaaagtttaggaataagatgattaaagtgagataaatcagaaatatttaataaggacctcagtgaagctgaagaaacagactcagtagaagtagagccataaggaagaagtacgtggtgaaaacggggcattagaaatgagtgctgaataagctgcagttaagaagctgctctgatacctagttcactactcagaacttagtggtagcagtgcctttgctctcacaagagtgaatgaataggctggtctcagacatttttctataatacctccattattttagtccccagtatgagatgccctcttagaaatgtggtcttttgcttgtttgtttctttgagacacagtttcactctgtcacccacgctgtagtgcaggggcatgatctcagctcacggcaacctccgtctcccgggttcaagtgattctcctgcctcagcctcctgagtagctgggatcacaggcgggcgccaccacatccagctaatttttgtattattagtagagacggggtttcaacatgttggccaagctggtctcaaacacctgacctcaagtgattcaccctcctcggcataccgaagtgctgggattacaggcgtgagccactgcacctggccagaaatgtgttgtgtgttaaatctctttcagcaggtccaaggagtaatgctgtacaagtatcattagtcttaagctttatatgtatttcagactttgcttgtcttcctttgcttatttttaagatatcccaaggtacttcattagttaccacaggttgagtatcccaaatacaaaatgctctaaaatctgaaacattttgagcactgacgtgattctcagaagtgtcaattggaggattttggattttcaggtttagggatgctcagccaataagtatacaagtattccaaaatcagaaacacttctggtcccaagcatttcggacaagggatactcaaacctgtagtgagttttgttataaaatttatttgcaactcagactggggaaaacttgatttgtttgtgccaaagtattttaataactcttctcactttattgaatgatatttttccccccagggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactagtaagttgaacctttcttcaacttcattctttaaaacacatattttatacatagtcaatctgtagcttcctttggaattttctgtgccaccgtagaatctacacctattcctaataaatatttccattcaaaattagtatttgaagagacaagtctatttcaaatacacaaaaatcagattatggaaatttgcttaacagttacttaaaattaaagctaaatacgaacgtggttggaactggaggttattgtgttaagtgaaataagccaggcacagaaagatagatactgcaaggtctcactcatgtgggacctaaaaaaattggtcttgtggagatagagaatagaatgatagcagaggctgggaagggtgtgtgggtgggagacgggatgaagagcggttgattcgtgggtaaaaacatacacttagatacaataaatatacccctgtatttgataggagagaagggtgactatagttagcaacattgcagatggagtatatttcagagtagctagaaaagaggacttgaaatgttcccaacaaatagaaaggataaatactcaaggtaatagatgccccaaacaccctgacctggatcattacgcattctatgaatgtaacaaatattcacatgtaccccattaatatgtaacacctttcgaatcaggttttttttttttttttttgagtcgttttaaggagtgaaatttagtagccaagaaagaaggaaggaaggaaggagaaaacagctccctccaacagagacagagggaggggggattcaaacaaagagaaaacccctcgaatgagtttttaaaaagtaaaatacagagagattattatgtttaattttaattttaccaggctagaagcattaaccatgacttatttattctctgtactttgtatactttcattaatcaattaaacatgcttttctgtgagagaagcactaaactatttgttagaaaattctacataccaggcagggtacagtggctcacacctgtaatcccagcactttgggatgccagggcgggcggatcacctgaggtcaggagttcaagaccagcctggccaacatggtgaaaccccatctctactaaaaatacgaaaattagccgggcgtggtggcgcgtgcctgtaatcccagctactcaggaggctgaggcaggagaatcgtttgaacccaagaggtggaggttgcagtgagccgagatcacaccactgcactccagcctgggtgacagagcaagactctgtctcaagaaaaaaaaaagaaaaaattctgcataccacagaactattgtaggatagggaagaaagcacacaaacttgagtgagttattctccaattaattttatttgcttattccttctcaaataacctatttaactgtataaagaatgcaggtagcctctattccactccttgatgacggctttagggttctagtctcatttgtttttgagtcttaagtctgtttgtaaagaacaggagaatctatttatcgcccttagcttcctgtagaaaaaaaactagaatatataatcaagttttaaaacttcttagtttagcaactgtttgactactaccatactaaatgatatgccaggtgttctctctgctgagcagttgctaaactcaccattagagtttttgctaagtgaaagtgatgctgtcaggcttagataataattccactttggtataatgctttatagattccatagcaccttcatgtgtatattgtctcatttaattctcaattagcctgtgtcattgcaaggtagagatgtggaaactgagttaaaggttattacttgtccaagatagttcaaaatagagctaggaccaaatctctaagtcttacagtccaggtcaaaaaacaagtacttttttatctggttatacagaaatctggaaacagtcactcccagcctcacaattaaaaaaacttggatatacagaaagttcatagttttccttgaactcattatagtgctgagatttcacggcaaccaactggcccagatactccagagtcaaagacactgtaaggagagttgacatttgagcattagacaagacacagatggtaagagttaagctagggtgattggtgaattgctggaggccaggtgtacactgacagaactgtgtgaaactcctgggggccgcagtataacacagggtgagtctgtgttctcttgtatacttttttactccgtgaatcccatggggtgctcagaagctcctgaaaaggtctcgctgtggtacacaactgggagaggggaagagtagccactacactaggggcaaaaagttttgccaggatctttttgtcttctttctctaatatgaaacaaaagctttaatctctgagaagacgaacaacaaacattatcactcttagggcactgttgaaatcctgtttaatggaaaaggcaaaatatctcaaccagtggtgaaggaacaggaagacatgctcggtatggagcgatgccaggagagtggcaggatgactgagaaggccacagcctgaggcacaacaagagaggggatgacttaaagctgagagtggagcaggcactaggggaaaacctggcatgcagatccccacccccagagggatatgaagcttgtggtaggtgccctgatggtaaccagagcaacagtaaggctcaaacccagtccagcttctaatgaaattaactcgattcttgcactaatagcttagcaggagggaaaaacctgtaggtctattagtaggaattacccatgctgaaatacaaagagaaagaagagtgaaaacaagacaaaataaacagaattaagtatccaagagctatgcaccattatcaaatggtataacatatttataattggacttccaaaaagagaagagagaacagattaggagtaatattttaaataataaccagtaccaagtaggataattactactgccaacacacacatgcacgcatgcacacacacacacagatgtatgcacgcacacacactctcactcctagactgctaaaagcaaaagatcaagagaaaaatcttagagatacattacagaaaaacaaagataaggattagtaacatacttttttcttcacaaactaaactattcaagcgagaaaaagggagtaacattatttaatgtgctgaaattttttaaaaattcctcaccccaaaattctctacccaccaaaaatatctttgagaaatgaagatttcctcaaacaaaagtcatgggaatttattgccagcagacctgctctacaagaaatgttaaaggaagcccttcagcaggactgtgatcccagcaaaaactcgagtctacacaaagaaatgaacagtggaaatggaataaatgaagataaaataagtaaactctggttttccctgcattttataaacgttttatttttagaacaattttagatttatagaaagattgcaaacatagtacaggaagttttcatacaccccacacatcattttttctattaacattagtatggtgtatttgtcacaactattgaaccactactgatacgttattattaactgaaattcgcaatttattcagatttacttatttttaaccttgtgtctttttctattctaggatccaatccaggataccacattatatttagcaatcatgtctctttagcctcctcttgactgtgagagtttctaagactttccttgctttaatgaccttgacagttttgaggagtactagtcaggtatttttatagaatgtctctagttaagatttgtctgatgtttttctcatgcttatactgtggttgttggtttgactgaggtaggccatagaattaagatgccgttttcatcacatcatatcaagagtgcctactacatttattatcccttatctgatactcaggaccagaagtattccagatttcagattttttcaagttttggaatatttcccttatactaataagtagaacatcccaaatccaaaaatctgaaatccaaaatgatccaatgagtactacatgcgagtgtcatgttggtgctcaacaggttttagatcttggagcatttcagatttcagattttcagatttgggatgaccaacctgtatcgtcataactattgctgatgttcatttggtcacctggctgatgtttaacaggtatttaccaggtttcttttctgtgaagttactctttctcccgcttttcatactgtagcctttgggtaggaaattaccatgttcagcccacacttttaaggagtggggagttaaggcttcactttcttaagagaaggatatctacataaattatttggaattcttctgcacgggagatttatctcttctctctcatttattcaaccatttatttctatcaatatggactcgtgggcatttattttaatactttggtttataatacaataccacgtttttctgttgctttgttctagcttcagcttttgagggctatctacttgattcctatgtccctttgatatatccttatttttgtgggtttttttttttcagggggagcaggcgcttttttattttccggcactataatatattctaggcttatcttgtgtattttctgccccagtcctagaatcaggcatttctccaaggaacattatttttatggagaatgaaagaaaccaagatccgagtgctttccctctttttaattgctccaaaaggtatctgactatgtaaggcaaaaatagtaactgtattttgtttctgtagcacatgtaaaaataaaatatatgacaacaaaagatgggagggaggaattgactctacacatgatgtaaatattatttgaagatgaactcaaggtaactaaaggtgtatattataaaccctagtgcaactacagaagaaaattttaaagaagtataaataagtcagtagaagagataaaatagaaatataaaaaatgctctactaagtagcccaagaaatgggagaaaagaagacaaaaagcaagataatggtagcttttaatccagtcatataagtaatcacattgaatgtggtgagaaagcgtcagttaaaagattgtcagatttgtgtgtgtgtgtgtgtgtgtgtgtgtgtttcttaaaaagcaatgtggtggctcatgcctgtaatcccagcactttgggaggctgagacaggcagatcacctgaggtcgagagttcgagaccagcctgaccaacatggagaaaccctgtctctactaaaaatacagaattagctgggcatggtagcacacgtctgtaatcccagctacttggtaggctgaggcaggagaatcacttgaacccgggaggcggaggttgcagtgagccaagatcatgctattgcgctccagcctgggcaacaagagtgaaactccgtctcaaaaaaaaaaaaaagaaaaatgctgcttacaagaaatccactttaaatataaagacatagataaaagaagggagaaaatttaccattgcaaacaccaaaaagaaagctaaagcagacctattaatttcagacaatataagcttcacaacaaggaagagtatcagcgataaggagggacgtgacatagtccactttccaagaaataactgtctttaatgtgtatgcacctaacagcaaccttcaaaatacataaagtgaagactgatagaactaaaaggtgagtagaaaaatccacaattgtagttggagacttctatatccctctcagtaactgatagaacaagtaggcagaaaaatcagtaaggatctagatgatttgagcaacactcgaccaacatgacctaagagacatttatagaacacatcactcgacaacagcagaacacacacttttcacaagtgcacatggaacattcaccaagatcacatcctgtgccaggaaacaaactggcaaatttcagtgaattgaaatcaggcatattatattctctggccataaggaaatcaaactagaaatcagtaacagaaaggtagtaggaaaatggccatatatttagacattaaacaacatattttaacccaaggaccagagaagaaatctcaaaggaaatttaaaaatacatatagccaaatgaaaatggaaatacagcatcaaaattttgaggcccaactagagtagtgatgaggtgagatttatagcaacaaatgcctatatttgaaaagagggatcccaaatcagtaatctaagctcttaccttaagaaactcaaaaaagaagagcaaacttaaccccaatcaagcagaagaaaggaaaatgtaaagtgataccaattctacacagtctctttcagaaaaaattaggagagaacactttccaacttatttttttaggtcagcattaccccggtgcaaaaccaaagtaagccaacacaagaaaaaaagtctacaaatccatattcctcatgaactctagacacaaaaatcctcagtaaaaagtaagtaaattgagcaatatataaaaaggataatacatcaagaccaagttggttttatcccaggaatgcaaggctgagtctacatttgaaaattcattagtataatcagtatattaacaattgaacatctattcatcatttaaaaaaaaaatctcaatgaactagtaatagaaaggaacttaataaagagcatctacaaaaaatatacagctaaaatacttcataaggggaaagcattcagtcttctagcatttggagctaggtaatgatatttttttttctcaccagtcatatttaccatggtagtaaaagtcctagccagtacagttaggcaaaaataaatgaataaaatgcatatatatcgggaagagagaaattaaacttcctctattcataggagatagattctttcatgtagaaaagtgtaaagaaattataaaaaaaactcctcggaccaatcagtgagtttagcaaggttgcagggtacaaagttaatatataaaaatcgattatatgccagcagtgaacaattggagtttgaaattaaaaaaaaaaaatgatagcaccccaaataaaggaaggaaaagaaacatctaggtaaaattctgacaaaatatgtacagtctgtatgttgaagactgcaaaacactgatgaaagaaatgaaagaagacctagatgaatagatagatacatcatgttaatggatttcaagactcagtattgtcaagatgtcatttcttcccagattgatctgtagattaaacacaatttcaaaatcccagcaagctcttttgtagttactaacaagctgattctaaaatatataggtaaagacgaactacaatagctagaatgattttaagaaggaacaaaattttaaaaaaatactactactacccgatttcaagacctactacaaagctatagtaatccagaaagtgtgatattgacaaaaggatgggcacatagatcagtggacaaaacggctcagaaaatttacacctatacgtatatattcagctgggtttttggcagaggtagtaaggcaattcaacagagaaaggatggtggttacaacgaatggtgttgaaacaattctacatccatacacaaaacaaaaacaacccaaagtctgaaaataactcaaactttattaaaaaattaactaaaattggattatagacccaaatttaaaacaggaaactgaaatttagaggagaaaatccaacacaaaaagcaggatccataaagaaaaaactgatgtattggaggttgaacttaagttttgctctgtgaaaggcactgttcagagagtataggacaacctacagattagaagaaggtatttgcaagtcacatatccaataaagagtttgtatccagaatattttaagaattcttaaaacccaacagtaagaaaacatttttaaaagggcacaagatctgaacagatacttcaaaaagaagatacatggatggcaaataagtgtatgaaaatatgctcaatattatcaggcttagggaattgaaaattaaaacctaatgagatataactgcacatctagtaaaatggctaaaatttaagaaaacgcaacggctgggcgcggtggctcacacctgtaatcccagcactttgggaggctgaggcaggcagataacctgaggttgggagttcgagaccagcctgatcaacatggagaaaccccatctctactaaaaatacaaaattagccaggggtggtggcgcatgcctgtaatcccagctactcaggaggctgaggcaggagaatcgcttgaacccaggaggcaaaggttgcagtgagccaagatcataccattgcactccagcctgggcaacaagagtgaaactctgtctcaaaaaaaaaaacaaaaacgcaaaaactagaaatgctggtgaggatgcaaagcagaaaatctctcccatatctttggaatgcaaaatggtacagccactttgaagagttggtcagttcttatgaatttaaatatacacttgctggccaggcagggtggctcatgcctataatccctgcactttgggaggccaaggcaggaagactgcttgagcccaggagttcaagaccagcctgggcaacacagcaagaccctgtcttaaaaattaaaaaaaaaaaaacaaaaaaaacttgctgtacaatccggtaatgccactctttgagtatttacgcacatgaattgaaaactatacttataagaaacccgtatctttcataattgtgaaacactgaaactagcctagatgtccttcaacagatgaatggataaacacactgtacatccatataaagaaatgctactcagcaataaactgtttattcacccagcaatacagatgaatcctaagtgaattttgctaagtaaaagaagcagtagtgtatgattccatctatatttcattctggaaaatgcaaaactcactggctgccatgggttgggagtggagagaggagttgactataaagggttaatagggaatttttgaggtgatggaactaatctgtgtgatgctgttttgttagatgcatgggtctgtgtttgttgaaactcatgaaactgtacctacaaagagtgacttttactaaatgcaatttagtaaaaaaagattccgggggagcccaagatggaatgcatattgtcacacatgaatataactttattacagataagtaacatgatattgaaggggtgaggaagcaagaacctggtctaagtaactttggaaacttttgactggatactgtaaggttagagaccaacgaaattgtagcaaatcactgtgctctagatggtaaattcatccctcacatacacaaacacaaagggttgaacatataaataaatataaaatgtaaataaacaaatggacattgtagataaaggcagccaggtttctcatggttggaggagaaagttgcagataacccagggggttgggggtggggtctagaatgagcctgtgtttcagggttatagttgaaggattcagtaagagtttatatgtgtgtgtgtgtgtttgtgtgtgtgtgtgtgtgtgtatatatatataatttttatatttttagtggagactaatttttgtatttttagtagagacggggtttcgccatgttggccaggctggtctcaaactcctgagctcaacatctgccccctcagcctcccgaagtgctgggttacgagcatgagccactgtgcccagccagacacatannnnnnnnnnnnnnnnnnnnnnnnnnnnnnnnnnnnntgtatatacacacacacacacacacacacacacacacacacacacatatgtacgtatgtgtctggctggcacagtggctcgtgctgtaatcccagcacttcgggaggctgaggcgggcagatgttgagctcaggagtttgagaccagcctggccaacatggcgaaaccccgtctctactaaaaatacaaaaattagtcgagtgtggtaggatgcccccatagtccccagctacttgggaggctgaggtgagaggatcgcttgagcccaggaagtcgaggctgcagtggcctatgattgtaccactgcactccagcctggctgacacagcgagaccctgtcacacacacaaaaaaaaggtacagttgtgtgtacatatgaattagtatacatcatatatttcctagctctgtttgctgagaggtctgtgaggcaatagcatccagtaactgaacatacctggtgctcagattttagtttcagaacaccattttctaatacaaggactcagggctgcttggaaaaaaatggtttgttgtagagctggggcagggaaacgggatgagccggggttgtcagaggttaagaaagtgcgtatcaaaagtcacgggagctggcctttcaaaagagtttccagtggccaaaactagaacaatttgagtaacaaaataacaatagtattggattatagcccagggaataaaaaacattgagtccattactgatataaataaatgatagaataaataaggggaaaaagggacaactcttccttagaaaataactaattaataaatgtagaaagaatgagagagagtaaatcagcattagaacaccacagtacaatggtaattgttgcaggcaaagtcagtggataaatgctaacataagtgggcaaaaagtttaagtaaaaagctattttgctttgtctcagaatgtctcttccccaatattcatttcttacaaagggaaaaattagagaattagaaataagagaatcctggaaaacactgccttaaccggaggatcaaggttaacatcaccagtaatgggacataaagacaacatgtgccttccaatatgacatgctaagaaagccatgtctctttgtggtattcttgcaaaaatccatgcccttctatctgattatgaatgaaaatcagacccaaattgagagacattctataagataactgatcagcactctttcaaaacaagttgtcaaggtcatgcaaaacaagttgtcaaggtcatgaaaaggaaagactgaggaactgtcacagagcagaggagacgaaggagatgtgagaactaaaggcttgtgggatccaggatctgatcctgggtcaggaaaaaggacatcagttgaaagactggtgaaatccaagtaaagtccaaagctttaattggtgctgtattatttttattagtttcgacaactgcattgtatttccttgtgatgttaacaatgtggaaagctgagtgagatgtgagggagctctctttgtaaatgctgtctaaaattatttcagaataaaaagtttaaaatatatacatacatacataacaaagaaatacaccccaaaagggagccaagaaaaaatggcatttaggatggtcccatagctcacctttcaggtactggatatgcaatacttgctactgtctttcagaaataaactctacaaaatgtcatgtagggtacagaaatgtttacaagaattgttagtaaactgccaatttagagacaaactccatttaagcattttagcaattgcttaataaagttatgtctgattgttaggagagcatgaaggatctccatggaaaactcaaaatgtgtcgtatgaactatttacacgcttattcctgtatattaaagtgaaaaccatatgttttacacatacacagctataatgttagacagtatattttggtgtgtaccttgtgtttggagatatgtaaagatatctataacaaaacagttgaatagcatcttgcccacattggagatagcagttgtagatcaagtgattgtttttcagagtaagtaatcggtcccacctactttacacacaccatttacagagaaaccttcttccagattagggcttcatgtatcagtggcacttacaatgacacttttcacagactgacagagaagcttaacttactcaagtaaaacaagtaaaaactgattagactgtttctagcatgttaatattttctaaatgttatggagaaaaggagcaaaaatgtttctttttttttttttttttggacggagtctcactctgtcacccaggctggagtgcagtggcgtgatctcagctcactgtaacctctgccgcccgggttcaagcaattctcctgcctcagtctcctgagtagctgggattataggcacctgccaccgcacctggctaatttttgtagttttagtagagacaaggtttcaccatcttggccaggctggtcttgaactcctgacgtgagccaccgtgcccagccttatttcttttctttacatgacttatgaattcatttctccttcagtctcattttcttcaaatatgtggtttttctccattgaagtcattttattcacatgaaaatatatttgcaaatgataaacatatataaaactggtatttaaaactcatgtatttattaacaaatgtttgtgttcctgttgttttataactgctagctcctgcgggaaataaaacatacagcagtttctttctgccaagaagcagaattcagtaggagatagataacatgtatcaccaggtggggtaatagtagggtgattaagatacagagttacaagtacagagttgatattctcacagttccaaatacagatcgatagcatgatgaggaaccccttttaaatactgttgcagtagcatgactatgtataagaggccagcatgagagcagaccaagttggggtaggagggtgtctttgaatactggccctagagaatttaaaataatttttctagtcttttgaaaactcaacaagtagagacaagtaatttatatttctatctgttgtgtatataatcgtctctttagagttccagacagctgctagtgtccaaatatgtttttctaaagaaatattttgtttgtgagtaccaacagtcttagtaactctcttatccctcttatgtgctgagtacagtcggaggaagaggaattggagttggtgagtgtgggtttctgcttgaaggaagttgaaaaagatgtagaaagtactaattctcttacgtgttgttatctaaccaatgttccctttgttacacaaatttttttaaacactattcaaacactttgaataaagcaatctactggtactacagactctagtttttctatttataattgtatgtgttgacccattttatttgttggagggaacattggaatagagcctttaaaaacagtagctgtccatgagcataggatacttgttaattttttttttaaggaaagatacaaaataccttatatagctctccaaattattgaaatatttttagaaaatgacttcaccctcgaagttcctcagattgtaacacacgatgttgtgttgtttctctttcaaaaagattacatcatttttggtgaggtcacctttttcagcgttggaattatttcatcctgcatgatacagcctgaaccacaagggggttccctgtttactaaaaggaatgtctgtaattgaatgtgtatataagtttacttttctatcagaaggcgctcttttcttaaaagcaactattgccctttttccaaaacaaacgttttctgttggcttttcctctagaaaataaacttgactaaaagcagcttgcagttgatctatttcttctttaggaactaaaaccaaaacctcacaggagtcatcatataatttcaaagtcagctgctaattaaaggactttaaggggaataaaaacttgaaaatgtttcttagcatggacaaaggttaagagtgcatgaaagcatgggggaggaaggcatccgttggttttaatattccatgtttatgcatgctggtgtgttttgcacagtttgttttcttttcaaagaaggttatctgttccccttaaaatacgagattgttctttatttagctttgtgatcactcacagttttgggtgtagttttgtattggccaactgaaatattctagtcagctgtaaatgttttgaattatattatgaatatcttttggagaaacactttacttaatgataccataatgatcagtaaatgagagtttataattcaagctaaaataattcaccttaggttagacctcactgttcaaggagttgtgaatgcgtccatgaattatctagcactatactgccctcttgtggttctgaaaatcactcactcttgtagaactcagtgccgttgagatgaggagcttagatgagtggaactagtgtttgaagtcttcactgcttttgaagacatgccaggagattgcatgaagatgatgccatggagtaggtagggtccaggccaaactatgtcatactgtattctttcacctagtgattggacttatgaagttccagactaaatattaaagaagaaattaagtccaaagtagatctctatctcgaaaagtcattaaatttataaacttgatgctgagactaaaatatattccgaactggcatacattgattttccacattcctcagagtacatctgtaattacagaacctcagagataaatatattaggtccttgaagactttaaaatacatacctaaaaacttataaacagccatttatattatttaaaacttaatcaattaaaaatgcagaactttatgtgccagaaccaaaatataatcagaagcacagtccgttacaacttagaaagttgttcagcttgccttgagctctaaagtataattgtggatgactctgatccgaagtgcagaaggacaggtgccctggggcctgcactaaagactgtactgttaagaccagcgacagattcctttagaagccgagcaatactagaacaacttgacttcatgaaagctgcagtagactaggctatggattagaaggaataaaaatatgtatcttttttcccaccagttatatagaaatttgggacagagggtttcttaggacaataaggatattatcttatatttgtgtagtacttcagttatgaaagcacttctgacatagtaacctcatttgattctcacagtagctgtgcaaggcagccaggacaaagattgctatatcttctttatttgacaatgaagaagttcagagaggtcaaattattttcccaatgcctaggaaatggtgaatctgggacagaaactcaggcaatacatccacatccacatgatctttctcacatcttctaacctaggttagaaagtagaaattaaaaagaaataaactgagatcaggatcctcatcgaatgtttgtaagtgtctacatctagccaaaggcctttttgtctgatgtacccttttgaaaattgtgatagagaaaatggaatcacattctaactcttcataatctcaaaggcactgaattatactttactgatttggctcagacccccgaatgtcagttatcaggctgtaacataatttataaaaaacaaatagagttgtgctgtggctttcttatgtgctagtgacacagagtctgttgtgttcctctgatctttgattttcaaaaaccgttaccttaagccagtttggcgagaaactgcttctgtcgtactcctacacgttaaggacaatgactgtcttagactaactggattatttaatagttgaattttttttatccattcccagcatggataggatgctacacagatgcatccagttggcaaaaagcatttaatattgctcttccactgccctgtcggcagtacttgattcaaaattctctactcaaagcctctgctacagaaggccaggggactatgaagggatacatgtccgaatctgttgttaaaaaataggtcaactgcatgattggagagaaagaaataagaatacaagctgcacccaataagccatgacttcaaaccgtgttaacacgtaaataataccgcaaagaaaagtagttttgattcctatactcatagacgtacaatccctatatatacagatgacctttgccatcatcaggtatttaaaacctacacatacttcatttaggggagtctgacagtatttgtagtggcatcaagtcctcattttgtgcaacaaatagaagtgctaatgcctgtaacagaagttcctattttaacgtggggtgtctgacactaatcaactattttaaaagaattaatgtaaaaataggacccttcaaattaaatatttagttattctcactagtatttttgaagttttcacatcatcagtgcttcagaaaatgacattcatatgaaactgtgaaaaatgtcacttaaattgaaagtgatttttaagtcaacataaataccacatcagaacacattttctcttttttgatctcacagaacacccaaaggatcagtagttctcaagccactcaacctcttgctaccccagtcgtgtctgtgacaaccccaagcttgcctccgcaaggacttgtgtactcagcaatgccgactgcctacaacactggtgagcctgctctggtgccttccgtaggttttaccgctctctgttttgtgatcaacgtgtgcttctgtgattttttttaagtatatttattgaaataaactatttccagttttttagatttaaattaggatgtatttttcaatgtgctagccttgaaaaaattacaaacaaaatggatagtgtggatagtgcgatgagtaagttattccggcttctccagtgtgaactttcacttaacccctgacacaaagccacgtggatgatagcaaaatggtgacatgcatcaagccaagaggggagcagcctgttgcttgagtattgctgatgtagtttctcttcatacagtatcacgcttttccaggcttttaaaataagatgtttgtctttatgctgtgttaacctgctttgggaaagacatgaatccctttggacctgagacttcaggaggtggccgacgtttggctgtgtcgaacaggctgttttcctccctgtaaccactagcttggtccatgtcatgtgcacctgaggggcaaaacaagggctgttctgatttctcctcggagccagtcactctgcctttgaggggagcttttccttcatttatgtttatttaggcatttcatcttaaaatgccctaatttggggttgtattaggaaagtttaagaatattacagtgatcgtaggagtgcttttagccaagcagactgtatggagaatcgagggcagctggtttcatttaaatttaccaatctaagaaggagtggaaaacacatgtggtttcgctttctcatcagctgagccaaacacctgatgcttcagaggaagacggcagtagttcaattctcccttgcccattactcagagactgcaatgcagagaagttattatgattctcctgagtgtcataagtagactgtggtaaagatggtctgattttagccttcagggtaaatgctttggcacagaactttgaaactgctgtccgcagctacgtgaggggacagagcgttgataacatttgattgccacttgaattctaagaagttcttttaaaacagaatcaacaataaaaggttttattgaaaaaaaaaaagcctcttaggaaatatccattacttttccaaccgttagtgtgaaaaataatgcccaaatttgtcagctgcatactatcttagggattgtgaatcatagcctgttattagtgccttgcacagaacaaggttccagagtaaagccagggatgaagcattcatagaaattctgtttcgacgcattgatcacctgctctgtgagagactgtactagggacatagctttctccaagtttattccaagtgaggaggcaggacatacctaagtgggtaaccgtggaggggaagtcctgaattgttgtgattgtgaatttatactctgagaattgagaagggagggcaaagctatactgttcaaaggtgtattggctgagaagagggagcttgaactgggtgtcagattatggtttactgaccgtttcattacaggtttttcagtatacttagaaattccactatacttatttttagaaatgccattgaattgggaatttattttttaaaagtataaaagaaattaccaaagcatataaaaatggaggcaggctctcaaaatcatcagtcgcttagcgtcagtctcatgccaccttttgaccgactttatctttcttctctttctcgtaacacttactctgtttgaagtttaccatgttgtttttaacttatttccacatctattcagcaaatatttatcaggcagctgctgtgtggcaggcactgtgccaggcactggaaatgcaggagtgcagtcagcagtgaagcctggggggaaggcacaagacacacagctctagggataagctgctgcagttgtgtcaagggctgtgtctcagctcggacaggaaggaacatgcgtgactcagccaggcagaggaggcagagtgctcttgggagagggtgtgcctgtacaaaggctaggagtttgcgggcgggacggggctgaaggaatggggacagagcgtgggtggttagaattgagactagagaggtaagtaatgatttgtagactatgtcaaggattttggaaactgtccggagagcattggggagccataaaaaacttttgaagtagaggagtgccatgaccatatttgttattttaaaaagatgtctttgctgtatatagggttaaaaggcaatgccaggaagccacatcagaggctactgtagtggtccaagcaatgggtgctgatagcatagactagagaggtggcagtagagatggtgagacctgggcaggcttgagagagagcagatagaattgctcagacctggaaattgatgttgggagtgagagggaagggaagtagcaaggataacacccatgggcttctgcacgagctgctgggtgcatgttggtgccatgtactaagagtacttaaggaggaacaggtttgcaggaaaggatgggccatgtcagatgtgtggcgtttggagtggcgtccaaatggacatggcactaggtcgtttaaaagatctagaggtcgaaggagactgtgggccggagggagcactggggaaggcgtcagtgtgacgggtccttgcccgagcccatgggagtgtatagaatgacaagggcagagtcaggacagccctgagcaccagctgtgtcgcttcaactccgttccttttttaaaatgttaattcactaggaagaccaatttctttaaacacctctcttgagacatgagaaagaagataaaagtagaagagttttgccacctctctttggaaccaagtgagaaagacaagtgttaatgatgagctgaaataactccccgtgtgagtgataactaacgtcctaaatcttggtcccagtgattacgactgaagcattcatatgatatgagctgggtatactctaggacaccgagttttttcatgaagttgaaactcttgcatgctgtcagggagtttgcgacagtctaggtactttaaacaaatgcgcttactaattgtgtaatgatgtcactgagcttggcaccccatgtagggattctgtctttcctgtcccctattccctgtcccccaaccccttgcttcattaagacttgctgattcaaactcactctggttgaggttgagtgtttctctttgttccaaagggtagtggcaggcatatttaaagtaacaattgtacagaacactctttaatgatggcctcttatttgaatcatcccagacaaagaaatattgctagatcctgtaaatcttccaagaaaagattttgcggattttagacccacatgtatgttgttttgttgtgaagtatctggcttctctcaatgtaggaactttttattttatttttttttgagaggaagtctgttgcccaggctggatggagtgcagtggtgctacctcggctcactgcagcctctgcctcccgggttcaagcagttctcctgcctcagcctcccaagtagctgggactacaggcatgcgccaccacgcctggataatttttgtatttttagcagatacggggtttcaccatgttgtccaggctggtctcaaactcctgacctcaagtgatccgcccatcttggcctcccaaagtgctgggattactggcatgagccagcatggctggcctcaatgtaggaacttttgcagtagctacgtaaaaaatagattccgtatggaccttccatcatatgcagagccctcttgtcttcctttgtagattattcactgaccagcgctgacctgtcagcccttcaaggcttcaactcgccaggaatgctgtcgctgggacaggtgtcggcctggcagcagcaccacctaggacaagcagccctcagctctcttgtgtgagtaactagaagttttccctgcatctttactcctggcctacacactgtcttttcctatcagtgacagccttttgctctgttgagtttcgtgtgaggaatcctgtaatgattccttttcaggtagatacaagtgtcgggagaaaatattttcttacatggctctagacagtagcttggatactgacaaactaggcattccttgaagggatttggggagcaaggcttctcccatagggacatcctgaggtagagagactcaaccaggatctgaaggggtctgaaggcacagataccacccgcatgcaccatccttctgccctctgaccagtgatgaagctgcctactgcacccctgctcccaagcacctgcctctggctgcactgcttgaaaggcagcctgtaggcattcaggcctccctgccacccttgccattgactgctttggtgagtatctgtagacaagaataggaagacaagctggaccttttgctttctccctgggccacagggaaggaaaactggggacagggtgtcttatatatcagtcaggctccataggatttgtgtgactgatcccagcccaatgcacacaccaaacctcattcacaaagagaatgttccgtatgggcagggtgtaaggatataagcaaagaggatttacagtggcgcccagatgaggccagacatccctgacagccgggagaaagaacagggcttttgtggaaccaggatgacagcagacccatggagcagttggaggagagtgtcccaagagaggggacaacatagcagacccagctggcctccatgaagactggctgccttgcctgtgctctgggcagtaggaataccccaggcccctagcctctgcccaggaagtccccagagagcctgagctcagcagtccctttccctcatccattctgaagtaactgcacagtgaggattgttgtcagtggtcttcttaggaattatgtcatggaaaaagcagcagagtatctcagggaaatttgcctacacaggatttggccctcaggcctgtcctgagcatcctaaatgaatgcactaaaaatagtcctggaaaagcaagtggaaagggctcagagcccaggcccggggaacagcctgtttgcgtcctcctctactgctctcagccagcccctcatttcctcatctggaaaatggggatggtgcgacttgcaccttagaggtgttgcgaggatgagcgatgttgtgccctgtcacagggccagagcagatggggagcagatgctgaggaagaagaggcggtgagcagatgaggctgctgttcctctgtctttctggtccctgcacagcattaagacactgacattgttttgtatactttagctgcaaaagtaccaacgttgtgggtaacagaaccaagtaacgtaagggctcaacggtactgttttctttcctcctaggaagatgggatttccttttgtgccaagcactgaaggaaacgacccaaaccagtcttggggaactctgataagatttcagactctgggcccttttccatcaggcagtgtctctactgtatcatcccagttttgcagaggtacttgcaagccatctgacctctctcttttttttccttcagtgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttataaggcattatttaaaacttgccttttgtgaggaaaaaatgtagtagaaaaagctgacctaatttaattaatattagagaaaatggcaaaatagtagatgagcacaaaggttttataagtggtaaatgattaggggaaaataatcatggggaaagggatcttttttccttgaccctctgaaaacagaacgatgcagctggttacaaaatcctaccgttatcagctcttctgcacattgcagtgatgctttggtatgcggggagaaacactcttagggtgctggtccttggcatgactcttgccattctaattggaattagtgccaccctcagcttggattttgaacaaggccttattctttcaggaagacaactaatggatgatagcaagttcatccacttactgggcttgtgccatgagcaaaattcaaagtcctgtatatctttcattgtagatttttaaatactccttttcctaaaaaactcaagggtttaaaaattgctattttatattttaaatgatattgagcagctacctacaatttctatgtacattttgttcccccccccccacccccccccaaattacgttccttttgacattttcctcatctgctgtttgtgacaagtcatcagccagatttcctgactgacacataggtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagtggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattatgtccattttgttatagactaaatcaggggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaa

SEQ ID NO: 14694 - DNA, 16883 bp, Human
agcattgagatgtttatgtgtatgcgtatctaaaagcacagcacttaatcctttaccttgtctatgatgcaaagacctttgttcacgtgtttgtctgctgaccctctccccacaattgtcttgtgaccctgacacatccccctctcggagaaacacccacgaatgatcaataaatactaagggaactcagaggctggcgggatcctccatatgctgaacgctggttccccggctccccttatttctttctctctactttgtctctgtgtctttttctttcctaagtctctcgttccaccttacgagaaacacccacaggtgtggaggggcaacccacccctacacttccaggacaatctgcagagattttaaatggttcaaataattttgacagatgtaagaatgttatgctctaaaaagtaaaagactttaaagtagttttaataataaaggagctacagtgttaaggaaggatgatagaaagagtttagataaaattattttacaaagtatgaatgagaaaagacactgtatctgcaatttatatacatctaatatataattttaatgtgtaagtgagaaatgcttggccaggcctggtggctcacacttgtaatcccagcactttgggaggccaaggtgggtggatcatctgaggtcgggagttcgagaccagcctgaccaccatggagaaaccccatctctactaaaaatacaaaattagccaggatagtggtacatgcctgtagtcccagctacttgggaggctgaggcaggagaattgattgaacccaggaggcggaggttgcagtgagccgagatcgtgccactgcactccagcctgggcaacaagagtgaaactccatctcaaaaaaaaaaaaaaaaaaaaaaagaaaaagaaaaagaaaaaaaaagaaatgctcacacaaggttgggtctggtggctcatgcctataatcccagcaatttgggaggccgaggcagggggatcatttgaaggaaggagttcaagaccaacctaagcaacaaagtgaaaccacatcactataaatatatttttaaatgaaatgttcactcaggctttttactattttatttgcttttgctgtaaaatagagataatgccacttattctgtatgctagaagtcattactgaattagacataaaacacaaacagctcttagaaaacaatctataaaaataaaatcacactataataaatttaaaaataaaaaacctataaataaaatatttctacaatttttcacttagtaaataagcagcatagtgaagtggttcaagaagagggtatgggatcatgagtgcttgggttcagattagttacagtgttatgattttagacaactaataaagtctttctgtgctcagtttctataaaaccatgaggaaatattatgagttttcagttgtgcgattcatgtaaagccatcagtactgagcctagaacatgagtacaacacatggagccccctcctggctgtgtgctgggcattaagtgccaggggttaggtgttcatgagtgtgttaaacatgtcctttccttatgtactgcacctctcaaagaataggcagctccattgagagtgtgtctattattttaggaaattgtagctgaaaattaacatgatgcctcctcattctaggtttctcaaattgactcaatccatgagacatgtatcattgtattcaaaacctaatgggcattttgttagacaacaaatggtctctaagatttccaacaacaacaaaaaaaatttgaagcttctggttgagaaatctttaaaccctcccactggcacactccactaattccatttatggtagtggagtcagtgatttgaacgaagtactttcagtttcatattactctaaatccattacaaatctgcttagcttctaaatatttcatcaatgaggaaatcccagccctacaacttcggaacagtgaaatattagtccagggatccagtgagagacacagaagtgctagaagccagtgctcgtgaactaaggagaaaaagaacaggtaagaacttttactacttctcatcaagcagctttctctctagctccaaaggatctcagctcagtgatatggaacctataaggttgtggcagggatgggaaggaatttataaaggtcagttcattttcttaaacatcatcagaaccaaattaggctgcagatgagcctgaagtgggacgcaggtcagatgaaatcctggtgttatcagggacagcatggccttaagtgccactacagtgcttgtgttgaattaggcaccagtagacaggggctaaactgagcatttgaaatgtactaggatagtctttctctttgttgacattatctatgttgactagggatatgattacatttccatcgtcagtgatggactgaatcctgcttctatgcagctaagaaatggaagagttacaaacgggttcttttcatggaaggaaagaacagcaaatgagaagcagagtaagcagcccactgacacggttaaagacaaagaaaaaactgaaactcagcctgaaagatgaagattcatgaaaacagtatactttttattacacttgtgaactttgtttcagaatggattactttctttagaaatagtccagactcactaatttcctagtgcccactgatccctgtcccttagaagtgaaattcaaccccactgcttcactgaagtgcttccaattttgtcttcttttagtagagagcagggccaaaagtgtttcctctttaattctcctgtaatgcatctctacagaaaatatctttgcttactttaacctctccatgcactcagactactttgatcctgccttctgcaaagtcttcccctgaatgccttgtcaagacactagcctcattcatcacctctggtctgacagctcctctctctctctctctctctctctctctctctctcacacacacacacacacacacacacacacacacacacacacattcccagccccttatcctcctctccactcctactattcctcctctttctatttctctttctcctaccctaccaaatggaaaacagaacaaaacagaaatcctaaagctgtatcgctggaaatatattttatttgaacaacttcctaggtagctctctttatctgcctcttgatcttttaatccttattatctggaggaaacattcagtatttgcaattttgcattcataccctcagtgacttagaagctatcttatcgtgactctaatgaagcttaagtttcagggcccttctcttggacatgacccttaggagcccttggaaggttccctagccatgtgtttcacatggttgtatagttttataaaatttgcaaaagtatgttacattgttaccacttccagaatggcaatgtgagaagctttgtcaatcctcattgcagtgaaataagcataatcatttgaagatggaggaaggaacacatttaaaaatctttggaaatttttctaagggtaaacatcaaactatgaatactgattcactgtgttggatgtttattcactgtgagaattaataagtgaatcaatattgaattccttacatacagccaggatgcaaataaatcctctaaatcctattctatcttccattaattgactagtgaaaatatctaataagaatccaaaaagaaagttttccacaataaactaaatgaaatatttgggtcgtgagagtagttgagtgttgataagtcactgtcatgctaacatttttcataatgagctactttgacaatacttccataactttctcaaatgatacagattttgcctcatctcttttgctgtcacacacaaaacttttggccatactggggaatcttatgattctcccttataattgcaaaacactagaaattctcatgtatttcacctcttctcttgcagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggtgagtggcatgagcaaagctctgccaagtcccttctgtccatctacacagtcagcctccattatgaagatgtgaggagagaaagagatgaggatgaatactgaaagctaactttccattcacagtcgggctccttatcttcacgctgttctaggggataagaatcaattcattaattattcccatgataccttagtttccatttcaaaagcacaaattatgcctctcctaaaaggagtaagacagtaataaaaataattaatgtacataataataactataataaactatacaatgtttattacaatttttatgcaataacagagttcacagtgatctttaaggttgaaaaaatgtttcaatctgtagtggatattattttttgttgttgtaaaaaaaataaaatttaacctcgtaaccatttttaagtgtacagctctgtagcattaatgaaattcacattgttatacagctgtcacctccatccatatccagaaatctttcatcttgcctaacagaaactgtattaactaaacaaaagctccacataaacccattgcctgccatcattctacattctatctctatgaatttgactactacagaaaccttatataagtggaatcattcaatatttgtccttttatgactggcttatttcaattcatatgtcttcaaggttcatcagtgtgttagcatgtgtcaaaactcttcctttttaaggcttagtaattgtacgtgtatactaatttgtttatctcttcatctgtcaatggacacttggatttcttccaccttttgtctattataaataatgctaataggaacatgggtgtctgaatatctgttcaagtccctgctttcacttcttttgggaatatacccagaaggggaattgctggctcatgcagtcattgcatgttaactttttttaagaaatcactataccattttccacagtgactgtaccgttttacattctcaacagaaatgcacaagggttctaatttctctacatcctcaccaacattttttattttcagtggttttttttttttatagtggccatacgaatggaagttaagtagtatctcgttgtggttttgattttgatttccgtaatgactagtgatgttgagcatcttttcacgtgcttattggccacttgtatatcttctttgggagaatgtctattcaagtccattgttcatttattaatctggttgtttatttctgttgctttgtaaatttttttatattttctagatatcaatcccttatcatatacatgtttagaaaccattttcttacattccgtgtgttgccttttttaactctgttgatagtgtccgttaatacacaaaagttttaaattttgctgaagtcccactaatctattttttcttttattgtctatagttttggtttcttattcaaaaaataatttccaaatccaatattataaaacttttaccctttattttcttctacaacttttatagtttcaactctaatgtttggttctttgatccattttgagttcatatttgtaagttataaggtaatagcccaactttttaaggagatatatcatttcctcaacatcatttgttaaagagactctcctttcttcattaaatgatcttgacacccatactggaaatcatttgaccatatatatcagagtttattcatgggctgtcttttctattctattggtttatatgtcagtctttataccagtaccacacatggttttgtaatacgtttcacaactcagaaactgtgagactccaactttgctcttcctttttatttttataattaggggatctctggaaatttcatatgaaatttatggtggatttttctatttatacaaagtaattggaatgttggtagggattatatcaaacctgtacatcactttgggtagtagtgacatcttaagaatattaagtcttccaatccataaacacaggatgtctttctaataacttatgtcatctataatttctttaaagggtgtttgaagttttcactctacaagtcttccacctgcttggttaagctgattcctaagtagtttattcttttgatgctgttaaattggattgtttccaaaatttccttttctattttttacactagcaactgatttctccatattgactttgcatgctgcaactttgatgaattgttttaatagttctaatagttttttgtgggatagttaatgttttctacaaattagatactatcatcagcagacagagataattttactttttcattaccaattaggatgcctcctttatgcttctcttgtctaattactctggataggacttgcagtgttctgtggaatgcaattgacaaaagtaggcatccttttcttgttcctgatgttataggaaaagctatgacacttcatcattaaatgtgaagtgagctgtgggttttcaatatatggcctttattatgttgaggtattgtctttctatttctactttgttgattatttttatcatgaaagcctcctgaatttttccatgcattggatattcaaatttcctatttctttgattgtaagtaagtaaggtgaatactgattgttgtttcagttctctctcttaaccttaaaatacgctaccttttccttcagttgctagaactgcctgttactaaatccccatctctggtctcctctctcccttgcaggcttctctctgggctccacggtgcagtctcacactaaaggaatctggatgtggtgtgtgccccaccccaagaagccaggccacatcctagttctgctggacaccgagggtctgggagatgtagagaaggtgagactcaaggatccagttgtggagtaagcccctcctctctgaatattttatgcagcggttaattgtttattaactattaactacaggctgtaatatgtgtgggttaacacagatgcataaagggagcacaaataatcccagtgtcataagtcttatcctgcacagaactttagttaagaatttgggtgctaaagccatgtgactttgtatttaaatttaaattctgtcactaattcagtagcctgagaaaattgacttattttcgcctcagcattctaatctttaaaatgtatggaaaagacctatgttggccatatagtattattttgaatatttaataagataatacattacaggtgtatattaattattcaataaaatagcaactaatagtaccaatcttatatgtgaattctgttattgaaaaaaagaagagaaaattttaaatttacattgtactcaggccttaaaatgcccaccaaccttgaattttaattttacaattatctgttgatgatcattagaagacctagtaagaatcatggtaacccaaaaacactcgtcgaaaaactacccaaaagccacatcctactgagaataatttttgtatttgtcttcctttaataggtcattagtgttaaaaaaaaaaaaaaaaaagaaaagaaaaaaaaaccctctaacatatgaacatagttttactactgttactctgaaaagtgctgcgatgatgaaacttgctcctgactccagtgtgtcttgacttccagggtgacaaccagaatgactcctggatcttcgccctggccgtcctcctgagcagcaccttcgtgtacaatagcataggaaccatcaaccagcaggctatggaccaactgtagtatccttttgtgacccagaacagcaccaaggtcagaggggacacctgtattcatacaccagctgcctgactgtgaatcctgatgaatcaagctcaaaaggagaaaacaaaaaataatgcaagtacagaggagagatcccatgtatccactttagaactgacactgacacttaggttaggagcaaaggaaaatggaaggtttgggtatgtgttgaactaacatgggatgaggtccctgttcattttgtcacatttccttagttagctactcagctatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaacagagagcttcaactgataaatgaggatgagaaaacacaagaaattatcatttttcagtttactattgctagttttccagcatttgcagttttctatgtcttcagctggctattcctagaaattaatacttgctgaatatccaaattaatagatgttattttaaattacatttgtcattgttctagaacaagtttcttgttctttcacctttgtgtatgctgtgattaggttaattttatctccctgcctagggtttgtgatcttctacttagccatagagtatggagtacaatggatatttatttaaagaacatagactaaaacatgaaccgtgtgctagtccaagcattggcaaactacagcccaagacaaatcatggcaaatcctgcctgccagctgtctttgtaaataaggtttttttggaataatgctatgcccattcatttacatattgtctaaagctgttgtcatgcttcaataacagagttgaatacttggaaaagagaccatccagcctgaagagcctaaaatatttactatttggccctttacagaaacacttatattaggcaattttataattttttaaatgtttttctaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtaagtccccttcctagtacttctgctcattgtttaagactagaggagcatagaataacttccacctagtttcagcattgaaaaatcccaatctactgctatatttgtgttaaattctagatggcaccaatgtttctaacatatattgttagtcacatttccagtctaggaaaaggccaaaggaaaaaagttctattgcttgaaattgccctagtgaactggacctgcactatgcaatagagtagcccctagacaagtgtgtctatgtaaacataaatgtaaataatttaaatagggaaaatttaaaagtcaattcacatgcctgtatttcaaggactaatatttacacgtacttagtgactagcacactgaaaagcacatatacaacattcccagcattacagaaagcgcttttgaacaatactgcaataaaataaactaaatggatgactcttttttattggaatagtgtcatttgtttcatacatattgatcaaatgcttactatgaatagactgaagatacagatataaatgaaatagatatggttcctgtcctaatgttggttggggttaaaatggatgcaaacattcaattaacacaagtctatgtaatctagtacaagaactctcaaatgttggtatgcatacatatcttctgaggatcttaccaaacacaaaagtctaattcaatagatctcggacagggtctgagagtctatttccagcaagcttccaagtgatgctgaggacattgatgctgtgaggaaaataggtggtatttgacatgctcagaattacatggaatagagactttctttaccaccagaaacattatcatttgttcttcatatgcaggtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaaccctccaggagctgctggacctgcacagggacagtgagagagaggccattgaagtcttcatcaggagttccttcaaagatgtggaccatctatttcaaaaggagttagcggtaatttttgtctcaaatgtatacggtttagggtcatagaagctaaagtaccacaaggaaagaaaactattatttattttgacggaagtaattcctcctagcttccataatggtgaaaacaacagatttgtgatcacatcagtcagaaggaccaactgtattattacagacccaaagttctaaaacattttttcctgaataattttccctttacttatgcatacaactgacaaccagagcttctaataaaattacctgcccactcttctcagactgatttgatattctagccaaacacaaagaaaattttcatcctacttatcttgagcaggcttccgttcagccacatttattccatatgaaatcattagtccaatatgcaaaaacagagttttcctctaacggttgacataaagctatcaatctcggtcctgaacctcacctccaaaaagaaagcgacttcagtagaaagtggggtcagaaggaagagtgtggtcctggtgaggagtctgtcaatttctccagcgtcattgacttttattttcagaagtcattcccgaaattctgaggtcaagctaacatcctttccctgttactctttttacttcctatttttacattaaaggcccagctagaaaaaaagcgggatgacttttgtaaacagaatcaggaagcatcatcagatcgttgctcagctttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggtaaccaagatttatctgtcaattatggaaagctgctgacctgcctcctacaaacaccaaggtgaccaagcttcactgcatacagatgtgcttttttgtttgcataacattcatgcttttattcaataacatatgcaaacaggctgttataccagatatgtcctaggtgctcatcaaagagagtgcagtcaattaactattaagttataaattcaattagcagatgaagcacaaagttattattgtcatcattacagctgggcttttcctgttgcaagagacaggaacccaatgatggctgcttaaacaaaaatgtaattcattgatttaggctgcaaactggctttacaggtcaggtgggtctaaggtttcaagtaacatcatgaactggctctctgtccagtgttcccccatccccacagttttctccctcccaccatccctctatctgagtcactctgatatttgctttctcaatgatggcttcattccccagcaggctcagcccatatgggaccacagcattaacagttccaaacttagagcccttaatctaaacaggacagagactctccttttcccagtatctatattagcctactaaaaatgactgctaagtaggatgttctgatcggcttgccaggagcatgtgtctgtcgctccgacagggaatttgaccaccaaggacaatagggccaagagaaagaattcccagaggagaaaggatggcaggaagacaaacaggaacacctgcttacagccatttcctacttctcactctgtgttctctgggtcctaaggctgaagagattctgcagacatacttgaaatccaaggagtctatgactgatgcaattctccagacagaccagactctcacagaaaaagaaaaggagattgaaggtgaggagtgagttaagagattagatggcctcaaaagctccaaaaattgaaataacttgactggataaacatgggaccctttaactagagcaagatccacaaaggtgtgtcttacttgccgaggtcatctctgagtagggcatatgcagtcagcaacaacgacaggtaagtgtataaggaagaatgaggcaacaagataaccccacacaaatttttcttctgccttttcctcctcagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggtatctaattgcatcaccttgaggtttctctgttttctctccattctccctgatcgcaaacttagtgtggcagagagaacatgaagcccagggtaaggaccctgcttgcttacttgtacttttcaattcctgtctgtccagcctgactggctactgccaagtctggtcactgaaagttttttatttgcagttgtgtaacattcagtcctttatcaatatatccttcatttcaaggaagctattatctgctaggcatcattaaaatatctgtatctcggtggggcattgtggctcacgcctgtaatcccagcactctgggaggccaaggcgggcggatcacgaggtcaggagattgaggccatcctggctaacacggtgaaatcccgtcactactaaaaatacaaaaaatttagctagatgtggtggcgggcacctgtagtcccagctactcaggaagctgaggcaggagaatggagtgaacccaggaggcagagcttgcagtgagctgagatcgcaccactgcactccagcctgggcaacagagcgagactccaaaaaaaaaaatctgtatctcttgcttaataacatatgtagcaagaactatatccttattacttagaagaagaaacaaaggttccaaaaagaataaataattaagttcacacagctagtaaatatatcagagctgtcttcatcacttagcggaatccacaatgattatttgtttctgtgacacctactatgaaattagatttaagaaacctttatgagcagaaaggctcctaaccctcacacctgtgtgatactctgctaattctgattatttttaatgtcctgctcccagtttgttttgagttgtgagctatgtgcagaaactcagtatggtcagtctggcactcagatttcttacctgtcttctgctacccctgacaccaaggtgtggcagcttagaccaaatttcctaatccatgattcatacaccttatgagattttgaggatactttgcttatttcggtgttatgtcatatacataatagggtaaggaacatggctgtgctttggtcaatgataggccaaagtatgacatttacgtcttgcgtgactcagagaaaattaaataacaaatcatttaatgtggaaaccagatagaatgtttcaatttgcctgatgctacactttactcagccttcgtttgtccctttttaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaactcttaacactcatacttgaaaactttctgagtttccccagaagagaatatgggattttttttgacatttttgactcatttaataatgctcttgtgtttacctagtatatgtagactttgtcttatgtgtgaaaagtcctaggaaagtggttgatgtttcttatagcaattaaaaattatttttgaactgaaaatacaatgtatttcactaggcttcttatttctgattttcttttttgcagttatttttatcagaaaataaggttttactctttatggcaatggctggtaatcttttctgtaaaataccagatagtaacgatttatggctttgcaggtcatacagtctctgtctgaattactcagctctgcatgtagtgcaaacacagccatagaaaatacataaaccaataggtgtggctatgttccaatcaatttttactttcaataacaggatggcacccataagccatagtttgcagaactctgttttacagaaacattggtcagagttttatatacctgcattgtgttactcacatgtataaaaatcatatggattagactatatatattacaatcttgaaaaaactatgcggttattcaaaataacacagtgagaaaaaagcaaggaagcagctaatgccattaaatccacattaataatcctgtctttcctaattgctttgaggccttttgttaccttgaactacctgtgatccaatcacacggcaaatgcctcctttcacaatagagcatggtgctgccaagcactgtttcttcacttgaactgaaactttatagaagaccaggtgagaacacagaatactagatgaaatgttcatgtagatatgctttatattttcttccaagctccattgctacaaaggtgtaaataaaatacatttttatgagttgaagtaacttcacagtagaaaagaataactctgccattaaaagcaaataatggtttctttgtaaaccaataaagtataagaaaatgaaaaatcagcaaaattaagttacttcctccccagtttggtagtattaatatttagaccatattctggccaggcgctgtggctcacgcctgtaatcccagcactttgggagaccgaggaggacggatcatgaggtcaggagatggagagcatcctggttaacacggtgaaaccctgtctctactaaaaatacaaaaaattagccgggcgttgtggcgggcgcctgtagtcccagctactctggaggctgaggcaggagaatggcgtgaacctaggaggcggagcttgcagtgagccgagatcgcgccactgtactccagcctgggcgacagagcgagactccgtctaaaaaaaaataaaaaattagaccacattccaaaccatctgacttggtttagtacttttctctaacatatgccagaacagaatcaagctctctccagggaggcatgttgctttcccgtccttaggccctccaatggcgtgcaagggtgcaggctatggcgagtgtggccgaacaatcaccaagctcctggatggcatgcttgggtgccagtggcaggtgacctgggcctgctgtcacacttcctgatgttgtgggcacacgcccgcagctacagttgaggcagcatgatccccaggccctgggcaccatgtttgcgtgacgggtggtgtgagagcctgtcctcaggacacagaactgcgtctgggcagaccagctccaggaccatgggaggcacatgcagatgcttggtggccctgcttcgggtggaaagttgagagggttgctgtcggtggcagtggccccgggcaagtggctttcagaaactgaggagtgtgcatttgggctccctttgtcctgggggcagtctccctggtgtggtgcactgcctgttccttactgcaccactggattcagcccacgggacaaagttgcagccctctgggtggaaatgaagagatgtccgcagggctccagggaagtggagatgctggggctgttgggccccagagcaagatacagtctgatgggggctgggctttcaaaatagtgctgcgcggcagctccttgagtcttgggagtgtcagttacctaaagcaatgcaggccgtttgcctgattgcaatggaaagccaaacaaggaagcacaagggttttgtagagggaaaggtttatttttattcaactagg

SEQ ID NO: 14695 - DNA, 101835 bp, Human
  misc_feature (1)...(101835): n = A,T,C or G
ttatgtggggtgttatcctagttcattcaaagtctatcgtttttaggctgatattgtatattcaataccccatctgttataatttcctcttctcccatacacttcttagagaccaaggactttaagcccctagaagggactatgtttactgagtgccttcctcgaatcaagcacattttatgtgcagtgtcagttcttaagacagcttaaatataatgtaattgggaggctgagagcaggagaattgcttgaactcaggaggcggaggttgcagtgagctgagatcccgccactgcactccagcctggcgacagagcgagactccgcctcaaaaaaaaaaaaaatgtaatttttgctgattttatagtacagaaagctgagtaccagataatgtaaacatgcccaagatctctcagctagctgactataccctctttccactatatcctgcagcccttccaggagaaaagtcctctgataagttacaaagcatatgaatgtgaatacgtttaatgtcccagcctcccttactctccttaaaactcagaaaacaaactaatgaatatgtaattgagaaacttcaggtggcacactggggttggtactagcttaggtaaacagccgctcagccttttagacctattcccaacaaaagcttttaattttctaaggatttttccagagctctcgccatacgtttcccacaacagccagaccaaagaccaaaactgtctttccctgagaaatatagagcatgtgaatcactttcttctgttcccagttctgtggcaggcaaacactgattgctcactcatcatgtgctacctgggcaaaacaggaatattaagtaggaagaaaggtttatgttaggtaagagcgtgacttagggctctcctacttttttacaaaatggagacctggcatttgtagcctcccacaatgatgtgccctgacattacttggatatagaaaggtcagtcttaggtgcgtcagtgacagcccaccccgctctgatccagaaatttcagatgacttgcatcagaggataagcctctggcatgttaataatgaaaaaatagagacaatcactgccccagctcatctcaaattagcatcagtgcagcgttagtactttggtagggagctttgctgctaaattcattctctgtaaagaggagaggcagagacagggttaaggggaaaactccaagactggaatcgccaatacaataaactgtcgaactgagttttttctcccgcaaccctaagatactagtaagtccttcctcttagccaacccttttcaccagggcaccgcagttttcttagaaggagggtgctgggtttgtctcaggtctttctattctcctgcccgctgccctagtacatctgaaaagggagcagcgactaggaaaagagacacgtgggtattttcccatcctgtctagtcattccctgaatcatcacaagttatcgcacttttccccttagccagcagcgttcgagactttctctcaaataatacggtcttgtacttaaaaggaagagtggtgggagaagagagaggcggagaagacaagcaagaagggcgtggagtgccgttcccgccccggagtcggaggcgccgggaggccggacgccgcgaagctgctagcccaggaatgtgccgtctaactcgcaggccgcgggcggagcgcggcgggcgcgctgtggtctgcggcgggagcggggcagaggacggctggcgcagggcaggctgcagcggcgggccggacgcgacgccgcgcacctgagcgccgggggcggggcgtcagcggccacgacccttcccaccgcgcgccgcgcccctcgcgcgccgcctcggccttttccgctcgtgcttcggcgccgctcggctcccttcccgcccctggctccctccctccctccctccctccttcttctccctccctcctgtcctgggattgcctggagctccgcaccgcgagtttgccgcggcactttccgcgcggcggaagagcgcgcgccagcttcggcacacctgggagccggatcccagccctacgcctcgtcccctacaagctcctccaaggtaaggcgctcgctcacacccggtcctttccacgctcggcgggacagctgggtccccgcctcctctgcgaaccggctaggagctccgcgcctcgccttgggagtggggttgtagctgacggggacctcggaccggcggtggctagagcgcggagcaggcgatacgacgagccgacaggtggcgggtctagccctagtatctcgaccgccgccggcgcggaccttggtggggatggggcgggcgggccgacttgggggtggggtcagtcctctctcctcccttctaggggcggcgatcgtcggggtccgtactgtaggtgcgtgggagaaactttgcagggtggggacccggcggctgctggccggtagtgactggtgggcgcgctcgaggactccaaggggcgcagcccgggggcagacccttgggtcgggcggggatcttacgcttcccttacccgcccccttttgtctttcacctcagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagaggtgagccgggcgggggccgcagccggaccgggccggggcgggcagctgcctcccggtgtcttcctcctgggagctacccggggcgcagagtttacctcccctggctcgtacttgtcccttcaccgagttaggcaggcagggggtgatggagttttactctgaacaaatgcttcctgggaagttccccaaactcagagtaggacacgtgcttttcaggcttcctggccaggtctcagatccaggatccttttttaccgtggtagaaagacaacttatggctccaggacttgcccacctggacttggctgacttggccacctggacttggctgtttatgcttgatcagttagaaaaattgattaatggtgacgacattctctagggtctcacgtgcccatgtgaagttaccagtttatttctcctttcttaccaatgtttaataacatctgtaaagaaaatgttgccttagcaatatccaagacagctttatcttacagtgagctcaagatgagtatatccaaatgaatacgtgcactattttatatataaatcagctgtttataagttgtgctcctaaacacacagtgtttttctgagtgatacttaggacaatagggatgatttagtaacccacaattctgttcgctaagacgatctctttttgagtactgtgtctgaaaaacatgtggtagggtttttgtttgttttgggttgtttgcagtttggagcattttcgaaacgttacaggtagcagcatcttccattagagtgactggtaaaacatttttactaagtgtataatcacacctccctctaccagaaacaagacaaaacaatctcaaacaagttttgattactttgatagtagctcatggatttgaggaagtggttcaactaccttgtttcacctaaaatagttgcatctttttctcattgactgtttagctttcactttttcttctcctggctttctaattttactcaactttaattgtggtttaagtagaagcatttgcaataagttagggtgtatattaaatatacctaaatttttagtattatgatttccatacctgttaaatcatagtgtgtctttgtaggacgtatttatatgagcgtttcagagatttttatcagccagcaaaactgtcctctgcggtttgctacttgcacaaaagatctgttattcattaaattgctttagaaggaattcgtaagagtggtaatcaaatttctaggtgttttttttttttttttttttagttaaaaatatgaagattaaggggaaattgaagacaaggctttggaaaagctacattcctcaacttgatttttaaaagtagctgatgatccaaataaaagaatttgtcattttcaatcttttcctcattgttcatctgacagcggtcttattttgggaaatatcttggcagatgttaaacttcactttttttctggctgcatgtgctaaaattatttttcaagtactttttttttttttaaacaagggtaatgtttactgggggaagtaagtagagtgtatcttgtgagatcctaagaaacatcttttgttaatacccctgctttgagtaagagaacatagtgctgagaatgtagatgacttcccactacaatggagtctaatactctggaatgtttttcgtttgggtgttggcaactcctaaatttaatcttccctgaaaacaaacaaaccaagggtacctttttttttgtctgtagagtttgaacctttttattgaatagggaattgaggactgctttcttttagtggtaactatgtctctgtccgtttcaagctgcaggacccaacaaaacagtaatgcttcactacagtatctaattaacagacatacttcttgagcgcctcctcctcatattttcttatttttcaaaacaacttatgtatttcagattattttaatagtggtaaaatatatgatgcaaaactttaaagctgagccattttcatgtgtttatattgttgcttttttagaattgtgccatttctcctggtagtttcaacattgagaataccagttgctgtggagtttcttgtgtaatatttaatttagcacccctgttttaaaaagtcatacatattttgcaaatttttcgggtatgaaaataagtaaaaagatgaaaatgaccaatctctttatattcaaaagtagactttattttatctaatgtcgagtaagactcttattttcagacatgattcccaaccaagtctgtattagtagattaacatgtagttcatatgtagagatctggttttaatggtggataaacattaagttccttcaaggaagtacttatgaaacatctgtgtgatacatttattgtgactttcattacctcactttactagttatagagtgtatatataatactgttataaaggtatctgacagcagctaaagataccagaattgactagaagatagttataggcaaggaaccaggtcaaaaaccgaaactagctatttgggaggtaggaaactgggtggttactgcatgtgatggctgaagtcgatctatccagagcttctttaatgagataaaatttactaagagttttaagaaaaatatccttttttctaaatttttacattttctattttttggtagtaattcacctgaactgggtaatttggacgtggcatacttcttgccagtaatttttgtgtgtgtttatcagatcagtcaaatgtgtattacatacctgttaaagacactatccttaagcagtggagaaaataagaacacggcagtgtatattctcaaggagcaaggctataatctaggaagaaggataaggcataattacatgaaaaaatttaagtactgagttaacagtttaaaagccatcttaatgaagcatgtaactatttattggaaatagtgtgtgtttaaaagggggagatgattgggctgggagaagctattgaggatgagaatcttgacctgagtcttaaacttttcagtacttgtatatttttacatatgttctcacatatgtacatgtatacataattgtttgtatagtatattaagtaccgacatgcagtggttcttaacttgagcagcacattgatagcatgttaggatctttaaaaaaatgtttgctcatgctaattcaattccgtgccctctttgtcccttcaccccaccctgtaatattgaatgggtctgggatggatcccaggcattaatatttttataagttccccatttgattcaaatgtgagtcagtgataacaactgttggactgcagtctgggtatagaaatgaataggacataagccttgcccacgaggtgctctcaggtaatataaggaaatgtgaaaagtagagtagtaagtatagcttagtgcctgagcagggtacctaacccagggaggaggagtgatagttgaagaaagcttcctagacagttacatacttgtttccagggggtttgtgaagttactgccattgagtagggttgtgtgaatgggttaatggagatgggtgccatagaaaatgtaatctttgaataggtagaggtggcactgaagttttggtttaagtataaaagttaacatatacagtatttaaaacttctgttttaaaatagtggttggctaaagtggtttagctttagtggttggctaaagtgctttatgtactgaagttcacagcaatctcatgtggtagttacactgtttatcactatttccagaggagaaaatgaagacttagagcttaaatgattcaagatcacatagaaagtaactgatagagcaatattttaaacatttttgtgtattttgtgtgtatgtatatatctagggaaaggggagtttttaaaaattaacctacttttcattattcagcatatttccctagatttttacataactttttattaaagattatcttaagtaatttaaacatctgaatgaggaaaacagtaaaggtatggaattgaatagaatttcaggtcaaatttgtggactcagagattgcctctgaccctctaacctatagagtggcaaaattttgaacaccaggctctcggcaaaacgtaaatttatttttggctagtggtcagaaaatgtgaatctttgattttacctaagtgatatattgtttttctatcaagatggggtcatgacacctactccatagtttgaactcgtgttggtgaaagggaagataaaggagcatttaacatatagaaagcacttttaagtgaacacaggttaggtcataattatttagtatgtttattgaacattatatataggacaagttccacttagtaaactttataaatccaggtggattaagaaatgccttttgttattcccattatgctccagactgtctacctttctgtgtgatgagtcaggagagaaactaataatgactcagagttggagaaaatttgattcgtgaatggggtagatatagtgtaaacactgagactgtttagtgtaaaacctgggctattagcccagctttcctaaatgtttgagctcactggtaaagtaaattgaaattttaatattatcaggatttgtactgagttgtctgagctgggatgtcatttctcataaaaataataattacataattaaagtagatgacatttatggtgtgcttattaagtgccaggcactgttctaagcacttgacatacattagtgcatttaattctcaccacagccctatgggaaaatggggaagagaaggtatgttacttgcttcaggtcatacatgtagtgagaagtagattagagatagtttgcactcacagtcttgtgcgtaataaaccatcttactacacttcagtgtattacatactgtatacctagtttaagaaatacaaagaatattttagtgttaaattgttagtatatgactatggaatttaaaaatagccctatttatagaacatagatgaagtgagactttaatggaaaattttgagaacaaatgaatatataaacactggcattaaaattcttatttaaaatcattatcaagctagtggcctgtttatactattttctttgtttttttctttctttcttttttttttgaggtggagtcttgctctgttgcccaggctggagtacagtggcatgtggtgtgatctcagctcactgcagcctccacctcccgggttcaagcaattctcctgcgtcagtctcccaagtagctgggactgcaggtgtgcaccaccatgcctggctaatttttgtatttttagtagagatggtgtttcgccatgttggccaggctgctctcaaacttccagcctcaagtgatctacccgcctcagcctcccaaagtgcttggattacaggtgggagctaccgtaccaagcctatctatgctatttattatttctgcattttttttttagcacctatgatgtgtgccagaaaataattatgccatttaatagcaaggttgatataatgttttataagtataaaattattggcaaatattagggtttgacattttctctgtgctttttttccttttttaaaaattgagatataattcacatacaataaaatttacccttttaaagtgtacagttcagtggttttttagtattcacacggtgtgctcttaagtgcttttatattttcatctttatttttcattatgttcttagaacctctggtccctaaattttagctttcctttcagtaaagtgatatggtattcaaattatgagaagccattaacttaaaataatttaatatcagcctttcccactttacagagaaaatgaaattatggtaggatctcctcaattttaagtttcttaaaacttgggcacctactaccatttgtttgcagtggagtttagtataataggtatttattaggtttgtgcaaaagtaatcacagtttttgccattgaaagtaatggcaccagcctaatagttggattacttttgcaaaaacctaacaatttaactgagtgtaatactttcaccttaataaaacttttacatatctttcatggagatctgcaaagctctgtcatctaaacatttgggaacattgattcagagttaaaaaaaaaaaaaaaaggagtttccactgcttaccactttagttacagtactagaatcagtgtcctaaaagatgtttctggggggaccatctctaccagtatcacttttgccatttatttaaaatcagatttctggaatccaccccagtctgggttagggatgttatctgagagtctgcattttaacttgagtgattttggtacacactaaagtttgggaagaactaacttaaataccctgtactagtttactgatccgtcaaatgaaatgaatgctggttatctaacaggattgttacatgaattaaataaaatgatgtttgtgaaaatgttataaaaatgcccaaatcagaaattgtagttactgtataggttaatttcctatgaggttgttaaacattttcatttttttcttccaatttaaaactgtgcatattttaacagacaggttgagctacttggaaattcaaagtactttaaacatttatgtaatgtcacatacttagtgcaaaatgctctgtctgctttgcctcttttccagaatttagacaagtctagactacagaaacacctcaaatagttaatgcgtaattagaactttactttcactcatttttaatttttacatatctttaagtgaaagcatatacttgtgtttataaatgtatttgataattagcaactcaaacttttaaagcattgtgtttgccatcttatcaaactactatcaagtgcaaacatttttcccattgattacaaatcttacatgttagacctataggcatccttgactggcaattgattttgaacatatttggttaactgctgagtcaactttctgtttagatcttaggcaaatgtgttatagccatatacctacatgtatagaattgagcctcagccacctgttacattctccttaggctatgtaaaaatacacagggcaccatggctgaacgacattgtaggaatatttaaattctaaaagcagcaaaatcacacacttcaaaggtaaaaagagctccagcaagttcaaatcttagcatgtcagttgactagtaaaatgtttattctgtgatagtttttggagattttgtccagcaaaattttgtgggtcacagtgtatttttcaatgatagtctcatttattttaagtagttgaagaaatagggcagttgtattctgaaaattaatattttgttaggttttgctgaagtgaacagataggagagaatttatattgtggattacaattctgtggcagctgaaactttgttttcaggctcttcataataaattctgtggggccaggtgccatagctcacacctctaatgctaccactttgagaagctaaggtgggagaatcaattgagcccaggaggtcgagcctgcagtgagccgtgactgctcaactgcactacagcctgggtgacaaagtgagaccctggctcagaaaaactcaaacaaaacaaaactctagggggactaagagaataggataaataaacataataatatacagtttgaaatacagaactgaaacagatgaaattaacttaaaaagacatctttcagactaagcttatctatggtcatgtaagcaaactacttaatattttagaatttgcaggttacataaagtatcaattgattttctattattttggagttttttccagaatatttttagtagtatttaaaaagaatgtaaatctcagaacagagttaacattcagaagatggtgcttgaggaataggaataaaaagtacgattgtattagctgaaataatcaaagaagttacttttaggtttcaaattcttgaaagacttctccatatcctataatgtaagcaaaagttgatgcaaatcaaatttatgtaatcctaatttttttctgctagtagaagtaatgtgttaaaaaaaaggcagtgtgttcactgtagttctctcatggaaataaatccaaggaaaggtagaaaaacctgttatcttatacatattaatatttgtgtttctattcttatttttttgaatctacttgagaaatggaaccacactattgatttgtgtgtatacttaaccactcatcatgagtatttttatgatgttattctataacttcaaaaataggggtggatgtgtatgtatcttttgttgtatgttttttagagacagggatcttgcttgttccccaggctgcagtactatggtgtgatgactcagcctcaaactcctgggctcaagtgatcctcttgcctcagcctaccaagcagctgagagtacaggcatgagccaccatgtccagttggatgcatgtgttttgtgctgtttgatattaaaatacttaaccattacttcattgggaaaggaccttactgcttatctgccttattatgtggctttttgattagcccataaatagtcttagataaatagccctttcctttcctttcctcccctcccctcccctccccacccctcccctcccctcccttcttctccttttttctgagacaggatctctgtcacccaggctcagtgcagtggcacgatcatggctcactgcagactcaacctcctgagttcaagagatcctcccacgtgagcctcctgagtagctgggactgcaggcttgcaccaccacattgggctaattttttaatttgtttgtagagatggggtctcagtatgttgctggtcttgaactcctacacgcaaatgcttctctcaccttggcctctcaaagtgttgttgggattacaggtgtgagccactccacctggtctatttttttcttttcatatattgtgtttcctgaaacattgctcaggaaaagtgtttgtgccattgaaagagtctcataggttcagataattgtgaaggatgaccagaggttttttctttttttaaacctctataacctttgatttcactgggaagttggtggttggagctggagtaattataaatgtatgtatgctgtagctgaaataagttcctgaaactcatcatggtatgcaaaattgtgcagtaaaaactgtagggcatatgtgaaaatggagtttggggcataacactcaaaaactttgtcaatggcatttaaaaagatagaaacctaataaaaactagcagtttcacacatgttaaatgcttaataagtacataaatactacaacaaatatgacactttactttgaaaaatacctaaactttttgaaaagtgttagaaggatcccagcttgtgaattactgtaaaatggtaggaggaaggttatctgaaattggagtgagagtgttacaccagatgtggatgggtgtagctcataacgtatgcagtgaactgacgtaactggcagatgtttgaggtgtgtatgcatatatttctacgtgactgggttgcagttatctgtgcctgctgagcatttcttgcatttgaacataagcaaacacaaaattagtgttattctcaacttgttccctaacatgtgttcatatcagtggcattgggacaaatccatgtttttctaaacaaatgttatagtgcgtatatgtctacccatgcatagatatctgtatccccatcaatctgtctaaaatatgtaaaacgttgtaaaaacatagaaaacaatggcttgggaagatcaatccaagtaatgacatagaggaaaggtataggaagcagagaaatgggagtactcatataagagtatactaataatgatcgctagggcaatagtggtagaaaaggaaagaaagaatagatttcagagatatttcattggcattaaaaattacataactggatgttttgagctggaaaagtgtttagagatcatctagcccattacaaaaaacaaaacattaatgtagtctttccagaaagcttttacctcaaaacttaagttgcatttcaacctcaacctttttcctctagctgagtctagcatatcccccactgctcctggccccaccaggctaatactactgccgtatcagggattttattttattacctcttacttaaatactcagcctctacctcctggttcatcttgtcatgcagaaatgttcccttaattttgctttaccttcagcttactgttttttctccataattggtcagtttcttaaaggcaacattttcacctgctgactgttcatttcttactacagtactgaaattcatctctctaaggttgcctgtgaccttttttttgtaccagtgtcaccaaacttgtgacctcttaattgccgaatgtgacagcttctttcattccatttgtcctctctgtagcatttgccctgtcactcctctcatatgctgcagcattttttatagattcttttataagaatctatatgtaaatgtttcttcagaaacatatgaatgcctgttgtgtgccccaggctcagtgctgtgtgatagaaaatattcaccagtctttaaggaacttctaatctttcagggaaagagataaataattagaggttagtataataacaactatgatggagaaaagagcaaagtactgaactagcacagaaaagggggccatgggccgggcacagtggctttcacctgttatctcagcagattgggagacttaggcaggaggattgcttgagcccaggaattttaggctgccgttagctatgataatgccactgcacttcagcctgggtgacagagtgagaccttgtctctaaccaccatcctgtgcctcccacccccgccaaaaaaaaaaaaaaaataccctaaagggagccattaattaaggaagtcaataaaggctttacataacatgaggtggtattatgctttaggtctcagttggtaagaaagattctccaagtgaagaggggaacagggtaacatttcaggtagagcaaatagcacgtgcaaaggcacagaactgggaagtaatagaaataataactttatattgcatgcctgctgtatgtccagaactgcacagaaggctttccatgggttacatctaatcttcacattaactcatgaggtaggtttttatttttatcattttacaagatgaggaagttgagcctcaaagaagttatgacttgcccaaaggccatcctggcagaacttggctttgactccagatctgtttgggtgccagtgcccacacattggttatcattgttggaaataagcaggatatgttctaacagaggaaatggtgatgttcagaaaattcatgatggggagtgaatggagaacagttaaagaggattgatatggaccaattgtgttggattttaatgccatgccaaagaattcagactttattctgctgttcagtattgttgactgggtacttccttcctctgtccatatctgtttatgcaacaactctcacaggttttggaaagaaaacagttttgtctgcctaatttgaaatcattaaaaggattgtcttgttcggaggcagatattcaagagtagtaaacaacacaaaatactgtgaaaataacatatagtagaataaatcaaaatttccatatgcattaaaaagaaactagaggataggatctaaacaaagttgtaccaagtgatttcttttgatgacaaaaataattatataatgaataaatttgagtgtttgggggtagagggcagatggagtggaggtggggaactccagtgatactaaattgctagagtttgattctagtgtaatcatggagaagtttatagcttaacgttatccctgagtttgtactttgccctgcactttaatataaaaccagtttattgcattctgattctctagttcattctgtaatacagatggtaggaatacaggtgcttaaggatgggaattgcctttgaatttttctccatgtattacttgtttaacttctacaagtgttttctccctccatacttccctccttcctggtagtatcttcgaggaactcaagggcatctccaaaccatgttttaggaatagtattcagaaaatttgaaataaaatagcaaatctaggattgtgcaaaaatcagctatagaatattacttataaatttaacaaattttcttccatttttatttttatacattgggattatattctatgtacattcttataacctgcctttaaacttgacattgtcttattatttcattttaagctttttttaaaaggagaaatgttattacttttttttgttgtttcataaacacttttgtttcataatcattttcattggacagtgattctgactatccagtgatactagtactttatatttttggaatacaattatttgaagccacccacaaaataaatgtatttatccagaaatttaatcattctacagatattgttacaacatttttgttatcactatctttacaaacatcacagatgtgttattcttaatgtctacagaatattctctaatttggatgttccggtatagctagcatacatttactaccttgttagtacatgttagacactgcactaggccttttgaacgcttaagttaatacagctgttctgttaccagcactgccaggatttggacaactctgattttgtccttgagtactttataatctaactcagaaaaacaagattatataggacaattcttgaacattaaaaaatgagtataataaaatgttaaatgttaggtcatactcttagtacagatatttgagagattcctggaggattgaatggtccaggtaattttgtgaagggaatgtgagatttgaactgaatcttgaaggactgataagaaatgcacaggtgaagaggagagttctatttcaggctgtgaaagcagagtgggcagtagtacaaagatgagaattagtaacctgattggggtagagggcttatgttaggaaatagtaagtgaaactgagggagcagaatagtgaaggatcttaaaaacaagcccgaaggtttttggtttgatgtatccggctacaggagaacttgagcaggatatgttcatattgtgagagcaaaattttaataagatcaactatcaggctgtagtacacagagcagactagaagaaagagagaatagagataaggagattagttgttgccatactctagttgggaagatactgtgtgtgaaattatagaacactatagcagagaatacagtttattaatgttttcagttttatgactatttaattgactgttagtgtcttcagttggagtacataggggagcttattattatcttgagtcacatgataatttgaaagattgattaaatcagaaattgcttatactacaagctggctcttagaatattttattaattatgggtgaagaaaggtatttgtatttctgaataagcaggccatattaatgtgagattacacttaagtgctttttgagcctggtactattctaagtcctttacatgtattaactcattaaatttttagaacagctctagatgggtcactgctattattattattatttctattttacaggtgaggaaagcaaagcattgagaagttcagatttctgatttgagaaattagttgctaactttgcacttgcctccattcttgattttttttttttcctctgtttccaacttcataatgcgatcagggtcacttctttctcctgtgcttccagcttcacaatggggtcagtgtcaccttttaaatactagcctgagcaaaacaaatatattaagcttgctgttattattttttttctttccaacttttattttagattcagggggtacatttgcagatttgctgcatgggtaaatttcatgtcgtgggggtttggtgtacagataattttgttacccaggtaatcagcatagtacccataatatccttacccttctcccaccctccactgttaagtaggcccagtgactattgtttccttctttgcgtccatgtgtacttaatatttagctccgtcttataactgaaaacatgcagtatttggttttctgttcctgcattaatgtgcttaggataatggcctctagctccatctatattgctgcaaaggacatgaccttgttcttttttatggctgtgtaggattccatggtgtttatgtaccacattttctttatccaatcaactgttgatggggatctgggttgattacttatctttgctattgtgaatagtgctgcgatgaatatatgcatgcttgtgtcttcatggtagaatgatttattttatttttatttttatatttgagagacagagtcttgctttgtcacccaggttggggtgcagtggcgtgatcctagcttactgcaacctccaccttccaggctcaagtgatcctccccacctcagcctcccgagtagctgcgaacacaagtgcggcaccacgcccagctaaaattttttgtatttttagtagagacagggttttgccatgttgcccaggctggtcttgaactcctgagcccaagcgatccacccgccttggcctccaaagtgctgtgattacaggcgtgagccaccgtgcctggccctgtggtagaatgatttctagtcctttgggtatatacccagtaaaaggattgctgggtctggatggtagttctgttttaagttcattgagaaatctccaaactgctttccacagtggctgaactaatttaaattctcaccagcagtgtttgggtgttcccttttctctgcaacctcaccaacatctgtggatttttggctttttaatagtagccattctgactggtgtgagatggtatcttattgtggttttaatttacatttctcaaatgattagtcatattgagcatttttttcatatgcttgttgctacgtgtatgtcatgttttgagaagtgtctgttcatgtcctttgcccgctttttaatgcggtcattttttttttggcttattgatttgcttaaggtccctgtagattctggacattagacttttgtcagatgcataatttgcaaatattttctcccattctgtagattgtctttttactctgttgatagtttattttgctgtgcagaagctctttagtttgattaggtcccacttgtcaatttttgtttttgtttgaattgcttttggagtcttcatcatgaaatctttgccaaggctgatgttcagatgatatttcctaggttttcttctagggttttcatagttgcaggttttacatttaagcctttagtccatttgagttgatttttttttttttatctggtgaaaagaaggggtccaatttcagtcttctgcatatggctagccagttatctcagcactgtttattgaataaggagtcctttctcctttgcttgtttgttggctttgtcaaagatcagatggttgtaggtgtgcagctttatttttggggttctctgacctgctccattggtccatgtgtctgtttttataccaataccatgctcttttagttactgtagccttgtcgtatagtgaagtcgggtattgtgatgcctccagctttgttctttttgcttaggattgtattggctatttgggctctttttttgtttccagatgaattttagaatttttttttctaattctgcaaataatgatattgatagcttgttaggagtagcattaaatctgtaaattgctttgggtagggtggccatcttaacaatactgattcttcctatccatgagcatgggatgtttttccattactttgtgtcatctctgatttctttcagcagtgttttgtaattctcattgtagaaatctttcacctccctggttagcttattcctaggtgttttattctttttgtggttgttgtgaatgggattacattctaagtagaagaatttaaccttgtgaagtgcttatatgaggaataaaaaatgctaccataaagtatattacctatttttagctcttattttaagttctcacaaatctcagacctctgacaagggagtgctgtttggctagtattgggttactgaatttgaaagaggagctcaggctcagctctttgaggagaggcctccaactggctggtaacggagtcactgaggggcacaataaggctggtttcagctgttgctacttgaatgagtgctgctctagtgactaagcaaggctcaggtgaaactgacagaacaggaagcaaacttgaagaacaaatcacttcttccttctccagacttgcaatttccttttctctctttgtattggtagacactagaaagaaatatgattaatttagggccgggcgcggtggctcatgcctgtaatcccagcactttgggaggctgaggcgggcagatcacgaggtcaggagatcaagaccatcctggctaacacggtgaaaccccgtctctactaaaaatacaaaaaattagccaggtgtggtggcaggtgcctgtagtcccagctactcgggaggctgagggaggagaatagcgtgaacctgggaggcggagcttgcagtgagccaagatcacaccactgcactccagcctgggagacagagcaagactccgtctcaaaaaaagaaatatgattaatttgactcacttaataatggttgtggtaattgagaaatttgacatctaacttgatatttgataatattaagtaatcatttttcattattttcgttgtggtagtggtttagtgtgtgctgtagaagaattgttttagagatatatattggtatatttagagaagaaatgcctgggatttgcttccaaataatataggacagatagtggtgggaaagtaatagaaatataaatgaaatttgtacttgttgaaattgcagtaatgaacaaattaggattattttattttctctactgctgtacatgtttgaaatacagaaaaaaattagaatcttttttttttttttggtgatacattcaagttaataaaactgattctcgttgaggggtatggatgtgatctaatacacacaataaacttgatgataagtaccttggagaggataaaacagggagataggctatagagagtagaggctgcaaagtggtggtagcactttagggctggcaaggaaagcctctatatggagcaaggtatttagttgagatccaaactttggaaggagccagttaggtaaaaatcaggggaaggagctggggtaaaaatgttctaggtaggagaatcggaagagattgtggggagaaagaaaacaaaacaaaagttctaggtggagggaacagacattacagaggttttgaggcaggaaacttcaagtattcaacttaaagcaaaagttgggtaggtgagaagagataaagaccaggtcatggtagagtttggagtttaagtgcagttgggagctgcttgttggttgaagcagaggaagtacttgatctaatttttgtttcagaaagatcagtttaggttgtaggtaaagaatgggctctgtgtacgggaaggagagggcagaccactacagcaatacaggagagagtgaccaggtgggaggtaggggccatggagagacgggattgcgtatggaatatgttttagaggtagagctgacagcactttctgtgagaagcagagcaatcaaaatgataattaggttttcctttagagcaattgggtggatgctgatgccattaactaacaatacttttcactgctattcgtgcagtaaaatgatgtcatgcagaagtatagctttttaatatttttatttttagagatagggtcttgctatgttgcccacgctggctttgagctcctgggctcaagtgatcctcttgcctcagcctcccaagtaactaggactacaggtgcacaactgtgcctggctgtgtcctttttgtagaaattatgattgagcctctttataaataatcttaacattttgagtatatgctaggcattgttctaagttcattacatgtataagcttatttaattatcataaaaagttaaatgaactatttgtctttatatccctcgtatcgaggaaactaaacaattaacatggtaaacacatcaacaagctaaagaagaaaaatctcatattaatagatggagaaaaagtatttgacaagatccaatacccattcacagtaaaacttcttggtaaactaggaatagatgggaatggcctcagtttgatgaatatctacaaaaacctatagccatatatttgaatttagagaagctacttctacgctaactacacataagggctatgtttctagtacagaatattgattaaaacctttcctgttttgattaaatctagccacatgattctcctagtgaagggatttaatcttgaaattggtggaatattttagatggtaaattgattagagaaaagagatttcaattatgttgtctagtactttccattttgttgaattaaagtttaaaacaccaccaaacaactttaggctgtagtggaatttaaaattagtatttgaatgtaatgttttctttcctttttttttttttttttttttaagtgctaaggtcttgctttttgcccaggctagactcaaactcctaggcttaagcaattctcctgcctcagcctccagcgtagctgggactagaggttcgtgctactgtgcctggctaatatttttcctttttaagctaggttttccttgacagtctattttagtatccttaatacttagctcagtgcttgacatgtaggattaagaaggtggtctgtcaactagggaaataatgaaaaaaaaaaacccctaaaaaaaaagtggcaaacatattctgatatggaaattatttcatttataaattgtgttttcttctaaggttttgctttaaaatcacaaaatcttgaagtacacttaaaatttgaagttcagcttatgatagccttttttttattgtgaactgaagttttaatatttgatactagagagtatctattgataaattcgtgtagttataagaaaggttcagttacagtgattgctattaccttgatattttgtaaattactccctttgtaacatttgctgtctcaggaattattttttctaatgtcagatggacttttcagaatgaattgaatgagatatttttggcattttgaaacctaatgatttttctatgaagaatttttattcttattcattgcattttttttttccccaagaaaaaatgatgtataatagtgacacataagatagacattctcctggtaaagtatattgctctttggattttattttgatttcagtaacagatttgataatttggttttttaagctttcattacctaattctgtaatctttgaggatacaattcaaccaaccaaccagccttttctataatttagtaactttacttgcatttttctcttggactttgcttatgtactgccaattagttgcttaaaactttttgtcattgttaaaactgtttacatggctttttaaaatgggggaaaaacaatagaaacatgctgtggtgcaacgaatgaatacagtgtgattaacaacttaattttttttcctgtttcaaacatccacctatttttagcattttgtatacccataggttaaaaatatttacatttttcttagaaaagtaacctgtttaagaacaaaaaaggccaagcgtggtggctcacatctgtaattccagtactttgggaggtggaggagggtggattgcttgagctcaggagtttgagaccagcctgggcaacatggcaaaaccccatctctactgaaaatacaaaaattagcccagtatagtggtgcacacctatagtatgtttgaaccgggaggtggaggttgcagtaagccaagattgtgccactgtactccagcctgggtgacagaacaagagactgtcttaaaaaaacaaacccaacaaacaaaaaaaaagaatgaataactgtttattcattatataaataacttatttaacagtttcagtatattttgaaatctttttccatgtatcatttgatttttttctttttttaaagaacacttgagaattactcaactaagtttagattatctagatgtttgttagagttgctttcgttggaggacttgaaaatgaagtatgtataatttaagatggttattagaagaggagtttttttaaatatatttcttagttatttaaggtctgcagatacgaaaatcatatgtcccaaaccaataatcaagatataagataatatggcaagttgaaaagatagaacagtgtatcttgaaatttgcatagtcctgagaatagacatggccctactctgtaatatggcttattccctccatgcagggaaagttctgaggcctctctaattcttaaatctattttgcaaattactttttaagttctattaacatcattgtacaagaaaccctcaatttaatattgttggtcttatatccctaatctttacataatctgcactgtgtggggaatcttctgcatagctcatgccagtaacttttagggctattttttaaatatcaccaagactgaagtcattcaagccaaaatgtgaagactaaaatctttgatgtatctgaacagaaaaagataagtgaaattatttaaaaatgtacttcattcttcctttccctagctttgtttgttttgaactgttttcttcataacagcacacagttggaagtgcatgtgtgtaaatatgtttgtatttgattgggatgagagtatttccttccaataggaataccccaacttgttgtctggattcctctccttatatttgtattctctatacaggggtccccagctcctgggccgtagacccgtactggtccatgacttgttaggaaccaggccacacagcaggaggtgagcagtgggcaagcgagcaaagcttcacctgtatttacagccattccccatcgcttgcattactgcctgggctctgcctcctgacagatgagcggcacccttagattctcataggaacacgaaccctcttttgaactgcgcatgtgagggatgtaggttgtgcactccttatgagaatctaaccaatgtctgatgatctgaggtggaacagtttcatccagaaaccatcctccccattatccccctggtccatggaaaaattgtgtcccatgaaaccagtccctggtgccaaaaaggctgggaaccactggtctataattttccttacttaaccagttgtttttgtttctaatattttagaggtaaagagttcagaagtaagataaaagaagaccaaagacaaactacttcagggctatttcgtgaagcagaaacagcacttcatcaggtggcttttgcgggaggaagcactgttaatgcccttaggcgtaagggtaaatgattcaacttacttaaggaaatacattttcttctaacttgaaacattaaaaacaaaaaatatctacaaacttttactatagaaagatcaaatgtggccagcactttgggaggctgaggtgggcagatcacctgaggtcgggggttctagaccagcctgaccaacatggagaaaccctgtctctactaaaaatacaaaattagccaggcgtggtggcacatgcctgtaatcccaggtactcaagaggctgaggcaagagaatcacttgaacccgggggacagaggttgtggtgagccgagatcgtgcctttgcactccagcctgggcaacaagagcaaaactccgtctcaaaaaaaaaaaaaacaaggaaaaatcaaatgaacaaaaggaaataagatagtattatcaaccctatgtgtgaacatgttaactagcttcagttatttttaatttatggctcatcttactttattgatttcctccaatttttattgttttgaggcaatactggatatcatttcatttgtagatagtatgaatttattaaagataaggactcttatttttaaaagattactccattccactattacatgtaaataataattcattaatatcaaatgtccaatcagtgcccaaaaattttcatgggtatctcatatatgtcttttatattttgtccaaataagatctatacattatagttgcttgcaatgtctcttaacttgtaatctttacattcttcctgtattattttttcacagtttatctgttgaataaagcttgttgtttctcacagtctagattttgctgaatgcatcccccgtggtcttgtttaatgtaatcttgtaaactatttcctataatttggtaaatttagatttaaactagaggtttgatcagatccattcattattattattattattttgacaaggatacattatatgtggtattttgtacttccatccgaaggagtaaaagtctagtcagttctttttctatgtcagcaatcactggtaaattgcctagatcagctgtcaactcaaaatattaatatctgagacaggtgtcagtcaatttagaaaatttattttgccaaggttaaggatgcacctgtgacacagcctctggaggtcctgacaacatgtgcccaaggtggtcggggcacagtttggttttgtacatctagggagacatatgagacatcatgtaagatgtacttggttccatccagaaaggcaggacaacttgaagaggggaaggggcttctaggtcagaggcaggtttgccctaagcagttcccagcttcacttttcccttcagcttagtgattttggggtcccaagatttattttctttcacaccaaacttttcagccttaagatccctttacattcttaaaaattattgagtatcctaaagggtttttgtttatgtgtaaatatcactgtatgtatgagcatttacttttttagaaattaaaaccaagaaattttagaaatgcctgttattaattggaaaaaaagcccactgcatgtttatataaataacatttttgtgagaactattttccaaacaaaaatttagaaaattggtccactgtttaacatttttgtaaatctctttattgttcagctgaaaagaagacatcctgtttctcctatctgcttcatcctttagtttgttgtaatattacatatcatgtaaccgttggaaactttgtgtacactcatgggagaatgaggagagaaaaggcaagtaagattttagcattctaaaaatagtttgaccttgcggatcctctgaaatggtcttggggactcacaggggtgcttggactatgatctattttattattggttgcaaaatggtggtattctaattcattcctttgtaatttattacctggaatattttatatagagaaatttcctttcatcagctgttttagttaccttgagatacaatttgtacaaataagatagcctagatgcttgattcttttcctttaaggagacagaagctttattgcattcattttactatgtgagaaagagatgagaagactacttttaagccccctttgtactaattgaaaccgcctccacttaacaagtgaaggaaggactccactaatacagttggcttcttaaattattaagatgcagtttgtatcttagaggttgcttattttagtactatatcaactaacactatataatctctttaagaaacttgcttgaggagtctaaaaaggattggaagctttcaagttatctgatgatactttcacctatttccttgtgaaaatgcaaagttaacaagataatgtctgcgattagcttaaaatgcttatttattgtgagatatattactattaactccatggaagagaaaaatcaggctctgttacgggatattgagttttgctgcagtttgattttataaaactcaactaatttgcttccagaattgcttcaaaaacttgagcgctcttgaggcaagacagggagttgtaagctgtcataaatgatacaacccagagactaagacttggaatggaatgaagtctggagagaggagatgtatatcagagtagtgtaagtaataggttaattaggcataatgaaatttcagttcttgttcttaaacacaaatgaaaggggaagttcatcttaattccttacttgtatatacttgagatgaaatgtgaagtcagttttcctctatgtaacaatttttattttaattgacttacggaatttttatgatacaatagaaatacgttgagacaagtttattgagccaactatctatacatcttaaaatatttggcagtttaaatagtcatttaatgtgggttagatgtgggaaggatgtgagttgaaggatggaaggaagctggaccaaatagcataatctgtcagcaaaataaatcttttctagttagacttaatctcttgttgtttttggacctgatgaaaattgttttagagattggaacttaatagaatagttatggtttgaagatatctgttttagttatgtatttgtagactataagaaaagtaaatggaactaatttttgtctctataaaattttccttaaaaatcagatttttttgggaatcttctgagtagtaccatcattctatggaaacatatctcagaaattaaatcttcattgttataatctgttttttcatattattggaggtacatagtaaacctcacagttgaaccttaaaatataactattgttgacttttggaaaatggtttagtgaattgctgctcctccttccaagttggaaattgaagagatgttgtgtagttgtaaatgctgaatgcagtgactgaatgttcactacatttttggtttacagcaatagtagatgtattaactatacttgcacaataatcactattttatttttgttcaagtataggccttggaactttaaaaaaaaaaaatagccagacatgatgacgcatatccgtagtcccgagtacttgggaggctgaggcaggaggatcacttgagtccaggagttcaaggctggcctggacaacatagcaagaccactctctctctctcctcccccccccgccaaagagtctactttgtccttaaaataatttgatagcacatttaggaccttatttttaatactaccttttgaaacattgactttctaaaaaacaatgtgtggccccaaacaagataatgacatgggtttaaaaacaaacaaaaatgccctttcagggcatgttacagtaaatataggtttagtataaaaacttggtattaaagtttttggtagttaatgatctggaagcatggcatgatcctaaagttctaaaaattagagaagactctaagtaagatagtaaagaaatgagtgtttaatttactatatattttttttaattgagggagggttttgcagaggtggagtgaaagaagaggatcactccgatcattgtcttttatttccagatctttttgagtaatgaaaatgcacttaaaaaaaagttggggtctagttgcagtctcaacccttgaagtggtggcctctgttgactgtctcgaggatatttactttgtccatcttttaagaaaataatcctttatgaatagtgataaataatcccacatttctcactatgactagttatttttaatgggcaaatttctgtttggaatgtaagatggactattttattataagctatttctcccattggcacattggcaatttcatatttgccaatactcagtacttttcctaaaatgtatatttggcatatactttgtagttggatttatttttgtttattatattataagcacatagcctgattaatcttactcttcagttaactgggatgttagtaaatcactacatgtaataaaacttttcatttatttctcttagaagtttctgtgtcagaagttcacactgtgcttttaaaataaatagggtttttttttttggttttgtttgagacagagtctcactccattgcccaggctggagtatagtggtgcagatcatggctcactgcaatctccacctcccgcactcaagtgattgtcccacctcagcctcccaagtagctgggactacaggtgtgcgccaccacacccagctaattttttgtattttttagtagagctggggttttgccatgttgcccaggctagtcttgagctcctgggctcaagcgatcctcctgcctcagcttcccacggtgtaaaataaaaacaaataagtttttaaactttatttgcctaagaatcacgaagggaactttaatgaatctatgacaggactgatgaatctacatttaaaaaatcttcccaggtaattctgattaaggtgtaaactgtaagtcaaaagtggcacccatttctgtcaggtgtattcctaaacgacagagaagataaagaaatagtcctgaaatgtgtgcatcaacacttaaaaccatagacaagataggagaaggaggcaaagcaccaataaaaatctccatatcccatgtacaaaaccttagaatacagagtaagtaactggtgttctttggccacaccaagggagcaagccttatgctactgaacaccttatgcattcattattttcccattacacaaaaaatgaagttgatgaattttggagtaagatagttacttgttgtgtaaaattaggtaggtggacaggctctcattagtataatggagattgaactgcctatctttaggcttagaattaaataaattaaaagcatttactcaaaatatctgccatgtaagaggttctcattctcaaaggatagctattttttgtttttaatgacaacatgttaccatagaatcattttaattatttccttgtgattaataattagcactttaaaaacagcattttcttgatgtttccttactccatcttcacatgccaagtgctaagagtgcttagtaacccttagaaatctaagaaaaagtagataggctttatgtgattttgttcaagcctttgtgtaaatggactttatgtgatttggtttaaacctttgtgcatttcttagtctggaatccataaagagctgggcttctgcttttttgtctttatgtatgagtgatacttttgccttgtagaaggaagtgagctgaactgaattctaggtcagcttggcagtgtggtccattattgaagtgtctagaactagaatgtgaatggaagtaagagattaataattgcaggatatctagatttcctcatacagtaaatacagtagaaagtcacaggcaaagaactaaaagactggacttttctggagctggatgattctgagcagttacctaacttctttgatccttgattattttgttgttagaatacatcaaagcctattcccagggtggttgttagggttaaacaagatgttatcagtaaaaactgttttttcaaatgtgaactacaaatgatttatattactgtttcctgtcctgaaagttctggatcttttaagcattagtatgcttttttttttttttttttttttgagagatgtctcagtatgttgcccaggctggccttgaacttgtgggttcaagtaaacctcctacctcagcctctgaagtagctgtgaccacaggcacatgccactgtgcttagctaaatgctactatgcgtattgactgagatttttctgtcatttaggtaatatgccctgaatttcaagttgaaatagagctttttgaaaatactatctttgggtatgagaatctttttttatcatttattaaagtggcaacatttaggttattgtttgagatgtttttatttatttttactttttgttacttttccattttaccttctgaatatgattaagcagctgtaaccctactatattataattccctgaactctgtagtctcccctgcttagtgtatggccccagctgatcatattaccatttactgatgacacatagacttttcatagatgcctattgaaataagtgtttgtgaggataaggggaacatggtgtagggagagggctttggtctaatgtatgtaataatgtctttaaaatgaatcaaactttgaagatttcctagttttaatagtttttttaagtgtaaaatgttactaacataaaatttttgagtaagaaaactatcttcttacggcttaaaacattatcttaaatgtaataaattaatttcttaagaaaagagtgacatgtccatgataaaatttcaagtggtgcagacagccattgttgttatttcttaagtatccttctggagatattttctgtttttaccaagaaatatgtgtggatatctccagagattttttctttcaaggttgttaatggcataatggatttgaaatcttttgtttgtaagctaaaagtttaaaatttaagtttctaaggacagattgtagaaatattatggctcaaagtttactaaaatgtaagttcttttttttttttttttttttgagacagagtctcgcttcttcgcccaggctggagtgcaatggcgctatcgtagctcactgcaacctccgcctcccgggttcaagcaattcccctgcctcagcctccccagtagctgggattacaggctaatttttgtatttttgttagagatggggtttcaccctgttggccaggctggtctcgaactcctgacctcaagtgatacacccacctcggcctcccaaagtgctgggattgcaggcgtgagtcattgtgcccagccaaaattgtacgctcttaaggacagatttttttcttagctatatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttttagtagagatggggtttcaccgtgttagccaggatggtgttgatctcctgagtttgtgatccgcctgccttggcctcccaaagtgttgggataacaggcgtgagcctctgtgcccagccagatgtgtgtggttttttttctttttcttttttttttttttttagtgtgctaagaggccaggagcagtggctcatgactgtaatcccagcactttgagaggctgaggtgggtggatcacttgaagtcacgagttcaagaccagcctggccaatgtggtgaaatcccatcactactaaaaatacaaaaattagctgggcatggcgggtgcctgtaatcccagctacccaagaggctgaggcaggagaatcgcttgaatttgggaggtggaggttgcagtgagctgagatcatgccactgcactccagccttacagattcattccaactgaatctgtaaacttaaacaattaaacagctattttattgtattatttattttgaaggatgaatattctcttgaaattttagtgttatataacataaatctgcatttgttttggagattgttcactacatttaatttactgattaaattcttatgtgtactgatgatgtgcatctgtatgtaaacataagtttttattcaaacacaaggcaaaaaaatcttttttctctgcttggttgtccgataagaggaacacaaccccctattactcactaaaaaagaaaaactggaagaatttcaagtatttagtttcttattaaattcagatgggatgatagacctctaagttgaacttttccttatccttaatgggttgtatgcattaataactcttagcttgattctggcctaatttcttttaaagactctttaaggacaattaattattgtttatattgaatataacatattaggagggtgccaatgccaggtgcaaagatctgttggcatctaggattcctgtgtttttcttaactgtcaaatctgaaataaaaattcctctagatttcttagtctttctaggtaaagtgacacaaatttttggatatgagactgctttggtgctctttcttcctgcaccatgatgcccacctcatagtctttcagtcatatgcacattggacattttaaggccttatcttgtttgacattatggatctttcatattttctccttgagaaaaatttttccccctttgcttcaatgacgccatactcctcagatttctcctccaattctttggacattccttcataatctctgttttattacttccttaaatgttggtaccctttatggttctattcgagtcctccttgagaatctttttttttttttgagacggagtctcgctctgtggcccaggctggggtgcagtggcgcgatctcggctcactgcaagctccacctcccgggttcacgccattctcctgcctcagcctcccgagtcgctgggactacatgcgcccgccaccacgcccagctaatttttttgtgtgtttttagtagagacggggtttcaccgtgttagccaagatggtctcggtcttctgaccttgtgatccgcccgcctcagcctcccaaagtgctgggattacgggcgtgagccaccgcgcggcccttcttcagaatctatataggatttctcagcaatctcaacccacccccttaacttagttactatatgtatcctgatagtttttttttttttaaatatattgaagtgtaggtgacctacagtaaactgcatttttttgcagtgtgcaattcaacaagttttggcacatgaaaccaccacactcaaggtattgaatgaacaatccatcacccccacgagtttacccgtgttcctttgtaatcctttccccagcccaaggcaactgttgatctgctttctgttacaatagagtactttgaattttctagaattttatataaatggaagcatacattatggactctttttttccctaaaatctagcttcattgagcacccttgtcttgagattcattcatgttgcctcttctcagctttgtttaggtttattccttcaacctttcggatgactctccccagccttggagtatttcctcatgtgcgtaagatgctgttcaatacttagattacagagagatctctgctgtttttttcctcttcagaactctgacctgaaaactagctaccttggcattcctggactcccatttccatcttttcaattcagggagagtgctggtctctgcccaggttctccctcactaagctgcagtaattttagagctcacctggtttgttttctgtctctcagggtcattgttttgtgctgccttatgtttagtctctgaaaactattattttgtatatttcatctattttttgttgttatttcagggatggtggtaaatctggtcccaattattccaacttggccagaactggatgtcattattgaatttactaatctatatttccagtcaatattttcctcttgagcttgagacctgtgtgctagtctgcctattggacattttctgcttttttctaaatcatcataattttctcctgctaaaccttcctgttcttgtattcctaacttgtgagtagtagcaccatctacctagtttttccaagtcattgccacaaatgttctgaattgacatatgtcttccatatttccccgcctcacccccatgttacgcatccattcaccgtatgttgtcaattttagttctagatattgctcagattcatctacttctctcccattctcattactaccacactagttcaggctaccagtatcaaccagttgaatcactatagtagatcctaattaatttatctgcctctagtctgctctttatcctgcagttagaactagttttcaaaacacaaatctattcatacagttttctgttttctttaggacaagtccaaaatatatttaaggtggtttacagcattcttcgtgttttcgtctttgctccctctgcccgttctgtctcacctctcaaatattctatccttcatattcttggaaggataccttgatacctcagatgtgatatgctttccttcatcttcagatcttgagatttactaccctttgcctgaaggagttctatcccacatttgcttatctctattagatatcactccggaaatctttcttgatcccggatctgggttagataccttctatcagcactctattttaattgcttatttgtctctttcacatattttacactgtataccccacaagggtaggaattttatgtcatatttttgtattgactttgtctaaaacagtttataacacatatgttaatattctgaattggaggcagtaatcatacttgactatagagaaagatgctctgagggcaaaagcttgaagtctttttgacaacctgtttctaaatttacggaccacaagggcagaggctgagttgctccatttcagaatattgttggaaatgtagtatctgaggccttaatacagacttcctgaaatccgaatctgcatttaaaggttgagaaggcatgctctaagtttattggttatcctttttagctacatgttaaaatcacctgggaaactgatgaccagtatttaatcctttggtgtaggtaggtcctgggcactgatattttggtaaaactagtgcctagggaattctaaggagagccaggaataagaacctatgttttagtttgaagtcctctctctttttagtctggaatttgagaaattgtcatttcatatttagattttgagctgctttcacacattctttgtaaagcctaaatgtttggagagtggcggcctggagctaattggggctgtcaggttggcagctgtggtccctaaagaccagtactcctcagactttaatgtgcatacgaatcacctgaggctcttgttaagctgcagattttgtttaaagagactgggatttgtttaaaggcctgacattctattcttaacaagcctccaggcaatgcattagaaaactaaaagagatgctacacctaagcaaatttatactttctcttatttccttaacttttcctatagagtaccacagcaatacctggcagcttagcgagctgaaagaattccttcaattccttgattgttattgaacagaataaagaataaagggcatttaactgctggcaatccccagtacccaagtggtaactccctctggggtggtgatatggtttggctctgtgtccccacccaaatctcatttcgaattgtaatcaccatgtttagagagagggaagtgataggattatgggggtggtttcctccgtgttgttctcgtgatagtgaattctcacgagatctgatggttttataaatggtagttctctacatgctcacactctcctgccaccttttgaagaaggtgcctgcttcgccttcctccatgattgtaagtttcctgaggcctccacagccatgtggaactgtgagtcaattaaacctcttacttataattacccagctattataaactgggcagttctttgtagcagtgtgaaaacggactaatacaggtggtaagtctctacgagaactaggctttatgaacagcttcccatgtgaagaagggaagccagctctcccagagctttggttgtttgatttatgggaaggagcatctcattgcttttggacagggtacaaaaaaaaaagctatcttttgaaccagtgtgttagaaatgatgcaaagctttgtatttatatggaaacacatccctctccattttaaaatttattgatcacatgtactgcctcattgttactatttttagtcactataaccattagattgacaagcccatgtctcccctaactcccccacactttgctggtgctttgaatagtattgtacttaaatcttaaatgcagtcatttaaaatttaatcatttgatgtaaccaaacataaggctaattggtttttccctgtctcttaaggaccatcacttcatttttgttaacctttttatcttcctctctcatgtttacagcagctgttttaacatgttttatgactttaagctgatctgacaatttggctattataggaagattttatatcattcagacacagtagtacctccaactgggcttgatttttctgtgatttacttcagtacaaataaggatgctataaatcagtttgagttcttaggcctcaactaaaagttgcaggattaaatgaattcctgttgtctacagttaaaatagtttgtctaacatttttctaaaaaaagaatttgaatttgaaatacaaataaaatgaggaggtgaattcttaaaaaataagcactgagggcaggtgcagtggctcacgcctgtaatcccagtactttgggaggccgaggcgggcggatcacctgaggttgggagttcgagacaaacctaaccaacatggagaaaccccgtctctactaaaagtacaaaattagcctggcgtggtggcgcatgcctgtaatcccagctactcgggaggctgaggcaggagaatcgcttgaacctgggcagtggaggttgcagtgagctgagatcgtgccattgcactccagcctgggcaacaagagcgaaactctgcctcaaaacaaacaaacaaaacactgcaaacattcactgaaaaatatttaagaaaattgaaattgcagcaatttaaaaacatatcctgctttttagtagaaagctcccattttttaaaagtagatcaggtaagagtttcaaaatgaattgaaacaggattttttgggctgggtgcagtggctcacgcctgtaatcccagtactttgggaagccaaggccggtggatcacctggggtcaggagttcaagaccagcctggccaacatggtgaaaccctgtctctactaaaaatacaaaaattagctgagtgtggtcgtgtaatctaagcaacttggaaggctgaggcaggagaattgctggaacgtgggaggtggaggttgcagtgagctgagatcatgccattgcactccagcccgggcaacaacagcgagactctgtctcaaaaaaacaaacaaacaaataaaaaaacaaacacaaaaacagaatttcttacagttggaatattaatttatttttttaactcaaagtagaaatgtgatttcaaatactttgttgttgtaggcagataaagctatgaccataaatacgtagaaaactatatttttaattgaattgaagttctatattattttattactttactggtgatggagaacataaatgtgaattcatgatacaacattttaaattcagaaaagaactctttgtcaaatactaaatccaattctttgcttataagccaggtttcactccctcacaaattaatttaaatcctcccaggaatgcacagtgtccctgccaaaggttttcacatggtgattgatgaaaagatttgctgaagaatatgcattctttttaaatacattttaggagcagtttaatatagaggttggaaaatgaaataaattcatgatgctccatattttgatcatgttttgtgattgaactttttccaaagaacttttgaaaaagacacattcccttcagaattacaaatctgaagcttcttcacaataaagctttaaaagtgacttgtattgaaagcttttctttaatctgctcacatccgcacatctcaggttgtggtctgtattgcagggtatatttagccaatgagtatctttgtattacttagtaaattaaatattttaattccactaatgctgttgaaaggtttttagggtcagttgtaaacttaattgctttcagcttttctttccttttttattaatgtggtaacatatacgtatataatataaaacttagcatcgaaccattttaagtgtagagttcagtggcattaagtatatttacattgttttgtaaccatcaccattatccatctccagaagtttttcatctttccaaactgaaactacgtatctagtaaacaataactcctaatttcccacccccctctggccaaccaccattctactttgtctatattaatttgactactctaggtactttgtagaagggagatcatacatatttgtcctcttgtgaatggcttatttcctctagcataatgtcttcaaaggtgcatctatgttacagcatgtatcagaatttcctttttaaggctgaatagtattccattatgtgtatctaacacttcattcattggtagcttggtagatactggcttgcttctttttctttcatggcctagatttaaaatactgattgtaccgttgccttctatcggcttacaaatggtttagacatctactacagaagagaccaaggaatttaagcatcgaaattcccacctggccccacccccccagcccccgccatttttttgtgagcccaggatggctttgaactcctaggctcgagcaatcctccccacttagcctccagataattacaggcatgagctaccaggcctggctcatcttctttgatttttcttaatgtcacttgagtcttttgtggcccagactagataggggaatagcctgatcatctggccagatctaaactgaaatacctgatgaggcagctgtatttggagaggctgagctgagatacggaagatgaagatctggtattgaggattcaggcttgtaagggaaagcttcaaatgcaaattatgcaccctaatttttttaaccgattcttttggttataatttactttttttggagattgcatttatttacactgatttgctaggtgtttgtatttcttttctgaattgccttttcatcttggtgtatttttttgttcggtcacttagaataaaaattcaagtgtgaagaaagaaaaataaagtttagaaatgtaaccttttgctttattttagaaatttttatttatgtgattatgcatttcctagatactagttctttctgttcaaggccatttactccagcacccaagtggatttcttgattgcaaatttattactataggatgtatttgtgtagaattatttcttcctattgtactggccttattcacacttctgtgctttaatacaatgaaaaattgttttgacattgaagttctgtattgagtcccacaagatattattcccttaaagcacttgtatggtaacttgcaaattgaacatttgaaatatcaaaatgaaagcacgcagtataaaggtctgcctttgaaggataatggcatgcatgtggggtactgttaaaaagaagattaactacattagcagcaccttgattttagcacagggatcagcaaattagtggttgtaggccaagtccggcccactgcctgtctttgtaagtaccttttttttttttttttttttttaataacctttaagctctgttgaacttgagtaaggaaagttttactggaacacagccacacctgttcatatattgtctgtgaccgatagattttggtctacaacaacagagacctatggtccacaaagcctataatatttactatctgtttttacagagaaaacatttgccaactcctggtttagtagatcaaagatcctttgatgtattttagtaagttttgcccaatatactgagatgtttatatggaatatgaatcctcatgtacagtcctttggcaatatacagatgagtctgaaggtccaatatttgagcatgcacccattggaaataaaaaaccaaaaatttaataactagcagttttgttgataacaaggtacagtgtcaatgtagcgtgtagccttcctttgcagctcagcagatattgcaagaattctaacaaaatttgcttaaaatgtgtcataaaatgaaatgctttaaatatactttaattgtgaagtagccaatacattatagatctaacctcattgttttaaatggttgcacactacattatcttatggatatggaaatttaactcaggggttctcaaaccctgggctgcagaccctaccaggctatacagcaggaggtgagtggctggcaaacattacggcctgagcgccacctcctatcagatcagcagtggcattagattttcttaggagcacaaaccctattgtgaactgtgcatgtgagggatctaggttgcatgctctttatgagaatcttaactaatgactgatgatctgaggtggaacagtttcatcccaaaacctaccccctgctacagcccagtccgtgaaaaaattgtctttcatgaaaccagtccctgttgtcagaaaggttgaggactgctgatttaactatttccttatttatttatttgatactaggtctcaccctgtcaccaggctggagtcccttggcgcaatcatagctcactgcagcctcaaatcctgggctcaaaccatcctcccacctcagcctcccaagcagttgggactacaagtgcacaccactatgcctggctatatttttaaaaattttttatagagacagtgttttgctatgttgcaccgggctggtcttgtactcctggcttcaagcaatccttctgcgtgggcctctcaaggtgctgggattacaagcatgagccactgagactagctctatttccttattgatgggtatttagactctccaactttttaatatgacaatgctataataaatatcctaacatacatgtattgtatgttatatatatccttgacatatatgtttttgtatctagtgacctatggtatattatatataatatatcataaatgtccttaacataaagaaaaagctgccctttgtaatacccaaactagactaacatctgagcctgttgactatttcaattaaatctgacctcttcatatagactcagaaatatggtaaaaaggaaaacatgtttatgatgcttcaaagtattagttcaatccttgagttttctgtgaaggagtaattgagataatatggctgccctttgccctatgtaacaaggagacttttaaaattaagatcgtgattggcttccagttaaggaatcacagtgttcagctagggccagtggtatttaccaactgagtctgtgaaaacattcctttttaccctcagatgctcactcagctttctgttttccaagtgacattattatagcctttagtagtcagagaaattaaaagcacattttaaaagcatgaatagcagagtctccctacagtttcacaaaattactactttttatgatattccaagtgtaggaggatttctgaaaacttagagaagttaattgctaaacgaccttttagggtttttttatttttttttttctagcccctgttagagccatcctgttgcccaggatggagtgcaaaggcatagtcatggctcattgcagcttcgacttcctgggctcaagtgaccctcccacctctgcctccctggtagctgggactacagacatgtgccaccatgcccaactaattttttttttttttttttttttagagacagggtctcattatgttgcccaggttggtcttgaactcttttgctcaagcgatccccccgccttggtctcccaaagcattactgcgctcagtcccttttatgcaaataatacacattatagaagtttaaagcatatatccaaatgtgtgtgtggttgttgttgtttgggttgctcaataacttctgactttgtttaattgaaaagtggaaatgtggccacttaaattttgggtatgactcttcatttaccgaaccagcaatgtaattaagtcttcagctaggataagaggaacattaggaatccatcctgtcaaatttctgggcacagtaccttcttggaatgctaaatgcaccaaatctaatttattgaccatctcttaacctaccagtctgcagtcatctttagtcattttatttactttatggattttataaagattttgaggttaggaatgttagaacaggggtcgccattctgtggtccttggcctgttagaaaccaggccacacagcaggaggtgagccgctggcaagcaagttaacattactgcctgagctctgcctcctgtcagatcagcaggggcattagattctcaaaggagtgtgaaccttatgtgaactgtgcatgtgagagatctaggttgcatgctctttatgagaatctaatggctgatgatctgaggtagaacagtttcatcctgaaaccatccccctgcccctgtcttgtgttccatagcaccagtgcctggtaccaaaaagattggggaccgctgtgttagaaaactatattgggaatttaattttgatacttagttggttatcaaagggatttttgcctttatattatactttttttcatgttcaactttcccttccccagaactggtgctagaagtaaattatctaacttgaatcttagatttttaatctgtaaaaggcagatatgcataaagactacctattttgatgacctaactctgcctagcatgtagtagaagttcaaacaaaatggtagttctgtcagtatagctgctagttatcctcctgtcttatctaattgctttcttgtttcttcatcttgtctattaactgtttttagaactttaaacttgcagtagcttcagtaattaattttacctgatgttgattcctatcttgggaaaatttccctgaaaaagcatgtctgtggtcatcctgtcttatgtcagtgtaaatcccaaaaaacttgcccctaatttcaaaaagttaaactttgtatacaataacatttgtatcaattttttaaagtttccagaatcacatttaaaggaattatagtttaactttaaagtttaactttaccaccaaatttagtaattatctctgcagtagtatgcctgaaagtttagacattcacatactactgccatttctttccttttctttttttttttttttttgaaatggagtcttgctctgtcaccagactggaatgcagtggcatgatcttggctcactgcaacctctgcctcctggtttcaagcgattcttctgcctcagcctcccaagtagctgagactacaggtgtgtgccaccacacccagctaatttttgtattttagtaaagatggggtttcaccatgttggccaggatggtctctatctcttgaccttgtgatcctcccgcctcagcctcccaaagtgctgggattacaggtgtcagccaccgtgcccggccaaaatgcctatgttaatatttatttgatagtttacaaactttgccttgcctaagcaataatatctgtgaaattacaggttctatatactagctatatacatttttaatgtatattaaagtaactacataaaccattttgtttgtgtactacctaattgtattgaattatctatttaccgcttcaggcatctcttaaaagatcatttaacctctgaatataattctctttctccttttttctctttctatataaaacttgaccacaattaagtctttttctttgatagtgagatatgggtttttggtggacaggaaccattataaagatttgttgtatacagtaaatctgataaatatgaacatatggaaatatttattacacttgtttcattttaatatttggagacatgtgttggggaaggggactggaaatgccagtattttgtatgtagactttcactccttatttctcaaatggtttgttctttacctctactcttgactattactgatgtctcagagtcagacatgtctttagttcagtatctacagagaataaaccatctccatgggtgtgggatagttgcctgactgaggtggcatacggggcaggagtgtccttagtactactactacagctttttcttaatcaactgaatttaagattcactaacttcctgcagactttcatcatttctccagctttcccccatcccttccctttgcctttgggagcttctcattgaagcatttaagattttggatttttggattagggatgctcaatcaatgtaatgcaaatattccaaactctgaaaaaaacacaaatccgaaacacttctggtttcaagtatttcagataagggagactgtacctgtgttaatataaaaataattcttttaaaaatggttgaagataatgaggctcaggagatggagggacatgcctaaagttacatggtgacagaacctgattccaaaacacatgttcttaattgtgaatcctgggcattatctactaaaagctgttgcttctttgaattgctataatcaaatcaccgtgagctggcccaatgggccttcagattatacaatgaaacactatagttaggagctaatagctctgaaaatatttttggaaatgttccatataatattaataatgttatcattgatagggtaatgttaccaagatctctattaatttatgagttttagatgtataacactggatgtttttcctaagtactgttaaaggaagatgactttgtacaggcccagatgagaacagaggagcatttctccctggagagagctgcagagaaactggactccttaggccacagctggatttcagttaattagccctcagatatttgtaaatagagtatactagcccttacacagcactaatggcctttgggtaataatacaagctagtcagttaatatttcaccaagtttagtgacagttccagtgtcatttcagtttctacccatatgctgcaaaggtacccaaacttcctctgttcatcacactcttagtgggctaagtaatcttttcatgatgtccttagatctaaagaaataccagatagttttattttcttagtagtttggtccaaacagtataagtatttatgtcctaataacttagtagccatttgaataaataatatatgaattctttgaagaaatatttttacttcattcttaagtaaccaacatttctaatgggatgtgtgcatctcttggacactgtacaacttcttaaaacttggagtccgattagaagctctaccctcatttcctattccacattgatttttgtgtgtgtgtgtgtgtgtgtgtgtgtgtgtggtgggggtggagggagcatgattcttcttttttacattacagagactcagttttgtaaagatgtgatgctatggaaagtataataggatctaattttgaaactggactgttgagttagggttcatcagtattctacagattacctaaaattactttgtttccctcagaaatttaaagtttgtctgaggtgtctgagttcactgcactttgatgtgttgtttggaaactatcttagggttaggacatgtaaatgcaaacctgtttagaatctaagggaattttaaagcctagtttcagtttagacttcaggtaaagttgtattttctttaccttggatttttagttttactttatgtgaaaatgtttttgctaacaaaataaaaaagcaggaagctttctatctttgctcacagatttttttaaaaaagaatcattgacgaaagtttttgtttatttaaaactttctgaagcacagcactctttaccaattatttgataaagggaataggaaaacaactgaggtagagagaaatggaatgtttaccttctagtgtcctatttaaatcttccacttaggtgactggctcaacagtaacgtgttttgaacactgaagagaggtatgtaaatgaatacttcatggttgtaattgttaggcatataatttgatgcaaactatgtaatgagagaggcatatgattatcattctttaaaagacgctgcacaagagcatttttcagtaaatgtcaaagttgagacaaaattaacttgttttatgtagacattttgttttctgtctttcttataaaagtcttgttctgtcctcctgaaatgagatcaagaactttgggtccttttaaaataaagcaaaacccaatgatacgggattttggcaatttaaacaaatctaaaatttcaattacaaagaagagaaaccacataataagcacatttgtactgaaggaatattttcccttctaaacaactgatgtatgttaatgtttgatttgacacatctgaatcaatagtgttattgtcttaccatttgcttcatacgaacttgtgcaaatttatagagcagcatgacacatagcagaccaaaatccatgtttgttcacctagtaattatttagtccaatgtcagtgaaatattttttattttgttaacattctaaccaaacatttacatattattttatttttgctatgtaaaattttgatattccctgacagctgaaaaatagcaggtaagtgtttgagtatctcttttcacatagctgtagcttactttgcttttacttttccctttatagattagagccacgaatataaataaactgcaaatgagctgactattcagtggatgatttctgattaggatttagagtaggttttgtatgtaaatgctgtgttttatgaaggctttttggtggaggaggaacttctgtaaaaatttcttgttgaaacatcagaattagctagtttcaaaaactctgctagtagacattttggcaattttatataggctttgaaatgtctttcaagtgttgtctttgtactttcaaatagcatttaaatgctcattcacggcagggggtacctggacgttttgttgagaagattttcttggtttctacttttaaaagccttgataagaagtttgtgttgtaccttaaatttgttatgtatattttcattacttctttgactattaagtattttggttcatataatctgcagggtgccagactaaagcaaataaaagttaagggtactatataaattggtaaatatctaacttagtttcctccttcctccctaccttcttttctttcctccctctgatatttattaagtagctactatatgccacacacattgaaggtactagtgagtaaaagataaatggtggttcttgttacatagtatagaaaatagggtgcaaaaattgcctgaaagcaagatttgcctttgtaatacgaaatgtgaattgattggtatataagaatatagcaggaaccaaaaataaggacactgtcttaagccttaaacaatttaaaagaattcctattatagtaattaattttagtctcaaatgaagagctggtatggttttgttttttctttgagttgttaatcctaatgtagaaatgactttactgttacctcaacagtagcttgctgttaacagaaacgatgttttgcattccaggttccaagtgttttatttttggttccaataagatcagctattatgttgttaatggactaagttttgtctctctcaaattcatatgttgaaaccctagcccccaatatgaactgtatttggagatttgcagatatgacctctaagtaggtaattgaagttagatgaggccttaagagtgagactataaagccagtatgactggtgttcttactaggagggggagagagagaccaaggatgcacacacacagaaaaaaggccaaatgaagatacaatgagaaagaaaggtgaccatctgcaagccaaggaggcaagaggaaagatcaaacctgccagcagcttgatcttggacttccaacctccagaactgtgagaaaataaaattctgtgatgtaacccacctggtctgtggtattttttaatggcagcaaaagcaaactatttagtaatacatctgacctaatgtaggcatgtgcttgataaaccaatttttcttgttgtcctgaagttctctacaaccatagttcatacctcaatcttgggctggtgtcaagtctttgatttcttccaaatacatagattcccagaaagtataatagctttcaagaaatactaattttcttgtatgtagtcttatctattaagcagccatatattgaagatatctttggtaagtcactataatcattgatttatttatacttttattccctttttatatactagtatattttaaatgataatgtgttacagtttggcagagtttcatttctcagtggcacataaaataatggtatgttttcaatcagtggcatcttagattgaatgaaatacattttttacattatatcccacctctccaggtccccttgtagcatctcaaatatttgtgattcttcaaaacaatcaggaaaggagttattatgtagctttctgtagtaaatcatatgacttttttttttttttttttttttttttttgagacggagtctcgctcggttgccaggctggagtacagtggtgcgatctcggctcactgcaacctccaactccctggtccacgtgattctcctgcctcagcctcccaagaagctgggattacaggaacatgccactacgcccagctaatttttgtatttttagtagagacagggtttcaccatgttggccaggatggtctcgatctcctgatctcgtgatccgcccacctcggcctcccatagtgctgggattacaggcgtgagccaccgcgcctggccaatcatatgactttcttaatcctgttaatattctataaaatatctgctgtattggagagcttgttttatataagtaaaaatagagaataagctaattgtcataaaacagtaaatgtggtctcatagttaagagaataggctcttcggacagaatgtcttgagttcatatcacagctccatcacttgttagctgtgtaactttaagcaaatgtttaactgctttcaaatccataaagtagggataaaaatagtacctatctcatagggttgtgaaggttagaagagttttgctctgaaaagctcttagaacaatggctgtcacgtaggtgctatgtaattgttagctgctattgttattgttcctttgagttaatgaatagtgttttttcttaaacatttaaaaaaaataccaattgcctttctgtataagcaacaaaacctgagaattcaaggtaaaaatagaatttaatcttatctaatgaaagttaaaatgaacctaacatttaatgatgagtgtgttgtatggtaattagataaaattaggattaaatttttagtcctctgttcattttctttagtatgtaaccaccgccaatgtaacagaatatacaatttagttatttcccttaacttcaaactctcagatacacagacacataactcacaagctctcatccaagatccttacgcatcaaactattataggacatagtttctttaatatgtatccctgtgttcccaactaatcagtcttctcctaagtcctttctcttttacatgccagggatatgtgtattcagatttttatttttattttttaaagacagggtcttgctctggcacccaggctggagtgcagtggcatgatcacggctcactgcagcctcatcctggacttccagggcccaagtgatcctcctacctcagcctcccaagtggctgggactacaggcgcacaccaccatacccggctaattttggtattttttatagagacagagttttgtcatgttgcctgggctggtctcaaactcctgagctcaagggatctgcctgccttggcctcccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatatataatacacacacacacacacacacacacacacacaccccaaatataatgatagcatttggacttgatagggaggcaatagatctagagtccctgggtatgaaccctgagtggggctgagggaatgctgtactccagtcggagccattattcatacaacccactgccgttgttgcaattctgtattctgtgtacatagttgaaacaattggctgttatcaaagtagaaaccagtagagtccaacttcactacacaacaaattaaatatgagattagttaagttaaaaatgagatagtaaaaataagaaaatatgtgttgattagatcttggagtgggaaaaactttcttttatagaaccacagggagaaattgcaaaagggaaattaaacagaattaaaaggtaaactagaaaaagacattaacaatatgttggacaaagattaccattcttgttatatactgcttttagaagtactaagaaatgaaattgacagacaacatcagtgaagaaaatgaagatacataaatatataaagccaataaaaatatgacaaaagtttatcctattaattaggattcagtgaaacccctatttgcctaatatatttggtgagagttgaaaaaataagggtgagaccaatcttacacaagctttctggggcaatattggcagtatttttttttttttgaaacccaaaagctgtactctgaagaatgacagtatgtttaaagagccataaaaattagagatacacacaaaaatttacgtgaaaggctatttaacttgtatgtctcatgacacagacaggattgaacaaatcacgttgtattcataagctgatataatactatgcagctactaaaatttttgttacaagagatgatgtaagtacacttcaaaatgggatatccacaactatttgaatttaaaaaagaactagttctcatagaaagatgtttaccacagtgataatagttggttaagattaagaatgatttttcttttttcttttttttaagatgttaatagttttgaaaatttgtacgttttaaatttactcagttcccaagctttctagtttagaggtatgttgtatgtgtgtgagtgttggtgtgtatgtagcagaccgtagcatattaatctatgttcattataacatagattaatacgtttctttctgctatccagttagaagacgtcatttgtttattatgcccagttcttttcacatagagatacttaataatttgaccttatttcaatttatcttttttttttttttttaatgttcaatgttgttgttgttgtttaatcatctcacagtaacttttggcttaggagccagggatggaaggtgaggtaaagctagggcagaggtcgagtgatgacagaatggtatatgctagataaaagaaggactaatggtagatgaaaagggtattaccagagaaggaggcggattaaagaagtggcattactgataggattgacatggtctccctgaagaaaatgagtggaatctattttaatttccctaatacctttcatggttatagtaactcattttggaaagcacaggcacttaatccacacacatggtttgtaattgtgtgatcccaaatagactgccctgcccatcccccttttagggagctctaattctttccccaagaagctttgcaaagattgcttacctgattattttttagatgtagtgggcagtcacagtttttgaactacatttatataatttattgtacataaatgcagttgaacttacttggctgtttaaaatctgtatttcattttagttctattgtagttatttttctcattctgattcgtaatttaaaagttgtcatattttccttattagagccttgttgaggagtgtttatactttgcaaaaatttgttcaaaaattaaaacacctaagaaatttgtgtggattcttaagatgtacatatgttgtgtctacaggcatatttggatagaagaaaatgagataaaatttttttaaggattctgaaaatcgaaggaacaagcattataaggaatgtcagtattatgtaaaggattttacgaacggttgtaaatattttctacttaaaaatgaataaactattgcattcatttgtaagacttactacttatgagaaagagcaaatgggaaagtagagaaaggaatgtgaaacaatatctagttgaattctttcaagaactagatagtagatcacaatttaagctatcaaagtatcaaaactttggcttgagcacttattaaaaattaatttgaacagttcttatgttttatgttgaaatttttaacattgtattttcttgtttagttagtatgcatagttttagataaatagtagctgtgaatgatgattgccttatgtgcttaggtttacccctactgttcaagagttgttattaatataagtaaaagttatactcttctccatatattagaaacatttaaacgtgttaatacagtttttgtttaatagaggcaaatggtatattgattgctttttctgaactgagttttgtggaattctgttttataaaattgataggaaaaagctgccatgagatgaatctttttgttatttagtctatgaacttattaaatttctatattaaaatctttgagctgtagtaatagaaatgttagtagtaggaaactattgcctttaagatttctaagtcaagtttatttccatatttaacatatatatcactgtaaggttagtctttcaaaagcagcatgttttatctcatttgttcaagaaatactatgattggctgattttttttgtatttatgacttcatgtcccaattcctgtttagccacaatgtctttgtaatacagtccagtcagtctagtctctaccaaacaccctagtatttagttcagcaaacatttattgaatatgtgcaacatacaccatgttttgtaataacaggagtgtgaaatactgtggtgatgataatattgtgatggtgcaatctgttgccccaagcaaagtcataaaactatcagaacatagcagtggctttcaaactttttttggacagataaaattatgctttattggtgacacaaatatgaatagttttacagttaatgacattttccaaaatggcaagcaatttttaaaaataagattataaacaacatatttcctggattttcaggatagccgtcttctggaaaaatctttgtatacatttacaaatcctgtacttctcctgctttgtttttataggtaagtggttgggctcagataattataaacttatttttcacctgctggctgactcaacattacattctccagttaaacaaggtgtaggtcttttctttcttaccggaactgtgttttcaaattgcaatgtgggtagcattccaggtttctgctccataaccagtaatatccctcagtcatcaaggtgaccaaaatgcctccacagaatttcataataccttttaggtattatgaaagaatcactgagcccagagcattatggccaaagtagagacttgccccagagacatacttggagaagatactaaccctactaccaggtcccaagctatgaggggaattaaataagttccagttgagacaccacagggagtctttttcagggagccagccaggttttaatctgcatctgacaatagcaagatgttaatcacttgagcaggaattttaggcagtagaatggaataatttggaagggagaggaagaatgcagtattggaacagattaggatatgtgaggttatgtacagagcaatatagtaagtgagaatctgtacagtgatagatgagacttggggaagctgggtctgctgttagtgactgaggtgtaaacttggaaatgagaccttatagaattcctccagatagcctctttaaaattaaaaaaaaattatgtaaaaacgttaacatacagaaaactaccaagccaaatgaatccttatataactgtcatccagcaataataatcatcaacccatagtcactcttttttttttcagctgcaattctcagtaattctgtgttctacaaagtgactcagtatacttacaagtaatctgaaacaaaagtttggaaaagtgctcactgctattgtctattctgttctttttcttaaaaattctgggttgcaatgcagtaaattgatttcataactaacaaatagttacacctggcagttggaaaattgagttcaggttttggagttagactgcttaggttggagttctgactgcactattcaacaaatgtgtccttaagcattaattcttatcttgtcccctcttcctgaatgtacattgtgtgtacctcctaaaatttttgtgagaattatgagatactggattttagtgcttagtagtaccctactttaagtgtcagactgggatctgaatctaggtttccagttctaaaatctgagttcttgtcttgtagttgtgaaatctaacacccactttacagaagattatttttttaaaaaagaaaaaaccaagagataaatgtatccttatcattcatacatatctttatatattaaatttgaagcatttcccaacattattttgaaaactgttttcagataatattctattctccagaggcagaagtgttatggtacagatgaataaaatatgtatttacttatagttatttagtcaaaacataaattttattgcatttttaaactgtatttggggatttcaatcatatacagatgtaaggagaatcatataatgaagtctacctgtactcatcttcagtttcaataattttcaactcatggccagttttgttttatctataccagcacactgcccgtcttacctcttgtcttattttgaagcaaatcctaggtggcatgttatgtcatctttaaatacttcagtatacatctctaaaatatatggatttttttttaaaccagaaggacaatgtcattatctcacttgaaaaagttttaaaaagtagttccttaatctctcaaatatatattcatgttcaaagtgtttcttaaataatttttaaagtagtttctttaaataaggatgcaaatgaggtgagtaccttgttgttggttcttatgttctttgagtttcaaattcatatatctcctttcccttcttttctctttgcaatttataagttgtagaaactgggccatttggtcagcagaggcttgtttttatatgacagagagccaagagtggtttttatagttttaaagggctgtttataaaagaaaaacaacaacaaaaaaacaaacagctgactttatgctgctaaatcctcaccaacaattggtatcgtcagtcttataattttagtcattctggtaggtggttcattatggtttcagcttgcatttccctaatgacatgatgttgagtgtcttttcgtgtgtttatttgacatttctttggtgaaatatctgttcacatttttggtcatttttaattgggttgtttttttaattgtgttctaagagctcattatatgttctggctacaaattcatcaggtgtgtgtttttgcaaatattttcttctagtctgtggcacgcctttttatttccttaactattttttgaatagcaaaagtttttaattttgatagtttttttgttttttgtttgtttgtttgtttgtttttgagacagagtctctctcttttgcctaggctggagtacagtggcacaatctcagctcagtgcaacctccgcctctcggattctcctacctccacctcccaagtaactgagactacagacatgcgccactacgcctggctgattttcatatttttagtagagacagggtttcaccatgttggccaggctggtctcgaactcctggcctcaagtgatccgcccacctcagcctcccaaagtgccgggattacagccatgagccaccgtgtccggctatgatagtacattttgagcttatttttgtaactgatgtgagataaaggactgaagttaactttttccttttagtgggagggtatatatggatatctatttgttacagcaccatttgctgaaaagatcatcctttcccagttgaatcttcatgacatctttgccacaaaataaagggccaggctgggcacatggtatgctgcacgcccataatcccacccctttgtgagcctcannnnnnnnnnnnnnnnnnnngcattccagatagttacagcattacttccaataacacactctttgattactctcactttataagtattggaaatcaagtagtataagttctttaattggttttttttgttgttgttgtatttttttttttttttttttgagacagagtcttgctctgtcacccaggctggagtgcaatggcatgatctcgactcactgcgatttctgcctcccgggttcaagcgattctcctgtctcagcttcccgagtagctgagattacaggtgcacgccaccatgcccagctaattttctgtattttagtagagacggggtttcatcatgttccccaggctggtctcgaactcttgagctcaggcaatccacctgcctgggcctccaaagtgctaggattacaggtgtgagccactgtgcctgtccaacttgatttttctttaaaaatgttttttcagattattttagatcctcttcatttccacttaaattttgaatcagtttgatagtttctacaaaaactgttaggattttgattttaggattgccttgaatttatgtatcaagttgaggagaaattatcttattgacaacattgagtcttcagatcccctaacatagcatatttttccatactgaggtcttttaaatttttcttagcaagatttttatagttgtaatgtaagggtatagtgtgttttttgtattttgtttgtattttaaatggtatttttcttcagtttgaattttcacatttattggttgccattatataaaaatacaattgatttttgtatcttgcgatcttcctaaactcatttgtcagttctggtagtttgtttttaaataagtccttaagatattctatatagaagataatgccatctatgaataaagatattttactttttcctttccaacatgtataccttttctttcttatgcttaccttattgtcctggcttggactggcagtatgatagatactgaatagaagtggtgagagcaaaaatggtgaaagcatcttacctgattcttggtcccaggggaaaagattgatttcttttaccactaaatgtgatgttagatatgggtttttctgatcagattaaggctattctcttctaagtttgctaagaatttttttgtgggttttattggcatgagggtttatgtttgtgtcatgctttttactaatgtattggtgattatatatttttctcctttgtaaagatgatgaatcactgatttgaaggttaaacaaagtgttttactgggatagaccccattttggtcattgtccttttttatatattttgcattttttatgctaaaattttgcaaaggcctttttgtctgtctttaccagattacattggtctgtagttcttattattttagaattttttttttttttttggttttggtaccagagcattgttggcctcaaaataagttgagaagtatttcttccatctagaagaatttgtgaacagatggtatttctttaaaagtttgatagtttaccaaaccatcttggtttgatattttctttactttctttactagatagagagctgttcaggttatatactcctgcttgattgaactttggtagcttcagtctttcacggaatttgtcaattttatcaaagttaccaaatttactggcataagccacacatggtggcccacacctgtaatcccagccctttgggaggccaaggcagatagattgcttgaggccaggagttcaagaccagcctgggcaacatgacgaaaccccgtctcttatactaaaaatacaaaaattagccaagtgcagtggtgctcacctgtagttccagctatttgggaggctgaggcatgagaattgcttgaacccgggaggcagaggttgcagtgagccgagattacaccactgcactccagcctgggtgactgagactgtctcaaaaaaaatatatatatatatattagtggcacaaagtttttcataatttttcttaatcttttaatatcatagaatatcatttatttttacttataatagtgattttctgtcttttttgttcagactgccaagaggtttactaattttatctattacttctaagaacccacttttggtttcattattttttctattttgttttattgtattttgctcttattttcattttcttccatttattttgggtttaatttgccctttttatagctttttaagatgaaagccttgatcattgatttgagacttctttttttctaaaataaatattcattgttataaattttcttctaagctctgcttttaggtggatttcaaattttatgttgtgcttttaaaattcatttgaaaatattttctacttgtgatttcttttttcacgtgattatttgtgaattaatttccatatatttagcagatttttcaggtagctttctgttactgattttaagtttaattgagtagtggtcaaagaacattcttggtatgatttcatcatcttatgtttgcacaaatcctgttttatgttccacaatatgttctgtcttattgaacatacagtgagttttcgaaaaacaaaacaaaacaaaacaaacatatagtttatttttgtggggggagtgttctataaatgttgggtcaaattgacagaattgaagtttttttttttatatctctacacatttcccaccttcatgttgtattaagtactgatagagaagtgttgaaatctccaactgaatttgtggatttgcccatttttattttcagttctttttgtttcatttgatctgaagctcctttatttggtgactacatttttaaaaactgtgtcttctggatgaattgacccctttatcattatgtaatatccctatttattcatgataatattctttattgtgtaatctacttcgataagactgtttcagcttacattagatatgtgttttatgatgcatcttttttcgtcctttcacttggaacctatttgtgtcattctatttaaatgtgtttcttgttgacagcatatatttgggtcttgcttttattattataacttctgcctttcagttgaaatggttagatcatgtgcatttaataattgaagtggtttggtttaaatcttcctgcttgatctttgttttctatttatcctatctgttctctccttttttttctgcctgcatttgtgttgagtattgtttaatcattcaattttatctttagcgttgcctaaaaagctctttgattggcttttaaagcagttgctttagggttaaatatctatatatatgtattatacatctttaacttatcacagtctgcttttatgtaatattataccatgccatgtatagtgtaagaatcttacactggtatacttttatttcctgcctttgtgccattgccatacattttacctttccatgtgttataaatatcacaaaatgtcattatcattttttctttaatcacttacatgttaaggagataccaaaataagaaataacagtttcttatatttattcatgtattgaccattttggatgttcttcattcctttgagtggttccacattttcttgcggtatccttttctttacagagaaacttcatttaacctttttttatactgaaggtctgctgctcagtttttgttatttgtagaagtctttatttttcttttctttttgaaacattttactacatttagaacctttatttgacagatttttctttttagtgcttaaaagttgtcatttcgaagggttttttgtgtctctatttccttcagttctgctctgatcttagttatttcttgccttctgctagcttttgaatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttgagacagagtctcactctgtcgcccaggctggagtgcagtggctgtgatctcggctcactgcaagctctgcctcccgcgttcgcgacattctcctgccttagcctcccgagtagctgggactacaggtgcccaccaccacggccagctaattttttgtatttttagtagaggcggggtttcaccgtgttagccatgttttgtagatctcctgatcttgtgatctgcccgccttggcctcccaaagtgctgggattacaggcgtgagccaccacgcccgggcccctctgttactttttaaattttaatttttaattttttaattcttcctctgttacttttaaaattttctctttattactttgattataatgtgtatatgatttctttttgcttattctttttggacttgttgagcttgcatctgtgtgtttataattttcatcaaatttggataaaattcagctattatttcttcagttgcttttttccccctcatttctctctccttgccttctgagaccccaattatgcatgtgttagactgcttgatactgtctcacaggtcactttaatttatatattcctaatatataaacaactgaaaaataaaagattaacctatagagaaatggaaaactagaggtagacctcaaaagaaatgcaaatgactcttaaccataggaactgctgctaaaattacactgagatactttttttcaattattatattggcaaaaactgcaaaagtatgaaaactattgggagaacaggtaatgtcatactgaaggaaatgtaaaatgatacaatccctattgagtggaatttggaaatacctgccaaattgacatattcatttaccttgtgagccagcaatcctaatactaagaatctatccaggaaatccattgcatatatacagaaactatatatataagcctttctaacacatttttcttagagcgtgtaaaaaacccaaatgttcatcaataaagctctgattaaaatatggtaggtacatctatttaataaaattattatgcagctgaagaaaggaatgaggagaatccacttctcttaagtatggcagatacaggaattctcttatttctcatgatttccgccaacttcttcctccagatgtatttatcccagttagaaaagattgcttaagaatttctaggatgcttgttatcaaaagaactgcactggttgctagcagaattttggagagaagttgtgattcatcaagtaatcctatactaaaagctgcctggaacgttagatacatactgtatccacagggatactatgtgtgatgaataggttcccagttcagtggatagcagtgttgccatgggaaagagcattcagaattttaacttcaggtatcacagttcaccttccagttcatctccaagatgatttgtctcatcttggtaactcattcattgttttatgaaacatttaccgagtgttttgtttcttcctttcttttttcttttaatatactggtaagggagtctagttgagggggcaggaggagggaaagttagtgttgtggggctgggtctcagaaaatgaaaacaaagacaaataaaatagcatcccagtgctctgggagtgcgtggctacctgcctcaacttttgctttctgttaatattaatctatgataatttaagaattccaactttaagctaatgatgttggagcctaggtgagggatttttgagtccatatgctggagaataagtgatgattgctttcacacagtagaagactagagatgagaccattctttattcttttccagatctcatacttttgcttctcctactgttcattaaatgattgacctctcctcccccttttaaagcaactccttgatttaaaatgccttttatgctattttattctttctgttctaggacctctatcaggtatttttgttattgtagttttatacattttaacattaactagagtgtttggtcatacctcttttttaaaaaagtaatttttttgatatcttatgtattttttcttccagatgatgcaccactactttccaaataaatttcttcatgattttgattggaattttaatttatgtgttaagagactgttgacaccttcacaatactagatttttcttaagagcaggttttaatttgtattcttcagtaaagtcttatagcttttttcatgcacgtactgttttttagttttttaatggttgttactaaaaattttgtaactggctattgatgttactttgggaaattttttgcttatttactgaaaaaaatcttaactcataattctaaaatgtttttgttttttacaaaatcatttcctctgatggtaattttgcctcctttctaatgttaaaatcgcctattcttcttacctagttctatcaactagcactttcagaatgatgttaacaattatgttaatagtggacatcaatgtcttgagtctgattttactttaaattttgctggtatgttgtcattaaacaagatattgtctagtgatttgagaaagtttttgaaagtcctgagagagattttttttttctaataaggactaatttcttaacactttggtgtcccataccagatttctttcactgactctgtttccacctatgatatatcatttttcataggatacaattgcctatgtcatttaactagtcacttaactagtcttttcacttttggtcttgttcctgttctctgcattgctatttccaggttcttcccaaaaagaattttgatcattccttatcccaaggaactgtatagcattgtaacatcattccaagctatggagtgagaagtctaaacttcttgggttatctattatttatgttccctctatgcctttcgagtcctcacttttgtcaaaaactgtaatggctttgagatcataccccacttgctggctaacacgttagcttgtgtatgctggcaaaagatactagtctcctgggttagttagagtcaagaacagtttagactcagcaataacagtagctacagtatcataattttcttgtgctgtttccccaagccccactcttggcaggttgatatgacaagggccaggtgacaccaaatctcaacctgcatgctcctttcatttgccctttccatttctgtcctcagacttctctgtatcatcctaatgttgtaagactccatctcagctagaaaccatcattctgagcaaactatcacaaggacagaaaaccaatcactgcatattctcactcgtaggtgggaattgaacaatgagaacacttggacacagggtgaggaacatcacactctgggacctgtcgtggggttgggggagaggggagggatagcgttaggagatacacctaatgtaaatgacgagttaacgggtgcagcacaccaacatggcacatgtatacatgtgtaacaaacctgcacattgtgcacatgtaccctacaacttaaagtataataataataaaaaataataaaaaacactccatctcagacagatgctttcttccatgtcctccattgtagaccttgtctttatcaagcttggtacccctttcagtatgttcctcctatctccaaatattccagtgcaccttcttggtttgcacaatggcttcagtgttttcttctctctgcacaactttttttttttgtccaattcctattgtcttcactgccatactgttatactttgctgtgatcagttccttagtgtctctacaaagaggtgtgtggttttttttgtttttgtttttgtttgtttatttgtttttgtctggagggggtgtgagttctcatgcagaaacctttagggcagtgtattggttaggaatgtattcagttgcaaggaacggataacccagcccatgatgtgtataatggatagagatttgtttctattttgtttttcttatgtagaaagtgtagagttagataatttctagtgttgcttctgttttttagcagccttctcttgtaagctttttcaatatgctgttacatgtgtaattctctttttttatatatctgcaattccaaattgtagccattctttaaattacaagattttttatagtcttttctaactctccaggtaaaaatactcttcctttatatgctcatagaatataaagctagaaactgggcctttatcactaagttatctatctatctatatatatgtattatctttcctactagattataaattccatttctttaatgcatcctttgttaccttctgcagaatgccttgtttaaggtagacgtagtttacttattgaatgaatgataaagaatgaataaacctttcctttaagaaaaccctgtcactgatgtttggagtttagggaaaagatttgttggcagtggtgtggatatggaagtacaagttttaagcagataatttataggaattaaatgtacatattgctgaaagaaaaatacttttattatgcaaactaatttctgaatgcacaaatatttctttaatactatcaatatattttcacatattatcgaaacagtctattaatagtagaaataaaatggaaactctttttttctttcagtgcttagatgagtacgaagatgatgaagcagggcagaaagagcggaaacgagaagatgcaattacacaacagaacactatacagaatgaagctgtaaacttactagatccaggcagttcctatctgctacaggtgagtatttaaaaataccaggaagtcactatctattttaatggcaatttttcaattatgcctcttgagttgtatgtagtaatatatctcccattgcctcctttcctcctacttatgccttccttaccataagtgggttctgacatcacatgttgggctcaccgtaagcatgaacactctcttcacccttttccggcttgtgcatcctttgataggctgttctgtagggcctctgtttgctcctgctgagactcggagaactcatgtcggattgctcctccatggggactcttcctcaacttgattaggttttgacaactccaggccagactgccactccatgtgaacattcacttcatcctgcctgcgctctggcacagaataccccatgccaggctgcctcttggagggtagacattttttaccctgctagagctctatcacccttttctgagccaccctcctgtaaaggtaaacttcacattctacttgggactctggctgcccctttatgggactccctttctgaccttgcctcacaaatgaggccttaccttccctgctttgtagaaatcttcttcattctgctcaggctctgatttcttaggtcaggctgagtgagctgtgctatgtgagcagtctcccttggtttgcttggacttgaattctctatgccaagcagctcttctttatgacaggttctgataccctgatctgagccactgtgttttctcacgttgctctgccctgcctaatggctttaggacttaattattcaggaaaggaaggggaaggatgagtttttccttttaaaatatttgttaatttgataaagctcttatttttcattttcttattttatcagttatatattagagaaattttattctgaagtcatcttcaacaatatatcatactaaattatacatggcaacatagatattttaagttagtcctgagggtcagttagcatgttatgccataattttactgagggctgtggctttgttgctagattatttgaataacatcagtattactttgctgtattcatctgacttgtatttgtctgatcttatttcacctatgctgttatacttgtttatacgttagaagttctgatctgccactgtacctgtaaagactgttttcatggggatttccttattgatctttataagcttgaataaagcagagcgttttatttaaacttacacaaaacagtttgtgctttgccaacattttctcagctctacatagatctttccccttccctttagtaatagaaaccatcccattgcaaggaagattgtttcagaaagagtatatttgaaatcagttgtataacagacttaaggatttgggggagatctaattacgtagtctttgaaacttttaagaccagtaccagtcttaacagttgtactttttacaagccgtttcaatgatactagtatagcagtacccccatatcaaagggagttatgttccaagacctccaatggatgcctgaaatcatagatagtactgaacgctatatatactatgcacatatttgtttttccttccttacaatttcatggatagaagatatgttcttatcataaagcttagcaacttcaggatatgatttttctttctttcgttattaagctgagaattttcacctttttacttaaagcaagcactttacagcttctctttggcatatcagaattgccagcatcactactcttgtacttggggcaattatcaagtaaaagaaaagttaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctgtctcagcctcccaagtagctgggattacaggcacttgcctccaggcccagctaattgttgtatttttagtagagacagggtttcaccacgttggccaggctggtctcccgaccttaggtgatcttcctgcgttggcctcccaaagtgctgggattacaggtgtgagccacccggtgccctgccaaaaaacaagaatcactataaaataacattcagcttcaaaatgtataatctctaataaaagaccatattcaaatccaccaataaggaataaactcgtgtcgtctgtgtgcttcaaaatcttaactattgaaatattagctatatacaagaaataagtatagcttaaattctgattatttgtatgtctcagacatgagcatggaatgactgtaatggcaaacccgcaattacttttcgtaccaacgtagtatgtgggagttctaattttatcaactgtatcaagctagcagtgtggaaaatactgtgtaaaacttactgagttatgttttaagtgactgagtgtttaaaaaaaaaacccaaacaactgtagagaaatgtagaaatctgatatttttacatgacttctggttagcatacttaactcaaaacttgtctgatactgacttttaagtcatttataattgggtcaaagtgtgaaattattgtaatgccactgcaatttagagttgctgaaaatgccctccattttacatttctgtttttgttaaaattctactctatatctctattactctaagttttaccatattacagaaaaagtctatttcaagcctcagaaatagtgtttgttgccaagttattcatacaatttcagttgatataccagtaacccacaaattagtaaatctagtaagggttgctctcatttagcaattttgctgacttcatttcagtaaaaggcaatctgggcaatcaagctgatgtggcatgttctgagatatttcaaatataaccaaaatgagacagatgtgagagaaatgatgtgtgatgttttagaactttattttggagattctggcattttttctcatgcatgtgtagtcagacatcatacgccttagtttagttcatatagggtaatattagggaatttaataaaagaagctctttgtaaaatgttaatgcaaataccgtttgtgaaactaccaggggaaaaacttttttttttttttttttttgagacagggtcttgctctgttgcacaggctggagtatagtagtgtgatctcagctcactgcaacctctgcctcttgagttcaagcagtccacccacttcagcctcccgagtagctgggactacaggcacacgccacttcacccagctaattttgtattttatgtagagataagagtttcaccatgttgcctaggctggttttgacttccagggctcaagtgatccactcccctcagcctcccaaagtgctaggattacaggtatgagccactgcacccagctggaaaaacttctgtatgaatcattatcactcatatttaataaagtatattttgagtgagtatacataagcttaatatttctttcgacattaaataaccatctaaataaataggggatctgttttacgtgtttggtacaaaagtgtagattcgtggatatctgcttaatgacaagcagataagaaactctttaaagtttgcttgccaggttttgttgttgtccttgctgtaagaacagctgatgctcagggatggttaaaatgtctttgtatcacctgtcaaggcatgacttccccagaactaagcgtgtttatggggtcaagcccacatacacagtcgctcaagtatcctgtcacctggttatttcctgcaactggttacttcccaaatggtacttttttgtaactgcagattactaaggaagttatttccctaagttgtcaatatatatttattgcatactaggtgagctggggttttgggggagaaagaaaggaattgctggtggagggttcttatttgtcagacacttacattttacttagaatataagatatatacatgaaaaattgagatacaaataaaactaagtgatataggcttctgtaatgagaatttattgacttggaataattaagacagacttactcaaattccatgcagaaaattcaattaagatttttccatatcccagttagttttctgtttgtgttagctatcaaattgaaattgaaagcctgtttggaagggactgtgctaattttactcacttatgtcattttatctctacaacaacccaataaaataggcactgttattccattttagagatcagtagacactgatagaggttaaacccatagtctcctagtctcctagctacggagtagcctgtctggttggaaacttgatccgatccctcctcttaatcatatggtttgctgtactggttccccacattgctagtcttttatcgcatcatgcagtcagtatttactcttttactctggaactggttatcttataaaggtagcttattcttttaccttaaccagatgagaacttctttaattgtaggatctctcttggcaacttaatgattaattaggaaaaaagttatcaatttttaaagacatcatttgattttgacctgttttattaaagtgaaactgcagaagtatttggagaacctagactgtcaaaagattgaacagagacatgactgcctagttatttgcaaggtaacaatttttctaccccaatggttaatgttaacttttagcaacctttttttttagtagcttagaatcagcacaatattaaaatgtactttttcnnnnnnnnnnnnnnnnnnnntgatgcccccggccttgtccattttctgagtttttaaaatacttctttattaaaaacataattttaaaaaagtgattgatttggactgaaaaatcagatgtagactcctgttttgtttgaccagcagtgtgaattttttaaaacagtaattgcttcaagttggtctttttaaaattaggtattctctatcaactattttatataataagtaattgtgtacatacatactcaaactgatacataattatttttactttgcaggagccacctagaacagtttcaggcagatataaaaggtaagaatccttatgacttaaacatattgtagacatgaatgtaatgtctgtctgacattgacttaactagaactatttaaagcagctttttgaaaagtaagaaacttttctactgtgctcttaaaaataaattatattgtaagcaggagtatcatgtctgcctgaccatggcttattctgacatgccgaagtctttgaaaactcactgtgaatttgcatgggtctgatgaactttgcaaaataaatgccttgaattgctatttctcatgtatttaaacattgaaaatataagtagacccatctgtattagttagctcagagtgccataacaaaatactatagactggtgacttaacagaaattaattttctcacatttctggaggctgcatgtccaccattgtcaggttctggtgaggactctcttcctgccttataggtagccactttctcactgtgtcctcacatggcagagagaaagagggaggaagagggaaagtaagctttctgaggtcccttctttataaaggaactaatcgcatcatgagggtctcatccttgtgacctcatttaaacccaattatctcccaagggctccatctcattaagggttatggcttcaacatatgaattttgggaggacacagatcagtccgttgcaccacctgtacacaatgagtaacacttctaaccagagaatgtgtttgtgtatgtatatgtataggaagaaaatcagaattgggtacaagaagtttttcagtggaggtgtctaggatattcacttccttcttccctgttgaggccataaaggttgcagaagcatgtggtcatacttgcgctaataatcctagaatgataaatattattgagtacttactgtgtccaaattgctttacatagagttctttcaattctcatgattatcttataaggcaggaataatatttatttctcttttatagatgagagacgtgaggttaaataagtagaataatttttctggggttataaacctagtcaacagtaaattctggatttgaactctggcagcctgactctggagcccacatttttattaactatgtaagaccatctgcctagatttatacatgtaaaacacttactttcatctgtatgttggagtttaaaatatttcagctgtttcatctaaaataaaacattcattaaccaatattatataaaaattttaatttttgtcatgggctacagtatttattagcaatagaaagagatgagaaggccaagataatcagaagagtagttaagtctgaagtagtttctggcacatgagaaaacactcaatacatttactactgttaactgcttttattttcatttctgggtaattttgatgtaggtataatgaaacctgctttcgtttgccattaatagtttaaactggaaaaaatcctttttctctttccagaaataattatgaaatagccttgatgtggcctgttcccataccacattctcaaaccaaaaaatttttagcattagtttttggtttggagactaaagataaactgtggcaacttatcaagtttgttgtattgatcttatacatttagttcttatcaagtaatagtcttaaagtacgaatgacacttttcaaatttgtgttctttaattagaatcaagaggggaataattttataaatcctatcaaaagctttatttacatgtcattgtgttaaatcagaaggcaaatttattctctgtgaatttttgtgaaacttttgagaccattacttgtgatatgtccatgtgtttgtacttttcttacttgtattctcatagcctagagcatgtggtttacttttcagctttcaaagatttgcccctgtttaatattgttataaatatcttaaagtttcccatcattttttattggtttggagctccattttaatgccatctaaaaagagaaaaaaagacaaaaacttaaaaagccacaaaacctagaatctgtatatgaaattatctcttatctagtagaaatgtgttatactttatatcaacagtttgttattttcattaatctgtcagcaagttatagcaatgactagagaatagatgtttcttagtgaaggtgtctgctgactaatgggaatgaagaaaagggagaatagagtaaaagatagaaatttggcatcacatgtaagaaaatattttcagtaaacctaataacttattttttatatatatataactgaaaatagaaaatattttcagtaaaccaaataacttccaagaaattatatatattttatataaattatatattatatataaatatatataatatatactgtataagatttatatataaatatctataagttttatatataaatatctataagatttatatataaatatctataagatttatataaatatatatatataaattttatatagctagaaataactctgaaagtcattaggaggttcaaacacccagaagattcatttgaatgtatgctcttataaattatgaattaaatacttaatttttctcacaaataagaatgtacatttttagccttgagtctgttatgtgctcagtctaattatgctgtattttaaaacttgaattgactttcgtggaatgtgtcttacatattcccggttttccttataaaaatgtgtttaactgtagggaactatttggaggtgagggttatgtaatttctgaaactcaagatttagtaaagatggatcagtgttaccaatttgtgggtttttttttttcaatgtgtaattttctttttcttttttttttttttaatttttggtagagacagaatctctctatgttgcccagggtgatctcaaactcaagtgatcctcccaactctgcctcccaaagtactgagattagaggcatgagccactgtgcctggcctcaatgtgtaattttactcctcacctaatgtaacatgagtatcttcaccttttgagttctctaaataatggctagtatcaactgagtgatttctgccttttaaacgaagtgtagcataaatataccagaaatcctcactgtcactgctttggtaacccgtaatttctgtctactttatttgaataaaacatgactatgattctttttcttcagggtcagaattttcttgcaaagtcaattctgctataatgcttgctttcgaaatgcaaattggtcctaattggtacattagggaacagtttgaccctaactcaaattttacctttgcttatatacagttttgttcaccagaaatgctaggtaaatgctgaaaaccttacccagctcaaccaagctgcataggaatacacagaaggttctcaggcattcctggcaaacatctaccaggtacctcagtatgagctacagctttgcttctgaagcagaaaagtttccctggcccctttgcaggcaggaactggagtgcacaggtgctggacctagccaggcactttggtgtggcaggggcaaattccactcactcgaacccactgcattctacccctcgtgggagggggagcacaggtgagcaggtgcaagagccagggtgagcgcttttggaccctggcaggaatgaattctgtactgtccccatggcagtatctagggggatgcccactacccctgaagtcccagaagaagtgttatagttagtgctcttttagctttgccatccatggacggcttaagtgttaaacagttcagtgggtcctctgccttttcttgtgaggcagttgctctctgctagtgagagcagagggtcagtatgacagcctttagcgtttgcacccattcagtgtccaggaaaaatcaggtcacatgaacgaattgaagggtggtgaatatggaggattatattgccaatgaaaggggagctggaaaggggatagagtgggaagataatctttccctggtgcagcattgtcaagccattactctgaagtcaaactgcttctcctcttctcttcctctcctctctgtggtggcagagcctgaggtttttatgggcacaggatggggagcaggacgggccatgggtggttttggaaaaggcaacattcaagcaggaaaacagggatgcatgttctcactttgggccacagttcaaggattgagggtgggaccctcaccaggaccaccctcttctgcccagaattttcctgcctcctgtccctatcacttccatatgtgatgttacaacttccagtctaatttcagatatcttctttctcacatttcgtattaacccacaagctgcaacccttctgctgccaaccagcttctataaggaaacctcactactttttcaagataaaatgctgtatttatttatttcttagctgttgtaacctgtaaaactgtactaccactttatattaggctactgtattttataatgtgtcacagatgaagttttagaacattgtcctccaaccccattttctgtataattgcccccctccttttgtttttttgaggtggagtctcactcctgtcacccaggctggagtgcagtagcatgatcttggctcattgtatcctttacctcctgggctgaagcaacctttacctcctgagctcaagtgattctcctgccacagcctcccaagtagctgggattaaaggcacctgccaccatgcctggctaacttttgtatttttagtagaggtggggttttgccatgttggccagactggtctcaaactcctgatctcaagtagttcacccacctcagcctcccaaagtgctgggattacagtcatgagccaccatgcctggcccaccatgtttttattgagtgatttttgcataacacagtgattttagaaacacttaatattgtattatagcagaactaactctgggtagatggttcagtaaactaaatctttgccattgtttaaatgataagacttctacataacataaatgcatttaatttgagacactgtgaatactttaagccaggggtccccacccctcagggtgtggactgctacctgtctgtggcctgttaggagccagtccacacagcaggaggtgagcagtcagtgagcattactgcctgagctttgcttcctgccagatcagcaacggcattagattctcataggagcgcgcgaaccctattgtgaactgttcatgcgagggacctaggttacatgctcctttatgagaatctaatgcctgatgatctgaggtggaacagtttcatcccgaaaccatcctccctgccatccccctggtccttggaaaaattgtcttctatgaaactgttccctgttgccaaaaaggttggggatggccagttaagaactttagttctcaacctcattctcaagctctttcataagaaaccgactagaaccggttcaagtttagagatgaataatttatttagaaacatagttttcattcaagatttaagatgttgcaacacaacaatgttaactttttttcctagatggaactttatgattttttttttttttttgagtccgagttttgctcttgtcgcccaggctggagtgcattggcacaatcttggctcactgcaacctccgcctcccaggttcaagtgattctcctgcctcaggctcctgagtagctgggattacaggcatgcgcccccatgcccggttaattttgtatttttggtagagacggggtttcaccatgatcattgttttaaccagtagttcttgttttgagaaccaccaagtagacacaaacttccttggtttgttggtcaagggtcaaaaccagaaaaatcagccagattnnnnnnnnnnnnnnnnnnnnnnnnnnnnnnnnnnnnnnnnnnnnnnnnnnnnnngctcaggtgatcctccagctttggcctcccagtggctgtactacaggcatgtgccaccacacccagctaatttttaaattttttgtagagacagggtttttctgtgttgcccagggtgatcctgaactcctaggctaaagagatctgcctgtcttggcctcccaaagtgctggaattacaggtgcgagccattgtacctggccagaaatcagccagattctttaacggtgggaaatccaaactaaagacgaccaaatatatctctcagtagttaaagaaagagagtcttcttgggctatatatgaccctttctaaagaaatctgttcctttcaagatctattctttctttctttttttttaaagacagagtctcactgtgtcacccaggctagagatggggtttcactgtgttggccaggctggtctcaaactcctgacctcaagtgatccatctgcctcagcctcccaaggtgctgggattacaggcgtgagccaccatgcctggcaagatctattatttctatattaggatatgttctatattttacccaatgctgtcaggcatgcaatagcagtgacctttctagttaatagatttgaaaacagtacatgaaagtcataaaatgattatttaaaataaattgggattcttgtacattttgtggactggtgaatttctgaacttttctaggtcataaatattattaatatttatataatattagtgtgtaccaggtactattcaaagtactttccatttagttaattccttgatagtcctagggagatgcttttattattattttacaaatgagtaaactgaggcacagtgaagtttaatgacttgtatgattaaacaagtaataatttgcagattgtgtcagcatatgttgcattacctcatggtagtaatgttaatttgcctagcatgggtaggaaatagatacagtgtggtagtttgattagcttatttaaactccaaatgactggatggtaccagtaactagatttttttcgaacatagggttttattttattttttcccgaaaagtaacttctagatatatggctctagatttcacaaatccactcagatctttactttgttttagctgtagtacaatgtcagaaaataacttgttctgaattatgaagtctaacaacatctagagtttcttcattataatgaaagataaaccatgttatagtatttggtgtcattttaagtgcattttgtgcatttatttggaaattaaccactaatctgatcttactgttccctgttattaagatgtaattcaaatgccataaaaattcactcttttaaggtgtacagttcagcatttttagggcattcacagtgtttactaccatcactgctgtctagttccaaaattgttctaccctgaaggaaacttcataccgttcatatccattcttcctctgcccctaggtcccccagcaaccagtaatatgttttctgtccttatagatttgtctatgttggatatttcagataaatggaatcatatagtatatggctttcttgggtttttttgtttgtttgtttgtttttaggcagagtctcactctgttgcccaggttagtgtgcagtggtgcaatctcggctcactgcaacccccgcgttgtgggttcaagtgattcttgtccctcagcctcccaagcagctgggactacaggtatgcaccaccccacccagccaatttttgtatttttagtagagatagggtttcaccatgttggccaggctgatcttgaaatcctggcctcaagtgatctggctgccttggcctcccaaagtgctgggattacaggcgtgagccactgcacctggccaagcatgtggctttttgtgtctcgtcatttgctaagcataattttttcaagatgattccatattgaagtttgcaggatatactatattatgttttaccatttggagtaacataatgttagattctttacactttttgcctatatgaaatattatacatataataggcaatacgctgtgaacattcatgtacaagtttttgtgtgacccctattcttactacacagaaatttttcatattgcttagttgaaggctttttttttaaaaaaaaaagaatgtatctgtatatacacacattatatgtcaaatattgaatagttcaaaggtgcagggtactatgcctggctgtttaggacacccatgttaagatgataatgaggaatgtataattttagctgtttctactgtatataataaactatatttggagagtgttttctggacttgtctagctctcaggtggtgaaatttgagcagccagatatatttgatctctttaggataattcactatatttaatataccagaaatgaatatgtatgatattccctaactgcaacaacttaaatttttaacgagatagattaaaaactataatatattgctataaacagttataatgcagccattaaaatgatgctatagaaaaataattacataagaaaattattacctgtttatgtaaaatggaggagagaacatattacaaaaaagtatgatacaaaaagtatatataaaatattatctgagaactattcatgtgataaactgccagaattctttgtaaaagaagataatgtttatttttctgggaggagatatatatttttcataagatttttaaaaggaatctgatccagaaggctaaacatttactaatatgttataaaatgttaatggacattatctctgggttagtggaattactggtgacactcatttgtattttctataataaatatgtatcaattttaataaagagttatgagagtttaatataatgggagttgattttgatttttagttgttggtgtatgtgcttatgtgtatgtttgtatttaaaggaagagagataaaccctacacagagcaaggagctgttacgaggagtgggagtgttggagggtgaagagaatggggcagtgaaagatactaaaaggatggaagccagttaagtagttgttggttatttgggaatttcagaatatatcctgtacttctgaatatttgatacttattctaaaagtaggatttacccttgagtcttgtatttcttctcattgctaagctttataatgtctattttagtggaaaattcctctagctataatctcttaatgctgccaatctcattctcatgatagttttagaataatagtgtaattttccccaacacaacaccccctggtgtttctacataagatgcgaaaattcccagagggggaaaacttccagtaaggggtggcatttatctttgatgatactgtttcttttcccttttctgagcattatagttcatgtctttgtagctaagagtggagggaggattctttttggatcgtattagagatttatgttaacattcctaagtaaaatgttaaaaactttttggagttaatgaacaatcttttattctgagtattttgcactgtgcatatctggctttcaaaataggttaaatggctaaatttggcaataagatcaagtaacacaattcttcacaattatgacagtattccctaaaacataatacatattgggaatgaagcactgattttgtttttcactattccttgcatttgcataatgaaggccgggtgtggtggctcatgcctgtaatcccagcactttgggaaggccgaggtgggcggatcacctgaggtcaggagtttgagaccagcctggtcaacatggggaaaccccatctctactaaaaatacaaaaattagccgggcgtggtggcgggcgcctgtaatcccagctacttgggaggcggaggcaggagaatcacttgactgcaggctgaggttgcagtgagccaaaatagtggcattgcactccagcctgggcaacaggagcgaaactctgtctccaaaaaaaaaaaaaaaaaaaaaaaaaatagcataatgatgccgtttatgtattgacaagtctaagatggaaggttttaaaaattgttaataagttaaacttttttgaaatattgttttaaacatgttcatcaagcaaatacacgattactaacggacatccatatttctggatggtttgtttgtagctgtcagcattatagtttctacctaaaaagtcatggatggatgcagaaagttggacttctttttttttgtgaaaaatgggtcctttaaaatgcttctaatggtcttctataatatggtatggctttagtgataccttcctctgttgattttctttttaccactttgctggtatttcccagtcttatttgtagttgtttctttcctgtatctcttcttcatgtattggtattactcaattttttttgtttttgtttctttttacagggtttcaccatgtcacccaggctgagtgcagtggcgtaatcgctcactgcagcctcaacctcttgggctcaagcaatcctcctaccacagcctcccaagtcccaagtgcttgggactccaggaacatgccaccatgcctgactaattttttatttttttaattttatagagacagagtctcattatgttgtccagactggtcttgaactcctggacctaagcagtcctcctgccttggccccccaaagtgctgagattacaggtgagagccactgtgctcagcctactcagctgttaatcttagactttattctcttttcgttttgtgtatttgtggtagaaatttcattcactccgatgacttcacttattatctatacataatgctgatgactccagatccagaagccaggagtttgagaccagcctggtcaacatagtgacacgtctctacaaaaaaaaaaaaaaaaaaattagccaggtatggtggcatatgcctgtagctccatacctgtataatcaacagctattaaatatctgctaagcaaactaaactaagcattttcaaaagtaaacttgtgaaacctgatggatttcagtagttgacatcagcatctacttttgctgaagtcagtagcctggacattatttatgacacttatttttttttcccatcttgcccttatccattcattcaccaagccttgttgagtttatcttctgagtatctcattgccatcacaccaatctaggacaccatcatctcttacataggtgattacaatagcctccacactggcctccctgtctccgtttagctcatctcccaatatattttataaaaatgatactgttactttctctgctttaatggcttaccattacctttaaatggagtctgaatcagtggtctccaaaggggggtgatatataagataatctgctagggtgcaggaggaaaatattggaacttttattcatatttacctttttatttgaaaaacactaaggcattaatatttaaaagctactactgtgtaatagttatttagtcattccttctttgctctatgtgtcagatggtcatttggtactaaaggtgtcctgagggaagcatgctttgttcactttctgcatgttgcacaatactataatttgaatgtccatctatgcggatttatgagttatctagtttaactattacaaaatatgtaagtctgggattagggaatttgtggagaaaatcaagtgtttaactgcaaataagatcacattgttgttcagctggtaagatatacaaaatcaaatctgttctcatgaattaagaaaaattacgctgattttgaggttttaagtgaaactttttaaaaaattctcatttttttgtaaggcatccctttctgctttgatagccattaaaaatcaaatattcaaactgatgttagaactagatctttgaatctctgtatcacacggtgttaagatcttcagaaataatgaagcatattcaatattttatttaaaatatttgtgagaacaaacttttgtaccataaataaaacaaattttagtctttttcttatgctctatttttgggatacagacgattattttatattgtcatattgtaaatcctataaaaatggtagataagtaaacatagataccaacatgggtatgtaattatgaataatatttggagatctttagtttaaattcttccataaaatagctttcagggccaggcgtggtagctcagacttctactccaagcactttgggtggctgacgcaggaagatcgcttgaggccaggacttcaggaccggcctgggcaacatagcaagacctaacttctaaaaaattaagataaattagcgggcatggtcgcacatgtagctactccagaggctgaggggaggattgcttgggcccaggaatttgaatttacagtgagctatgattgtccactgcactccagcctgggccacagagtgagaacctgtctcttaaaaaaaaaaaaaaaaaaaaaaaaaaattcaggtttcctgcttgctttttcagcctcatattttattactcttatgtttacactccatgctttagccatattggagttttctgtttctcaaatgggccacaatttataggtttttgcacattcttgtccttctttttacgtttcaaccttctctaacatagtgatacccaaagtgtagtccttgaactgtttgttgtcaatccaagacaagaaaagaacttgagaataagcatttagaaacttgaattgcattttgacttgtcatcatcacatccaagtgcatgatcagtggattactctgcgaacaggatatagagtagttcaagtgccgtggcaagttgcatgctaatcatgcccagcagggctgttacaatgtgtgatattttgaagttagtcatttgtaacccaaaaatgtgtaagaattaagtaaaatgtggctggcttatgcctgtaatcccaagaccaaggcaggaggatagcttgaagccaggagtttgagaccagcctggtcaacatagtaagacacgtctctacaaaaaaaaaaaaaaaaaaaaaagccaggtatggtggtggcatatgcctgtagtcccagctacttggtaggctaaggtggaaggatcacttgagcctaggagttttgaggtttcaaggctgcagtgagccatggtggcacctctgtacatcagcctgggtgacagtgcaagaccctatctccccccgcccccccaaaaaagcaaagcatttatttttaaaatctcgttaattttaatcacacttcttctcgtcccataaataatttaaaaatatatagtaattttaaaatgtaaaaatctttttcattctttagaattttatgttttacaagtattatttaaatcctggaagcaaaatttgtattatttataagtcagatttactgatgacaaaacaaactttactggacttttttgacaagcaaagatacacttttttgagtgcgatagcagtagtaaaccaaatgatgacaatggaagtaatttcaaagagatacagatcaaaagaatttgtactagttttcttggaaagtattatgtgtcctatgtttagtttttagccataattgatgggcgaagtgctaaaaccaaaaccaaagtgggttgtttggagatacactggctatttaaacaatataaaatgatcaaaatttaattggtagttgcaggcatgacatgtacaaaatgaattcatcaaatatgttcaaaaccaaattcattatttgaaagaatattacaaagatgaccggagcagatgttcaggatttcacatgtgatcactagtatttttggggtttctgatagtctgacttgaggttgctaacattaaaaaaaactgcatacaaatgacaagacaaaacatgtttgcttggaaatgttggatgaatctgtagtaaagaagatagttcacataccactttccagcaacaccatgatagcttgatgtgtttagggacaggacagtgatacgaagactaactctcagacaaataagatcctgcaaaggaatttttgttacaatttgatgaacacattggttttgctaacataggaagtaacaatttatttttcagcttcattgctgacatacagcttgctctgaactatataacacttgcaaagggttacagtatcaacaaatgtggtttggagttttgctttacttttataggaatatattctaattatgcaggcacagtaataagaaaaacatactgaagcttgtaccagaatgtaaatcggtgtcctgcttctttcattgagaaagtcttgctttgccagctgaactaaacagtgttcttgctatatcagctgaattcacagtatagtacactaaaagtgtgaatttattattaaacactaattcattacatttgaggtttctaaaaaattagatactgtagtttgggagttagctgatcagctgttatcagatgctagggtgtacattggtcttcaaactgaccttttcagtcaagagtatttgaattttgggatgaactcttggtgtttttgcaagacaagaaaccagtttggtccccagcttttcaaatatgtgagttagctttttgtctgatggccttattctttattttttaagtgatcttagctttccatgcaaagaaggaatgtcagttggccgggcgcagtggctcatgcctgtaatccctgcactttgggaggccggggcaggtggatcacgaggtcaggagctcaaggccagcctggccaacatggtgaaaccctgtctctactaaaaatacaaaaattagccgggcatggtggcaggcgcctgtaatcccagctactcaggaggctgaggcaggaggatcgcttgaacccaggaggcggaggttgcagtgagccagaaggcttttcaatggcagataagatcaggtgacaaaaatgaaagttggatttttgaggagaaagttaccttagctggttataaagggttctacgatatagtaacaactatcagtaaagtagatggtgatcttggtattgcacatttgaaaaggttacaatcaaataccttacaaatttgataggacacttttattttctatcacaagaaaattcataggtaagaaattcatagatgaggaatcaatttttaaaacgagaagtcactttcgatttaactgtaaatttgctggataaattattggaaatggataccagtcagtgaaggattgaaaacaaattttgaaaagcaaattttctacatttttgacaaaagtttttaaaaatgaatgtccgagcttgttgaaattgcattaaaatcactgctatttctgtcctttgagactgttttctctgattgctattaaaacaaaacacagaaatagtttagatatacattatcccttgttgagtagcattgtcctcggtccaacctagattaacaaatgtagtaactggctttcaagatagcccccagtgaaccctacctcctgatgtttgcactgtgtataatcctctcacacaacataccaagttgatatgtgtgaacaatagaataaggtcagtgtgatagtatgtcacttttgaggttgcgttatgaccgacactgcagcttctgtctcagttgctctgtcagtttgtctctggaagccagctgccatgtggtgaacaggccagtggagaggccaacatagtgaggaactgaggctgttgtcatcagtcatgtgagtgagcctagaagcagattctccagcccagttaagccttcagatgactgaagccccaaccaacatcttgattaaaaactcatgagaagccccgaatcataatcacccacctaagctgcttctaaattcctgaccaacggaaactttgagataagaattgtgtgtaagtttgggggtaatttttaatagaataatacaggaaacaagaagcaaactcatttgttacattaaaaactttaaatactgacatatgtgctgttcagagggtatgaactggtgtttaaggaattgctgttttacttacaacttttgattaagttagaattatggcataacaaaattatcaatatggtagcaattttctgtattgattgcctgtatgcatacttatagtggagaatttgccactgatgtaactcttttctttttttctatttataattttatgggtctgaatctaataaaacatttggacttgtattttgtatgacctttttaacttttatttttccagcagttcattttaattttactttttaaaagtgttggtccatgaaagattgtaattttgaagaaggaaagtggtttttcaccacacatagtctgggcgatctaggccaggcacaatgctcacatctgtaatcctagcactttgggaggccgaggtgggtggatcgcttgagcccaagagtttgagaccagcctgggcaacatggtgaaaccccgtctctgaaaaaagaaatacaaaataatttgcccggtgtggtggccacatacgtgtagtcccagctactcaggaagctgaggtgggaggatctcttgagcccaggaagccgaagccacagtgagctgtgattgcaccactgcactccagtctgggtgacaagagtgagaccccatctcaaaaaaaaaaaaaaaaaagataatctgggagatctgtcctatcgtagttctcatagtatccatcactgaccttattttactgatcatcttgctttattattagttatattcccttttaaccaaaagctctatgaagggcagagtccatgtttgtgtttgctgttacgtcttcagtatccagaacagtgttcgttacttaacacctattcagtagatattggtcgaaagaattaatggtacttttacatttttttcattgtgtgggaataatgattaacttctacagttacaaataagttgctactataaccatatgtccttggggaatgttaatttttttaagctcaatagaaaatattcttggcatttttcttgctgaatactagggattttaataaaatgtttatatttccacagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggtatggattataagttatttaagattgataaaattaatataccattagaattcttttgtttcatagcaactgagtgagaaaggaaataatattccttaatatttaatatgtgcgcttttctgccaactgttacctttagtatattaaaagcccttgtttttgaagtggttagaagtctgagctggcaaatatatactactgtgtatttattatattgtctgaatagattttcatttgtaactttacaaattacaggagtaaatctgagttaggtccatctttggtgtttgaaacaattttgtctaagaatatgcctgtttaaaagtgtctttcagtgcaagtcagatgactcttggcataaatttattaaccatagggtctcaggtttgtgccatagacattcaacccctaaaattagcaatggtgttgaatacttttgtaattgttgaaaatgtgttttgttttacttgagattattctctatattattaaagatctaatttatatatgttatgtaaagaaatttcatttttaaaacttgtttctattttataacatttatgattttttgaggtcacatttctaagctttaacaacagtttcttcttggaattattatttcatagttttatttatttttatttatttatttagttttgagacagagtttcgctcttgttgcctaagctggagtacaatggctcagtatcggctcactgcaacctccacttcccaggttcaagtgtttcttctgcctcagccttccaagtaactgggattacaggcatgcaccaccaagcccggctaattctttttttgtatttttagtagagaaggggtttcaccatgttggtcaggctggtcttgaattcctaacctcaggtgatccacccgcctcggcttcctaaagtgctggaattacaggcgtgagccactgtgcccagcctattatttcataattttaaattaaaaagtttagacaatatgtaatctaatagttttgaagatagttgcccagaaaggcttcgtgagttccacaagagtttggattgaattgctagtagttggcagcagctaagggatatggatggttgattgctctgtaggaggtttagtaagaaagaagccaagttctgggcaaggccttttgagctctgcttcccttttgcccccaaggtggctgaccaagcccagtgccctggattctaaataagatgtctttgaaaaagatgttgcattgtttaaagaaaaaaaaaattaaaaatcagtaatctattttagttccttctttttatccattatcagttaactggcagagccagaagtaaaactgaggaccattgtttttctgtttagagtttctattgggccatctcctttaaactttgtatttttaagaaaaattaattttgaattatttcaaacaagatacccattaaaaaataaggtagttcataacttatagtggtgataagctaaataagttaaatcacaggccgggcacagtggctcacgcttgtaatcccagcactttggtaggctgaggcgggcagatcacttgaggtcaggagttcgagaccagcctgggcaacatggcaaagccccatctgtactaaaaatatgaaaattacccaggcatggtggcatgcacctgtaattccagctacttgggaggctgaggcaggagaatcgcttgaacccaggaggtggaggttgcagtgagccaaggtgccattgcactccagcctgggtgacaagagtgaaacactgccatacatacatacacacacacacacacacacacacacacgaggttaaatcattgagtctattacattagttttgttaaagacttgtataaacatagctttactcaggagcatcctaatatctcctgtgcattctctgattccttttgtggtgggatctttgttccttcaccaaatgtcttaagggattcattggaaatcttcatgtatgtaagatattttaccaaattggggagatatatgccacttaggaagattataaataaacaattacttcctaattactggtttttaattgtatctaccaggaagtagtaagagaaagacaagaaaacctaagacttgtgagactgatgcaagataaagaggaaatgattggaaaactcaaagaagaaattgatttattaaatagagtaagtatttcaccatatttcaggtttggaggggttttttttggcaattggatgaaaatatataaatatgaagaaattattaattgcattattcactttgttcttttgttagtgaaataataattagtaagaggtatcattttcttccaaaaactgatttcctttgggcagttatcagtttagctcacttaattttattcttttggagatagactgatttatggatttgttctctgttttgttaaaatctgagggtgacaggcgctttgtcactaccatatgtaagggcactggcacagagttgcctcaagaaatatctaaaattggccaggcgctgtggctcacacctgtaatctcagcactttgggaggccgaggagggcggatcacgtgaagtcaggagttcgagaccagcctggccaacatggtaaaacccccgactctannnnnnnnnnnnnnnnnnnngatatattctgaaattcccaaataaccaacaactacttaactggcttccatccttttagtatctttcactgccccattctcttcaccctccaacactcccactcctcgtaacagctccttgctctgtgtagggtttatctctcttcctttaaatacaaacatacacataagcacatacaccaacaactaaaaatcaaaatcaactcccattatattaaactctcataactctttattaaaattgatacatatttattatagaaaatacaaatgagtgtcctccacccccccgggttcaagtgattcaaattgattacatcaagatttattattttaaactgcaagaataaatctataaatgtctgcttttttaacagtaaagagtctgtcttgaaataatgtttcttgtaactaaaacttatggtgaatttgttttaaccagatggttgtgtgtttgggacaaggattaatacagggaaaaaagagctggatcatatgcttttaaagctggagagcgaatacttaatttagtggctttgaattaattttagctctaaaacctttccttcaaaatgtcgtagaaaagtccaacatacaaattgatctggagctgaaaacaaaattgatccagatcaagatactccagatccccttttccgtaggcctcagttttgtcacctctccagagtgttatccccattgtacacctttaaagatcagacagtggtaggagtgcatctagaacttgtacctgcaccttttgatgactaatttgacacaaggttgcaacctagggctcaataccatatatggcttgcatgggtagtttttttttttgcctcagttttagggaggggaagtggagtttgtttagctaaaaaactaacttatttatgatgattgaaaattggaagattcacaattttaaaattctgactttcggcttcctttgaaaaactgaaagatctgtaagagttggcctatacacttgttgtaagaacgaagagtcaagtaatggatgctcttttttggtggggcatattacatctaaagttgttttcagagcttgccctcatttcaaaattaattggttgtatgaattatttttaatgtgtattaagtgttttcatctctcctcaaatatttttaagtatttttaaagtgtcttttttttttcttaaggacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttggccaatcatcagaatcacttgaggaacttagaaagaactccctggctgtagctcctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaattattaatacttttaaagactgagctgtttaagaattttttggg

SEQ ID NO: 14696 - DNA, 6414 bp, Human
ttcaacgggctttcactgcaggcattttgtatagtaatttatgcgtatttcatttaatccacccctcattttcccattcctctgatttcttactctagcattttttttgtgtgtgtgtgagatggagtcttgttctgtcacccaggctggagtgcagtggcgtgatttccgctcactgcagcctccacctcctaagggttcaagagattgtcctgtctcaccctaccgagtagctgggattacaggcacgcgccaccatacccagctaatgttttgtatttttagaagatacgggtttcgacatgttggtctccgactcctgacctcaggtgatccgcccgcctcggcctcccaaagtgctgggattacaggagtgagccaccacgcccagcctcatctagttttcatgttttatggtatctctgtaagttgcctcacatccttgcggaaagggactactgtaaataaataacatgaagaaaattatcccttaaattcagtgtgtagatctgttatggcaaatttatgactgcagggtttgattttaatttgttgttgtttccccctccttttttttttttttggaggagtctcactctgtagcccaggctgcagtgcaatggcgccatctcagctcactgcaacctccgcctccagggttctagcgattctcctgcctcagcctcccgcgtagagtggattacaggcgcctgccaccaagcccggctaattttttgttttttcagtagagacgggatttcaccatgttggccaggctggtctcgaattcctgacctcaagtgatccaaccgcctcggcctcccaaagtgctggcgtgagccaccgcgcccagcctgatttgaattttaattcattagcgacgtttaaaaatcccaggatttcacataaaaatccagatttcagacgtcgaaaaaaaatgtaaaatgttatctcccaatgccgcaggcaaacaggatcacagtcctgaatagcaaccgcggtatctagtggttacggttctcacatccattttgctccattttattacctgagaggaccggtattttcaaaacctggtgtatcagtaacttttagggaaaacttttgaaaaaaggactgcacacacgcaccctttcttccttctcgttctttgaaaggaaacaacagaaacgattcattctgcgggcattctgcgctagtcccacggacaggcgactaacaagagataaaaaggtgtgggtcccataggcggtacggtgttaccccttctggttggcgggtaccacgttgccggtcgggatacggacccactgcgactagcactaggagtgctgacccgagctatgcaaagttctgacgagaaggtggaacggtacttaatgaagaggattaaggaatctaaatcggtttcgctaaattagacacatctgtctaagcagccacggtctattcgcagcaggggcgggaagacaaaccaacgccccagctctccgttcaatcacccgcaactcagctctggattagacgcaccctacgaagatacccgggtttccggagcaaccgcccgggccgtccccctttggccccgcctccgagactctttcccgccaaaggccgttatcgccgcagagcatggtgggacaacgctttaggctaggtttcaccaagtgctttgaaggcgccgagttgctttcaaagatcctcattcctggagaaatcgaccatccttcaagacccgacctggatgactagctcctttaacgaaagttcgttatttaacttttaccaaacggctggtcactctgttcgcaaaccaccccaagctgggaacgcgggggacttttttacccccttcgtggggagggtgacgtcgcgcgtgcgtgcgcgtgcgctgaacgtagccctcgcagcacccgttgcgctcccgcgcgtgcgtgttgggatcgaatcgctgtttccttccgcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcggtgaggcggcatggggcttgcagccttgaggaaataggtccgagtagttggggaaggctccaaggccttaacatagagaacggggaagcgggggctcttagagaggttggggcgagactgtatcgcccatgcaggagtcgagtaaggagctgagttgatgtggcttctctggcgcctcgccttggacgtccccggagcccattcgcaggctggagcgggaaactgaggcgctgagggctggtgtagtggttgggagcctggcgtgtttctgggtgggggaggggccattcctattatgcggcgcatgtgggctcttccacgttgggtgcgcatgtgcggggggtttgctggttcccaactgagcgagcttttcctcctggtgtttctcatcccttttactttctgcgatcccgcagagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggtgagtgtactggttgtgtggattgatgtgaagggacgaaaactacctaaaatttttctcttgcgtgacaggtttaataattgcaaatttttcatgctaggtcttaaattgctttagtttttgggtgaatttaataaacgaggattgctgctgtggtgatttaccaaattaggttgcggtactagatacgaagatcgttacaaataattttggactctggattccagaatcttaccagctctctttacctggtatcacttaagtacacctattaagtactttaaagtactctttgtcctaatgtaccttaccagcttaacgtgaaatttaagataattggtactaagaaaaaaaaaatcactttttcaggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgaggtaggttatacacgtattcttttctttgaccagaattggatacagtggtcttaacagtggaatttcaaggtaaggattcaggcaaggttgtccaagtaaattgccagatttctggttttagttacattgtattcattcagcatgtctgaagatagatgaaagcttagatctttcaatggaaagttctgtctatccaatagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagccaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaaaactatgcatggttgtcctttttcctcttcatgtaagattctaactgggtctatcagttaatctttaaattgttaagtaagataagattttgactcttgtgttaatgtgttagcaaattaaaagttcttaaaaggcaatctaatggtattagccatcttttattgttaattgtaaaagtcttcaggggaaagcaaaaggggagaataaggcatttgtgtatgtaacttggtaaatgacggtgggggatggatctagcatctgaaagataagcttctctactttgttataaagtggttaaaaaactatagatgctgcttattttctggtggtcatagacaacataggcttttgtgcaaaattggttgatggctactaatgttcacttggagatagcttttgatattctcaatgaaactcatctcaaaaaaaggtaagtattaaatgttaacatcagcacagatgtattagaactgttttttgtttttgagacagagtctcgctctgttctccagactggagggcagtggtgtgatctaggctcactgcaacctccacccctggatttgagtgattctcgtgcctcagtctcccaagtagctgagactacaagtgtgtgccacccttgcccggctaattttgtatttttag

SEQ ID NO: 14697 - DNA, 6800 bp, Human
atcctcttactcctttcaacaaccctaggaggtgatgtattattattgcctttttatagttgaagaaactgaggttttggtaggttgaacaacttcccaaggtttgacaggcaggaagtggcagaatcagaatttgaacttgatttgtcacacaaatcacctttccatactagcttctgaattccgtccctcgaactctccctatctcctgctaacccctgctcccatagaaaagctcactaggtggaaaatgaacaaattgaccagagctcattaggcccactccgctgcttttagccctcagagggaggggcagctgtgtgacttcagccctctgctccatcatcacaagttgccactgttgtggagccccttggctacccctgctataggaaccgaggaacttggcctacttactttggctagcagctcctggcgggtggcagctgtcaggcctttccggatggtccgcttgtgatcacagacacggaaaggtcgctggggtggtggagctgaggtccagaccctccgtccaaactccgagcttatattagatactgacctggtagttgagaagaaaagtcaagaaggggcgaggaggggcttggtgagtgtaaagggcatgatgagggtagagtggctagagggctagggagggagagatctaggtttatcgattagggatgagggagagaccatggagtgcaggtgggggcgggtggctcaggagcttgacaagcccactgtggagtggggagcaggagaggaaggggtactggttagtctcctaggggctgagtggagtattgttgccctgcctatatcccctaaaggtggagggtagagcggagggttagcagtcacctgagtaagtcactggggttcagagctgagaggtactccatggtggaccggagagttccttccctggaacttctgggctgggtggttctctcctgtgctggggctttagtggtgttttctgttacaaacctgggatctcagcccaggacaaggtgggaatgagtcaagcctggactctggcccccctgcctggccagtaagaagggcaaagtccaaggggagggatgagggaggggccagatggggtcctggaggaagaattgcctggcaaaagccattggagcttgtatgtgtgtctttggtgatgacatgtgttgtgagggtagatgggaaccatgtaaaaggatgaaatgtgacttctggtgtttttttatttctatggagggactttctggggacggtttctggctctcaggctctgagaagctgcagtttatgagtggctctgtgtgtgctgccacctactggagaagccataagctgcagctttaggaaaagggaacccggggcagagtgtggggaagtgggatggcagcatggcagggctttggaaaatgagaggtgagagtgtgtccaggaagggtgtaaggagaggatggatcctgatacatggattcaggatcattagggtcctgtctgggacactggccttcctgcttacctgctctttccttcctccttggtcggaggaggggctggctcactgctctggcttcattttccagagctgcctgctgcagtcacacttaggtcatcttctctcacttttctccttttgccgattagtggacgtgacagagatgtgaatggggcagggatgtcctttgatggcatcaagactttagcttctggtgcgctgtgtcccagctctgatttcagttgcagccgtgatggacagttgcatggaagctgagactctcactgacagtgaaaccctcaaatgaacacaatccctgctttcctgccaaggatccttgtagggtcccccagcttccccactttttttctgtgtcctgacaaagaaacacagagtaacttgattgccctgtgacctggccagttgcatttcccctgcaggcttgagcccaagccagagccttgaaaaggtattcaggttgttgcccaaaacactgaaaaaaactggccctggccctgaaccaaataccttgaaccctcgtaaactccataccctgacccccttgttttggatatacccaggtagaacaactctctctcactgtctgttgtgaggatacgctgtagcccactcattaagtacattctcctaataaatgctttggactgatcaccctgccagtcttttgtcttgggcaatctatacttttctcagaggttcccaaggcctactgaagggacttaacatactcttaatggctttcctctctcttgttttaccttatgccctcacttcctgagttaacctcccaaatacaggatcacctgtacccaagcccttagctcaagaatacaggatcacctgtacccaagcccttagctcaagctctgctttggaagaacccaaactaagacagtgctcctggtgccctccccaagcaacctcaagttctggctgttacttgagcagaggcctttcttttcccttcccccagctctatccatctgccaggcccccctcaaatctcttcatttccaagttttgcttgacttttccaagaggagagggctgcttcttagtatgtccctactcatcctttcctttcttgtcttgtatcctggtgcagcctggtaatggggcctcttcatggttgtgtgtcatgactccctaaccattatgcctccatgcatcccctgttcctcctggaacctagcaccatgccttacatggaaaagctgtcattgacagcccggtgagagccctgagggtggagtgactggggcagggcctgaggcaagaggtgggaggaggtaggaggccaggggctcagccggaccaggagactggaaacaggcaaggataaggcaggtgggggactgagttgtttgggtcacctctgcaggccagagagaccaggcaacatacacactgcagaaggtgggctgggaggattggggccagagctgggggagggatgagaacagaagcaggaccaggattcagcagagtcctcctatttccttccaccaccagggaatcttactgccccacttcagcttgtgctgtttcctggcaaggcaggctctcacatgcctggacgcctgggtgcgttggtgatgggaaggagcagggtgagggaggggccccaggagaggcccaggatgagcctcatcttgtccctccccattcttgtcttaccctctgcaaatgtgataggcacaggacaggagtaggcacctcgcctactgctgcttaacctttcagcttctccaggcccccaatcctgcttgctcccagcttggtaagtagatctgtgcacgtccctttacaccccaccatccagttttgcccagatgtgctagaatggggctggacaaagaaggaggggccagactagaggagtggtggtagagatagtgacagcctggggtgaggactttatgcctgtttaccactgagctctgggaaggaggccaggagtggggcaggtcaactgactgggagcaggggatctgggttccaagaaggagttgtgtttgaggtggggtctgggtcctcgtggaagtcaggactcccaggcagaaaagaggcaggctgcagggaagtaaggaggaggcatggcaccttctcatcgggcatcacaggtggggttttgccccacccctgaacgccctctgtggcgccttccacccacctgtaggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttgacagcagaccctacaacctgctgcccttccctgtccctttccaccccccacccaccctccagaggtcagtgttctgggacatttggggacccttctttgactagagtttggatctggctgggtaggattactatacacttggggcaggcccaggctcctccaaactgagggattatgagggtggtgatggtccctgttaaggactattgtgtgcttgcaagttggcatgtacccatgtgccagcattgcttacttgttgccaatagctgttattgtgaaatacactgggaagccattagatgatgacttaagtgtgcttcccctggtggttcttcatgcctgagttgtactgaagccacctagttccctgctgggtcaagccaggctgggcagtgccagccttcagtggcatcttgacctgccctcctcagcccaggtgccctggttccacaggccaacccatagaaccactctggaaataaaggagaaaatggaaggagaggtatgggagcttggatgaggggtaggaatgggatccattctctgaggcttataaaagcctctgaggaggaaatggctctgaaggggaaaatgaatctgtggggtttgaaaaggaagttttcctgcctgtcttgtatttggtccagtgagtatgagacaggcacacaaggagtggacagtggtgtaggggccctgggagtctgagacttaccttgccccctgaccatctgatcctccctgcaaaggccacctgacgtgaaaaggagccaggagcaagcactcagtcagggaagtttggaggttggccattggggtatgaggaatggcaggaatatttagaggacaggaataatttttcagagaagtgccacatattctttttctctttgccaagtctgggctccttctaagatgctgctagctattcctagcccgttccccaatacttctctgcccccaccttttggaatccttatctaggtctaaaaacggttctagatcctgacccctttgattgggggatgtagaatgggattcttttcaggggacatccacaagtacacatctgtggtcactaaggtgaccagctcatcccagttggcctggaactttcccagtttaagcactgaaaactccttgtcccagccctgccggtttcccaacaaactgagatggttggccgctcaagtggctaccctgaccatcaccccaggctctactttagcgactgctcacacctccctgcttcccagacagaagtcaaaacagcaaaagaaacccagtccccagggtcatgctagggctaccaaaactgggatgaactagcacctgtgaactagaacagcagggagtatgcttagagtgcctggtcctgggtgtggggaagaaaggccatcaaggtagatgcgggtggggaacagcttgagagaggaggcaaggacaacccagtttctgtctgaaggggcctctggttgaccctggagtttctgtccccaaacacaggcctcacgggattctttctgtcctcatgcactgggcagaggttccttaacttcctttgttgcacattgccattctctcacatcccgtgcggtcaggaagcccttcctgaactctgacttcagttcttgctgcggtttctgcccatttttttcatatcctctgacagctgcgaggtcatctctgctctggcttttctccaagcagaacaagtgggggctctggaaaggttaagggacctcagtggccaccattatactttgcatctttcctgagaagtgagagttgaaagggaagcaggaaggcccatggtcagattgaaggaaggactttttagtttcttttttttttttttgagatggagtctcgctctgtcattcaggctggagtgcagtggtgcgatctcagctcactgcagcctccacttcctgggttcacatgattctcctgcctcagcctcccaagtagctgagactacaggcacatgccactacacccagctatcttttgtat

SEQ ID NO: 14698 - DNA, 18895 bp, Human
  misc_feature (1)...(18895): n = A,T,C or G
gaatgaacaggggctagtgaatagtgaacgtatcctaagtgctgttatttgggagaactggtgcaagaaagcatgtcgctatccacatcagagtacctcaggtgtactcacaaatctcagcgatgtgtagatagaataatacatgcctatattcagacatgagagtgaggactggaagcaaataatccatcgaaaagctcaggcttcaaatccatcttttataatgccaaagaaataacaagtattctctaatactcgattggaaagttaggcaggcagaaaaacattccctcggatgtttcactcaaaagaggagagttttgctctacacatacaatagatacagatataacacaatataacacaatattcttcccatgataccacgaagaaactgaacaaactcacagaattatttgcaaatcataagggacttgaatgcaaaacattaaaagaactcttacaactttgttatgaagagatagcaaattttttttaaatgggcaaaggatttaaataaacatttcttcccaggagacatataaatggccaataagcacatgaaaagatgctcaacatcattagttgtgagagaagttcaaattgaaacagcaatgatgtttaacttcacatccacttggatgtctacaagcaaaaagacaggcaataacaagcattggcatgtatacggagcaattggaactccagattcattgctggtgggacggactgcaaaatggtacagctgctttagaaagctgtctggcagctcctcaaaaagtgaaacaaagaattacaatatgaaccagcgattccactcccaggtacatacccaagaatgaaaacatgttcgcacgaaaacgtgtatataaatgttcatagtagcattattcataatagccaaagggtggaaacaccccagatgtccaccaactaatgaatggataggtaaaatgtggtatacccatacaagggaaaattatttagcatgaaaaggaatgaactgctgatgctaccacatggatgaccctagaaaaccctaggccagtgaaagaagccacacacaaaagactctacatatatagtatgattccacttacatgaaatgtcaggataggtaaattcatagagacagaaagtagattcatggtcacttaggcatgggaggtggctagggacgtggagggtagtggggagtaaccactaatgggtacaagatttcttttagaggagatgaaagtgttctaaattagactgtggtgatggttgcacaaccctctgaatatactaaaatatactttaaatgagtgaattatgtggtatgtaaattatgtctcagtgaaggtgttttaaaaaaataaaatattaacaaattaggtaccttcactcctcagttttgtgatatataggctaaaaacaaagtgaatcaaacagttaagtttctttcaagctagttggcttgtatgccagaatttaattgggaattggaattgttttcactgagataacctatgttgtatttccttaatatagagagatcatgaatagacatttttgttttttttgagatagggtgttgctctgtcacccaggctggagtgcagtggcatgatcacggctcactgcagccttgacctttcttggcccaggtgatccttccatttaggcctctgagtagctgggactacagttgcaacgccaccacaccctgttaatttttgtatgtttgtagagagagggtttcaccatgttgcccagcctggtctacaactcctgggctcaagccatccgtccgcctctgcctcccaaagcgctgggattataagcgtgagccaccatgcctggccaagtataaacacttttaacattggatataccagttgaactttatactttcctctttcctttgcagacaagtatctgtatttaaaatatgtacacctaattttttctataatgtatattttcttttaaaatatatctttttcttttcctccttagccacaacaagttgttcagaagaagcctgctcaggtaagacatagtcattaatttttttctcccaattaatataaaaagtgaaatatgtactgaaaaatgtccccaaactaaaccttatttcgcattttcttacttttggttatcgtcctgcagtattcctgaaaatgtgttgtagccttcaaagttaggaatatatagtctgcaatcgtaccatgaaaacctcccaaaatgtaaggtcttaagtgtacaaagcaaatataaattcttttaaaaataaaactattttattacattgcctcatatgtaaaacaaatatttaatcttatcctatattttaccaattcttaaacatcaaattttgtccttccaactgactgtctatattctgttgacaccagacttatatttaatgattcatgactggaaacatatttcttcattgaacaatttcataatatttgatgatcccaaaacactccaaagaatgctagaatacttggaaattaagttatactaacgtgcagactgatgcattcttagatcttatttaaataactgaatcacagtctctgaagtttttggcaacatcaaattggaaaatagctctacgtctcttgccccatattcctggagcaccttgtcctcactataatctgtacatagaaacattaaaaaaacatatttattgaggaagcatatcttgaagaaaacaaaactgaagtataaattaaccaggattgctaataatgtgagccagtattaaagtataagaacgtcctgctgttctcttcccttctgtatgtaaatagtcattggagatccaggtggtatcatgctgaacctgctaaaataagtagtaagcagtgtcatgagctatcaaattaagtagaactctttcatgtaattttaagtatccatgaaatttttttccctagaagtctttacaaatctaccttgcatcctgttttcttaggtcaatgttgccttgcctgggaaggaccacccgggcaatcttatatatctactgttctctaaaaatgccacttagaagagaattgaaacttccaaacacatgaaaggatccaaggaaagtgtcttcaaacaattacatatgagctttaagtggaataaaaacagagttaccatgaaaaaaatcattttcattgctgctcccatacctaaaagctaagagtgggagaggggtgctaaaaaaaacccagtgtttgtgcgtctttaagcaatatttaaaaatatatacatataaacaaaaacttgacattttcattaggagaacccaaatatatttagcctctcatcctttaactgtacaaaaatcaagagaaagtaaattgataattctgtgcatttgagtcaaaggatgaggcagagttcacatttgcatcacaggctgtgaactatagattaatcactttatgtggtttgttaatattgattcagcccctgtgcttagtgtcatagggaagatgagtcaaacaaagaaaaacagtcactgcatctgagaaatgtatttatatgtatatgcctgtgtcctatccagtggtatgctggaaccagcccttgtgagcaaatagtgaacatctcttctgaattctgtgttcagtgatgtcaagtaggtagcttgaaatccactatggtgggagtatttacaccatggaaagtgacaaatactacaaatcaggacttttttttttcctgaggagcaagtagttaaacatttacctccccagcatggccccacccttcagcgattctgtttatttggtctggagatccatcatattttttatgaactccctaagtgagtttaatatgcaactagagatgaagacactccatgaaaacacatgagaagatgtctgaacatttgttgagcaaatgaccacagaatgtcaatgtgtatgggacacacgggggatacagatgaatgagtggaatgcctcaggttatcaaggggatgataagactggaattttcttgttttgtttgattttgttgttgttgagttgcagaagggaaaactgaaacataaattaagggaaagaaattacagatgagatgaatggcatatagaaaggtagagaggcaagaacaaatacatcataggtggagattattaatatggctagaactgattgcaagttggacattaatacatcaagaaataatataagtgaaatcacagttgtttttcccaagagaattcagaatctcaaagaagccacaagtggattgagttgatcttcaaggatcaatctggctatcttacagaccctgttccagatttgccctttataggagagttcagactcagaattataaaaaagaacatgagctcattgggctacctaatttatattgtgtaatgacacagtgatgaattatataaacatgaaaactacgtgaaagttcgtggaggataatgtaaattttacactacattcaaaagaatctcttccttttccatctgtttctttcaaaataccctcccagatggctttcccatgaggcaatctggattaactcagcctcatatccttccttcaacagcactttgaggggttacattcagaatcgcttttgaggtggtaaaaattttagcacaactaaatattttacatctaaagaaaagggctcagcagtgtgtaaacagacctacgtttttctttctggccccatcactgggctaattaatttctctttgctctatttatccatctaggaaatgggataataataatgccttttcccttactcccaagaacattacaagagatgcataattatataaattccaggtagcattattacattctgacttatttttgactgttaagtttttcatttccagagatttatagtctcaaaaattctagaatcctgatttattccaaagtacttcctctttgacgtcaagtgttttcattgaatgttttttaaggcaggaattttttagctggaggaaattttctagtaattgctccatcctactgttagggctaaagcattcagaatcatcttcctagcatttatgtcacacgtatacagaattacaaaggctctgtggtgaagtatcctcatactgcccaatgctgaagtctcctcagaacttcaagaatggcccttgttgaacctggggtacaaagcagcagagtttattctgaggagacaaattcagaattatgataaatctcagcacctgcatacgcacttgtgtttgtgtatacaagtacatgcatctagagagaaatgaaaagtgaaggaccaccctgttgcaggggtttgtgtttgcgaaatccaccaggtgtcatcagctgcaaacatcaagtgtgtcccataatcctaatgggagagttaatagtctcttaaaaatctaaaggggaaaatctgtaatatgtacgttaacttttttctaaaattccaaaaccaatgaaaacagcttacaaaataactctactatatttccacttcaagtgataaacaataaattgaaatcagctaattacaaataaatagaaatgaggctgggtgcagtggctcacacctgtaatcccaacactttgggaggtcaggagttcgagaccagcctggccaacatggtgaagccccatctctactaaatacacaaaaattagccgggcgtggcggcggccatctataatcccagctactcgggaggctgaggcaggagaatcacttgaacctggttggcgggggagggttgccgtgagcagagattgtgccactgcaccccagcctgggtgacagcgagactccatctcaaaagaaagaaagaaagaaatagaaagcagctcgttttttagcaatttgagcagttgaattctcagtcatatgaattacattcttcagtaggaaatggtggtaggtttttctttttctttttttaaaaaaagaaacaccataaaagtaccagattattattattattagagggtgctttgttactcaagtttttactttgataaaaataagtgtctctccaactgagatgtctaaaaaagtttcgctagtttatcaggtatttgatcgtttattgctatttcccttttaaggctttaatctgagacttgaagggactccctaaatgtaattcagacatttttctctcacctttcttctacccaaagggaaaacaggtttttaaaatcctaacagctctccaccctttcaatccactttccccattgttgtacagccctggcaaacgatgcctctggcaattaggacaggtataaacctgctccttttcaatttcccaatgagagaattgcaaagttttcagtttctaaaagactggaaacaaagctttctgtttcaaaaaaagagtttttacttgcaagtaacatcttctgtgggtggtgtgcacccgggcaaagaaatctcagtaagccttgattatcacgggatttcttccccctcaaaataaaatgttgaatgtttttacagagacttcaagggcagttttaaggatgtttatatttcagacaacctaaacattgtttggagcaaaatgagagatttcattttgggacaagcaagttgatgaattgcagtcagcatctcgttctcaaagaaggcatttttactgggggcttttagtctagacatacaaagagggaaggaggaaaggggaaagcattctcactctaacactcgtcttttacatggtaccttggccagtgcagtaaatagttcataataaatcagacttacaaatactcactcgtctactcactcaaggagcataatgatttatactgcctaagtcacaaagattaccgatgtatttattttcttgcttatgcactttcaagctagtaaaacatcttgtgggccagtaaatgtttagtaccaactggcaaaacatgaagaatcatatcaaaggttgccctaagttgcacggttttgttgtataggaaatactttttgacttaacctctgacctctgacatcaccaaggtcaagggaaaaggagagagcaaagtagaaaccaaggtttaacccttaataaagtagctcaaggacatagaagcacagggaaattggagggcagaggaagcgtatcaaaatgattattaactgtaaacagatgaagtaattagcttagctaacagttgtaatacaggaatattggcaggatgaagtcagcggttcttggcaggaaatgttttatagagatgacaacttctaacagaagtgaaagaacatcaatcaatttagggcaacttataaaactccaaaaagcaaaatttagtgtttctggacttgacaaatttgctgtgagagttttttttttaagtatgactgtttctgtgtggggaagtctgtggattaggctcaaaacaaaatggcagtggctgcctgcatttcctcttcatattgcagaattttcctctacattttgatgtgtactggataaaaaccaattgtttactcaatatataatctttcttcttactctccaaacttgctgacccaaattaatgtggaacaaatagcaactggctttaaaacctggtctttctaagaaaatccttaatggttgcatagaaatatgttgcattgcctcagacacttacattcaggaaatgtttgctggacactcagatgtctacagagaaattgttaacttactgttattgatatttttataatcttactcaaaagtcataactcaggataatgaaaaatgtttggtgcaataatgattaaaatccacaaatattctgttccctggccgcaaatacaacacctatgcaaaattttacacatctacaaaacaaagggaaaaggtttttcctagtctatgccattaataagcacatctggaatataacccttaagcagtctttaatcataatttaaagctactttgcataaaaataagaacattccacaacagctgtggaaacattgaaataaattttcttcttctgggccgggcacggtggctcatgcctgttatcccagcactttgggaggcccaggcagaagtattccttgagcccaggagtttgagaccagcctgagcaacatagtgagaccccatctctatttaaaaaaaaaaaaaattaccttcttttgaatactttgtttatgcaaaaatccttttgctttctttagctatttttttaaatgcagtgttcctgcagtaagaattgaacctggcatggaaaactgatcaaaccggtagtcctcagaaatcatcactcctgaaacttgcaattagtttatacctaaaatgatttccctatttgaaaaatgtgcctaccatttccagattttaaaaaaatggccctttatcccagaaaggagaaattcattgtatcccagagaccagcattacttctgttgcagtattttcagtgatggaactctgttgaggctacagacaagaaaagcaggagagcattttaggaatctaagattttttattttactttcctctggggaccttctttaatagtttttttctttcttaagaacctatccttgaatcataggtaaagaaataatcacagaatgagtaactgacattaataatcacagcttcacactatagtcttactggatttttacgtttttcagggtttccccaagtggtggtcacatttcttacacaactctgcagtgtagatagacatgtatagtcattactgggctgacacggtgggactgagacctgctagtgccgtggttggcatctatgattagtgaggtccaagatcaaccttctttacattaaacatgccctagcaagaccttcaacccaactttattaagctgatgctaacgcacacaaagaagtcctaacaattctatgtttttatatacataatgcaaaaataaagacaagatcaggtacaattgctgtcaatatctcaacttattgtctccttttgaaaaacataattcccgcctagcatttccaccagaatcccttgctcttgccaggttatattgtttatatatgttccatttaacatgttttttaaaaatctgctgtagagttttcctagttggaggaaataatcactttccattaagttaaacagtcccgataaattttaaatgaaaatatctgacagagaaatagaaaaactcagccttgtggtcttgccggtcacttagctacagatggaacttgaaaaactggttcctggtcattgctgctgaagagagccctttatttctgttgtgacaggactgactcaagatactcatgaacgtggaaaactcctaaatgtgtcattctgagttcctgagaagttgaacatacacagatgacaaaaaagaatgccatttagccataactaccctttctagattaccaagtatttgtaggtttattggcaagatagcttaaattacgtatgtatttctggcctgcaacatcatgtaatagaagagttgcagaattctttgcagttaagaaaaaaaaaaaaagataaggacttattaaagctgacatggactgtgatttttgcactccgtaccacacacaaaggagggcatcgtggtgacaccacccctgtgtttgtatttcttggttccatttagaattcactggcctcttctactgcagacctgctgtttagtctgcatctggaaattaaacccagagcttcagctcttagcattaaatattgaactttcttccagcacacaccctcatccatgcctgtatagtaagtctgattaaactcaagacattttaaaattccatcagccttaggagttaagtttggatattgggctgtcttcctcctcctttttaatctattagaagaagtgtacccaaaggtatatataccacatgcatcatgttgaaccaaattaaaagaacagtgatatgtgcaaactatatttctgggttttagtggagtttttttccaaacttagctaaaacaatgagttacatttatcaaattccttttttcatgaacaaaagaaaaactaaggcaaagtaagtgcacttttccagtagttataataaaaatatagttttccaactctgcccacccctgttccccactcatcagttttctgccaagaaacctcacatgtttcggcccggtacctcacttgtctttgtaaagtagctgcatgatggctgggagcttttcggtgtttagaggccttagtggctggtgctcataaaaatgtcaccgtgcacttgcactttgaaaagtcctttcatctgaacattcctgaagccccattccaacaggtaagccttcttgaccaaagagtggctgtttagccttcccaccctgccactagaccctaatgagatgtgtgcaactcttggctacagttttcatctccttattacttcaaggctcctcttgggagctacacaagctcaaaggtcctttgaccattaggtgacaaatgagaagcaattttttaaaaacatgtcaaggtaaaagctattgtctataacacacggccatgtctttttttctttttttttctttttatttgagacggagtcttgctctgtcgcccaggctggagtgcagtggcaccatctcggctcactgcaagctctgcttcctgggttcacagcattctcctgccgcagcctcccaagtagctgggacttcaggtgcccgccaccacgcctggctaattttttgtatttttagtagagatggggtttcaccgtgttagccaggatggtctcgatctcctgacctcgtgatccgcctgcctaggcctcccaaagtgctgggattacaggcgtaagccaccatacctggccccatccatgtcttttaagttattaaagatgatcgaagctcaggggtccctaccaactcctcagttacagaaacaggactctttggggatgtcggagccagctgcttattctccatgtcacctgtttctgttccctctttgcaccacagaagcaccctgtgttaagtctggccgaaccatgacacttaggagagctgagaatgggttttccaacctcattcctgacagggaggatttttcttctcttcattgaatgcacacttgtcgtacagaatccgcacatgtaaccaaagaccaagtcactgggaaggtgagagctgaggtttgcagaggtgggaaaagccacctgccccaccacatcaaccctttgggaaccattccttcctttgaagggtggccagccagggctatgccaagaagagagagctctccactaactagacatttgagaaaaccatcattctgagcatgtgagagccacattgcctccaaacctttaatgaagtgagacttccaccctctgacatcctagtcatgttcccagtactaactgatagttactagtagaattctaaggtcagcagaaagatacattaataaaacaactatccacattgtcttatccacattgtcttaaggacagttaaggaaacaatatgacctaccaccattttcatctgaattgtgtctaaagggttggaattcaggagtttcagcagctcacatcaagcaaagtttctgggaatgttttgaaaagctgatcacattccatctagtacaaggtctttgttaagttcatggcctgaaaattctgtttccttccggatttgaaagtaccttggtttccggatagtatagaaaaatcaaacagttagaaattgaataattacagcacaatccaggaggtttgccagcttgactgagttctatcaattttttaaccgtaagaaggaataaaatatacttgctggcttttatgccgtggtctgtttcagagtagtcacctaagtccacacctcatgtcagaatgagaagtgaatcatctggggacaaacgaggtgtgtatctgcctaacagcttagtgactttctggaatttaaatattaagtgaaaggacagggtcacagggcagctgatctttggctcgtctctctttcgtctgcccatggctttgatcatgctacatcctcctttgtggccagggctccacagagaatctcagggtcatggcctgttgcctagtcaagaggtataaacctgctgcttaaatatgtgaagcccacagtttgggggttgggagttaaaggggaggtagcctcatacgttccacttttcccacaaaacccaaagcagactaaacaaaaccggtgtgaaatctcatgacttgatgctgccgtggttatatttttcaagctgtaatccattcatttgtatgtgtgtttattcccaggatttacagctcgctcagtcttcggggggaaagagaatatttgaaaccttttgcaaagggtttgaagtatgcagtggcctgtgattaaagcccaggatagagtgtgtgtgtgtgtgtgtatgtgtgtgtgtgtgcattcatgtgaatgtgtgagtgcccattcttgtggggtttttttctcccatttgctgcttttacgcaaaagcatcacacatggtagcatttaggagccccttcacagctgaagtgtttcaaacactaatgaatggaagtttggtcatataatgcagacaagctttaaggcatgctttactgaatggtgtactgtagtgacctgggaaaggaagagaggtataaattgtgtcggttagccacccagacaaaatgaagccatgtggaaaatcaaatctattaaagtatgaagactgttataagctgttttaagctggccattcttaaaggggctcggtctgctgcaggagtaaatgtttacctcttcccccagatctttttcacatgccgtcttatgagacaatgtgcagcatttgataaaaatcatcctctcactaacgacgcttttatcggaaatgtttattgtctccgctttaccacccatgtcctgaaaggtactgcacatttgttaaataagcaaaaggaaagagaactttgcggctcaagccggctcgcagaaaccccaacaaattccagagccataaggaatcagaaaaaggaaaagggaaggaggagttagatttatatgaagagggggccttgcaaaaacatatatattagattttctctgcttggctagcccaccatcaaatgtttggtcgatgcggattagtattgagattgagcagttaacgccgaacttgggtcactgtctcaaaatgtgctttaataaatacaagggggaggaaatggatttgggaaggctcgttgtcagctctgcccctgctctcacactgcctctgcacagtggtgtaggggtcacacacaggtgttggcaccagtaccaacccgacccaaatcctggtcccacacaccctgtaattttgggcacattacttgtctgtgccttggttttctcagatgtaaaacaggaatattaacagaaggtgcctaagcatctggtaagcactctaaaaataccagctattattaccagtatctggagggtgggttcatttataccttaagaaaggatccccctaactctatttttcttgtgtgccggtttttaaaactgatgaatggcatgctgtcgggaaaaatttatccattcctactttttttctaattggtgagtaagcgtgcattgccctgacattctctggacagcaaacaattgaatttgctgaccagccgccatgatgtcaagccttaagtcaacagtggctaatgaccgctctgggaaaaaacaacaccttgattcctcaattacggtttaagaagccctgggaatgagggctcgccagtcatcgtcatcctcttttgaggcaagcataatgtgctgtggaaacaggttacctctgcactgttggcaagagcagcccacacagtataacgattgagcgtcatggctgtgccctttgtgtgttccaggaggaaactgaagagacatcctcacaagagtctgccgaagaggactagggggcgccaacgttcgatttctacctcagcagcagttggatcttttgaagggagaagacactgcagtgaccacttattctgtattgccatggtctttccactttcatctggggtggggtggggtggggtgnnnnnnnnnnnnnnnnnnnnttaaaaaggactatattaatcaccttctttgtaatcccttcacagtcccaggtttagtgaaaaactgctgtaaacacaggggacacagcttaacaatgcaacttttaattactgttttcttttttcttaacctactaatagtttgttgatctgataagcaagagtgggcgggtgagaaaaaccgaattgggtttagtcaatcactgcactgcatgcaaacaagcaaacgtgtcacacttgtgacgtcgggcattcatataggaagaacgcggtgtgtaacactgtgtacacctcaaataccaccccaacccactccctgtagtgaatcctctgtttagaacaccaaagataaggactagatactactttctctttttcgtataatcttgtagacacttacttgatgatttttaactttttatttctaaatgagacgaaatgctgatgtatcctttcattcagctaacaaactagaaaaggttatgttcatttttcaaaaagggaagtaagcaaacaaatattgccaactcttctatttatggatatcacacatatcagcaggagtaataaatttactcacagcacttgttttcaggacaacacttcattttcaggaaatctacttcctacagagccaaaatgccatttagcaataaataacacttgtcagcctcagagcatttaaggaaactagacaagtaaaattatcctctttgtaatttaatgaaaaggtacaacagaataatgcatgatgaactcacctaattatgaggtgggaggagcgaaatctaaatttcttttgctatagttatacatcaatttaaaaagcaaaaaaaaaaaaggggggggcaatctctctctgtgtctttctctctctctcttcctctccctctctcttttcattgtgtatcagtttccatgaaagacctgaataccacttacctcaaattaagcatatgtgttacttcaagtaatacgttttgacataagatggttgaccaaggtgcttttcttcggcttgagttcaccatctcttcattcaaactgcacttttagccagagatgcaatatatccccactactcaatactacctctgaatgttacaacgaatttacagtctagtacttattacatgctgctatacacaagcaatgcaagaaaaaaacttactgggtaggtgattctaatcatctgcagttctttttgtacacttaattacagttaaagaagcaatctccttactgtgtttcagcatgactatgtatttttctatgtttttttaattaaaaatttttaaaatacttgtttcagcttctctgctagatttctacattaacttgaaaattttttaaccaagtcgctcctaggttcttaaggataattttcctcaatcacactacacatcacacaagatttgactgtaatatttaaatattaccctccaagtctgtacctcaaatgaattctttaaggagatggactaattgacttgcaaagacctacctccagacttcaaaaggaatgaacttgttacttgcagcattcatttgttttttcaatgtttgaaatagttcaaactgcagctaaccctagtcaaaactatttttgtaaaagacatttgatagaaaggaacacgtttttacatacttttgcaaaataagtaaataataaataaaataaaagccaaccttcaaagaaacttgaagctttgtaggtgagatgcaacaagccctgcttttgcataatgcaatcaaaaatatgtgtttttaagattagttgaatataagaaaatgcttgacaaatattttcatgtattttacacaaatgtgatttttgtaatatgtctcaaccagatttattttaaacgcttcttatgtagagtttttatgcctttctctcctagtgagtgtgctgactttttaacatggtattatcaactgggccaggaggtagtttctcatgacggcttttgtcagtatggcttttagtactgaagccaaatgaaactcaaaaccatctctcttccagctgcttcagggaggtagtttcaaaggccacatacctctctgagactggcagatcgctcactgttgtgaatcaccaaaggagctatggagagaattaaaactcaacattactgttaactgtgcgttaaataagcaaataaacagtggctcataaaaataaaagtcgcattccatatctttggatgggccttttagaaacctcattggccagctcataaaatggaagcaattgctcatgttggccaaacatggtgcaccgagtgatttccatctctggtaaagttacacttttatttcctgtatgttgtacaatcaaaacacactactacctcttaagtcccagtatacctcatttttcatactgaaaaaaaaagcttgtggccaatggaacagtaagaacatcataaaatttttatatatatagtttatttttgtgggagataaattttataggactgttctttgctgttgttggtcgcagctacataagactggacatttaacttttctaccatttctgcaagttaggtatgtttgcaggagaaaagtatcaagacgtttaactgcagttgactttctccctgttcctttgagtgtcttctaactttattctttgttctttatgtagaattgctgtctatgattgtactttgaatcgcttgcttgttgaaaatatttctctagtgtattatcactgtctgttctgcacaataaacataacagcctctgtgatccccatgtgttttgattcctgctctttgttacagttccattaaatgagtaataaagtttggtcaaaacagatcaaggagggagacactcacaagtcattttgttgcaccccttgcacacatcttggcacacatgtacataaagtgtgttttacatatcatactccttcaatcaactgccctgagctcgcctttcagattttgacatttaattctacagagacaatcttagaagaaacatgaagaacaagctgtagctccaaactacagaatttttacttcaggctagcacctacaaagtttgtaagggaagtaactaatgcactagtcgtctttgaagtaacattggaaagagatccggaagattgatgaataagaaatgaaagccacgaagagtctcctagataggagccttttaactctaaaaactactagcagagtcagaatgattctaccaagttcaaggtcaacttgacacttaagttgctaattatgaataaatctaggatttttaaaaagctaaaactttcggtttttactatcaccgttgttactcaaattttcttcatttagcttcttagaaggagaaatttgtttctaggaaaagcttgccaattttaagacatctactgtcaggaaatttgttaaacgtattatttcattcctaaattcattcacttattctcacagccaatattctgtgagtaccttactgagttgtcctgaaaagtggttgcatcctgaagcccctgccaataccaaggacaaatcacaggccctctcacaaaaagcctttatggtcaccatcagagagggagaatgagtttcaaccaatgtagcatttcacatgggagcgtggggagggtatgtatcttttaatgggctgaggatgctcaactctctggtgaattcaggaatagtaaatggtttaggagtctaggcagaaataaaaatagaatttaggaatgaataccatccagctaggaggcatatgaggcaaactccaactgtaacaaaacttcagagaagtgaaacataagaagcccaagaccagcacagtggcgcactcctatagtttcagctactcaggaggctaaagcaggagggtcacttgagtccaggagttggaggctgcagtacactgtgatcacacctctgaatagccactgcacttcagtctgagcaacacagcaaaactctgtttctcaaattaaaaataaaaagcccaagggcagagagaagacggcagatttgatgctcttcttttcaagttagttttatttctgtgaaatgactttttattgagcaagactaatttctagagttaggtaaggtcattcttgagcaagtactcttcagatctaggaattctggcctaaaagtggacgaaaagttgaaaagaatcaaaatttttttgaaatacataattcagatagacaacaaccggaggggggagtcaaaaggcaacaacaggggtctacacccctggtctgagttcagccgtctgtaaaacttggcaatttttcttctgaagtaggagggaaatggctgcagatatgaccctctctcctccatcctcagcctctgtatttgggactccacccaagctaagccagtcatgccttggttccactctcataccaagacccagttgcggcccatgggaaaatgcctcatgtcagtgagcaatactccactttgtacctagtttgcgatagttaggttcttgtttttgcctttgagcctaactcaacaccttgatgatctgcctccaccccatgagtaagcccatctcagccttcccagggccctaaattcttcccctgtactgccacccaccctaaggttgaccccttgtgacctgttagtcccatctccctttcttctattcaattacctattttctcactcttggaaattgcttgtcctgtggcttccttagtcctagtttaagcatacattcttgaggatgtgaaatagcaacatttgagaatgctgcactgccagaacccagactgtggggtatccaccttgaaagaaacttgctatgtgaggaaaatggtagacacagatctag

SEQ ID NO: 14699 - DNA, 278866 bp, Human; identical to SEQ ID NO: 13922
  misc_feature (1)...(278866): n = A,T,C or G

SEQ ID NO: 14700 - DNA, 278866 bp, Human; identical to SEQ ID NO: 13922
  misc_feature (1)...(278866): n = A,T,C or G

SEQ ID NO: 14701 - DNA, 278866 bp, Human; identical to SEQ ID NO: 13922
  misc_feature (1)...(278866): n = A,T,C or G

SEQ ID NO: 14702 - DNA, 278866 bp, Human; identical to SEQ ID NO: 13922
  misc_feature (1)...(278866): n = A,T,C or G

SEQ ID NO: 14703 - DNA, 278866 bp, Human; identical to SEQ ID NO: 13922
  misc_feature (1)...(278866): n = A,T,C or G

SEQ ID NO: 14704 - DNA, 55061 bp, Human
attagctgggcatggtggcatgcgcctgtagtctcagctactcaggaggctgaggcaggagaattttttgaacccgggaggcagaggttgcagtgagccgagattgcaccaccactgcactccagcctggtgacagagtgagactccacctcaaaaaaaaaaaaaaaaaaaaaaaagattaaaggaaaaggtaacgagtttttaaaagatatgctctctgggactgagaaataagggaagagcctcagaattgtgactgaggaacaattctgtagtgtgcatttttaaaaaagaaaagcctaggctcagcctaactaatcattcatctatgcccccaaacaacttcacacttggttctatagattcaagttccacatgagtcagaatccctaaaggacataatcctattagcaaaggcagttataaaggaagtgagaagtggaaattgacctctgtgtttcattagcagtcttcctcagagcagaagtgggacaatacaatgcctggaggactggacaattcattgcaagtgaaaaagggctcctgacacctattgtgaattttgcttgcctaagaagaactcatctctttcctccttcaactcttctgcctaaccttgtcaagttgctgcaggaaagaaacatgcttctttttagttggacacaagtttaggagatctgtgataaatcatggcaagaatgattttgacatacttcttggtcctgggcagagtcacaatgatgatattctagaaacaaggttcaaatctttccacacaaagatgtgtacctgtcaaagcagtgaaatggctgacaggactttttcaagcacctctaaaggacaggagctggagaacagacttaggagagtggggcagaaaatgaaaaatccaagtaacaagcaggaagaaacctacaacagtgggtagtcgtctgacaggcgcatataggtggatggaggatgctgttatgtgaacctagcagcaaggtacaatatgtccaaataagcaatgtcagggggtctgagagcaggtaacagggaccccagcttaaaaccttgagttcaggcacagcactctgcatactgggggacctagagggaaagacaacatccaaaagacagggtcacaagcagaagaccaggagacattcaggaatggagaatgagacagcagatgactattagaattgaggaacaggcagggttttttggtctcaagagagcaatgccagtgactcaattactagaaataagtatgaaaagaacagacaacacagcttcctttacgaatggatttatttattattaagataaaatgtctaagataaaaaatttatctaatgttttattaatcttctaatcccctcctatcaattcttttcttaaaaaattatattatcagccaggcacggtggctcacacctgtaatcccaatactttgggaggccaaagtgggtggattgctggagcccaggagtttgagaccaacttgagcaacatggcaaaactccatctctgcaaaaaatgcaaaaataagccaggtagtcccagttacttgggagtcgaggcaggaggatcacttgagccagggaagatgaggcttcagtgagctgtgttcgcactactgcactccagcctgggtgacagagtgagacccccgcctcaaaaaaaaaaaaaaatgatactatctgtttagctttatctttttaaattttgactaaattttcaagcagccatttttctgtctgaattgttccagatagtttccagagaaaggaagacaggttgttggctaaataccaaactgcatctcatcattagaaggaagcacaccaaatttcatttttctccacctttattaagtgcagatttttgtttctcatccaggaagttctgtattatcagggcaatgctaacttcagtataaatgacacagaaactattaatagattatgactatgatgaaactgaagtagaaaacagaagtgttctgaaaagagaagtaaaaaaatggaagggggaaaaggcaaagtattctgccttccaagttagatagctatctttatgaaaggacatatttcaaaggcaatataaagtctttatggtgctcttacctacctatatttgaattgggggatgcttcacctgcttattagtgaaagaagaaagaatacacttagtaaattaaattttttttaaaactttgtctttgctcagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggtactgtaccttttgatctaccttttctcagttaacttaagtaaggctaattatctgggcaaaataagaatcttctatttctttgagctatataaaatgaaaactgtttatttgctcttttgtgtttcagtgatagaaattaacagcaggcttagaccaagcccaaaagttgttatgagaacttttatctttgtctgtatcacttgttcctaattcataagtcactccaggtcagacaaaggaataaaggtagtaggccattgaattgatcaagggaagaaagaccctacaatataaaatataatttaacaaatatgaaccatttgccaagtatataaaggcactgaatagaacacacatgatagaatcaatatttgccttcaaaacatttttatatggtgtagacattgcataagtatagaaaaaagtaaagtaaaatataagtaccacaagacaggtccattcgaccaagagaatttaaaagaaacgtgcatatctagtttgtaagggggacagtcttattgcaaaatgaagactgagagaaggttattgctaaagctctagaattacaaatggcagatacgataaacagagttattcaccaggtcagaatgaatgaaaggaaagagatgaacctgcagttctatgagtggcaacgccacaaggaaaaaatatttcacagccagaagtgaaaggaaaaggacagatttgttagggattttacataatatagtgtgtagactaatactgcgaacataagtaattgatcttttttaaataatgaagttcatgagattgagaagaaaaaaggaatgctgggagtgcaaatcttttcatattgaatgctaagataatttgctttgattcctttctccttttgagattcccttctatgaatgtatctcttgttgatttgtactgaacagctgaattttctctattctaagaatccttttggaaaataactgctctgccaataatggattttcttctctataactacagtgatgccttcctttaagaaaacaatggttagttagctacttactacaactgagtcctgttagcaaaagtctttccttagaataattcttttatagaatagtgaaagagaaggaagtggaagaaaatgctgatggctctcatttctttatgcaagggtgtttcaaaatcttgttttgaaaaaaatgctggctcatcttttgctgttgtacggtagtacttgtcactagtctggccatgggtccaccaagttagcaacttctttgactcaagaataagttaatactaaatgtttcttagtgcggatagttgccatgttttagtggatgttatataaaagctaagaatgcagacaaaggtgtagtgtccttaatatataaagaattgctacaagtcaaaaaaggtaaaggtcaacaacccaaaacaaatatttcatagaaaaatacagaaatctcttgaacagatgaaaacttcagcaacctcacttacggtaaaaaaaaatgcaaaataaaactacaatatacaattttcactagtaataatgggaaagctcagagtttgcaaatgtatggtactggaaagaatgtagggaggcaggcattgtcacgcattgatgccaaaggtgagtaacttgcaaaatgtctgtagagaactatttttctatagctttcaaaattttaaatgtacactttttgactcagcagttcaaagaatgtgacactagcaaagaatatatgagtatatgtgtatgtgtgtacgttcacacatatatacatattacatgcatatattgtgtgtatatatgtgtgtatatatatgtgtgtgtgtgtgtgtgtgtgtgtgtgtctatatgcatatgtgtgtgtcttcccaaatttgtgaaatgaagttcattgtagcattgtttgcaatagcaaaaaatcagagaccatttacacattcatcaaccggggctcattaaataaattatggtatgtcctttcaacggatttctgtccagctcttaaaaagaataaaacagcttaatctgtactgatatggaaaaagcaccaaaatatattgatagctaaggtaaaaaaattagcagaataatgtgtaggctaagccatcacttatgttttttaactgtgtcatatatgttcatacatccataaaatgcatatgggaagaaaaataatgcctgacaacatggaataatgctgcttccatgaaagggaattggtcagatggggaatggggaaaaaaggaaacatttttcaatgctattctttgtcatcttatacattttttactctgtcaatctattaccaactcaactatgaaatatatttttaaaaaatatagatgaagttaacctaaaatttatcttattttctgaaaccccaggaaccagttgctgtttcttcccatgtcgtgaccatctccagccttcttcctgccactgcctacaattgtagtgtcaccagctttagccatgacagccccagtgtccctacgttcatagccgtctcaacaatgggtaattatacacattagtgtataattttctcactttttttgaatatatatatatatatgtatttgtatcaatattccaccaagaaatcccaagcttcggagtcagagagtccttaatttcaatcccaaagtgcacttactagctatggagttagagaaagacatttggtgcctctgagcttttctttcatctgtaaaattggaataataatatgtaactttctgagttgttttgaagcttagaaataaaatacttaaatccttagtatatgctgtctaaatgctagttgctaactcatctcatcttcttcagtaataggcacagtactcttatcaatccaatttcatctatttagccttggtcttcatctgtcactgatcagagaatgacataattgataactgggtcaaagcaagaaagtttccaatccagccaaaagtataagtgggaaaattagaggttaatgaaaggtctggaatgatgctgtttatttccttattcttttcttagttgtattacatgtgttactcctggtttgttagagtctgattctgcaacctgagaccctctatgaagcctcttgtaataaagtcactcataacttcactggtttagttccatttctgtaatattagtcatatatttagctgctaaattcagggatgactggagcggactgttttcttttttctttttctttttggttttctgtttttaatttttgttttttcagaagagaggacaaaaaatatacctgcaaagtattttaatggtctctcattcctacatccttgtacactttctaaaatatacagttgacgatgaataatgagagacttagaagtgccaacctctgcatagttgaaaatccatgtataatttttgactccctcaaaacttaactactcataggctactgttgacctgaagtcttaccaatgatatagacagttgatcaacacatttttgtatgttatacttattatatattgtattcttacaataaagtaagctagagaaaagaaaatgttattgagaaaatcgtaaggaagagaaaatatatgtactattcattaagtggaagcagatcttcataaagatcttcctcatggtcttcacattgagtaggctgaggaggaggaggaagaggagggtttggtcttgctgtctcaagggtggcagagagtaaagataatccatatatatgtgaacctgcacagttcaaactcattttgttcaagggtcaactgtaccttaatgtccatcattccttgtcagctccatgacaatgtagcataacaggtgatattattaaacttatttataaatgaggaaaatgaggcccatagggcagatgaaatggcttctctccaaatagcagtactcaagcgaaaaagctcttctgatcatgagtccattgttctttctgtttaagcactctactcataaactggagccaagctggcccaaatgggaagtggtaaatacccagaaccttagggatcagatgcacctgctcattctgtgactttatgatcaatgcaaaagatggtatgagtcctcaggcccattttaaagagttttataagaatattaaacctatgttcctgcctttgatatcctgttcttccgtgtagtatgaagaagtagacaatgtgtaagtgccacaggagacaagtctttatatatagtacatgaaaaggacgtgacccctgttcttcagggccctacaacctattaataggttttatctcttgagctgtgcagatggaaaacctctaaacatatggccacggatcatcagaatgtctgcttctagtaatgtgttaagtgcttcagcagatggtagtttgctaatgtctttttgatatacattattagttgtaagcaaagtatacagttgtgctttctgacttcaaaatcatgggcgtaaaataagaggttgccaccctctaagcttgtgaaaatgttaaaaaacgataatgcatgataatgacttccacatttttagctttcaaatgaatttaaactgtggcacaggtattcttcattctttagtttccctatgtaagaatatcctgaatgttgtaggcctttgaaagggactcaattcttccagacacctcaataccacttatcagtctagtttgctaagttacagttgaccaggaagaggtcattgctggcttggggaacatgattgttactattattggtatcatcgtaagctcactgcccttaagactagatgaaaagcaatgaattgttctgtttggttccctgtaagagaacctatgatgaaaatgcacaacttatctctttagttacagagatgaatcccaatgtggtagtgatctccgtgctggccatccttagcacacttttaattggactgttgcttgttaccctcattattcttaggaaaaagcatctgcagatggctaggtaagttaagttttactaatattttatccggaatctttaaaatatctttatctgccatatatatattgtttttgcacacctaagttgtatagcggtatattggattttagttttcagtgtctgtttctattgtgtgtgttttctaaatagacttcgaaacattatattggaaaatattaccattgaaatgagaaagcaaaggattgcttgtttacacaaagtcagacctcttgctatcaatcttggcatttgaagtagcccatatatggagatccattacatttgggtactttcatacacatttggaataaaagaaatatctatgacagttcagtatagttaatgaaaaaagttaataaaaatggagatgacaagaaagaacggggtggggggcgggaaatcctctccataattttaagctgttctattggaaaatatttgtacagtttatgattaggtccattagcagtctctattagttttattcctattactcagagttgcagccagcttagtttttcttgcaattagaaaagcctttgatttatgatttcagctcttccctgttcctttgaccactgatgcattgctcatcagagcacattctcaagtagtttctgtggccccctgtattatcagaataatctatcaattcccttaaaaactgttgcttatttgaatactacttggtttgggaaattttgttaacatttatatttgcccaatattaacctgctgaattataaattaacattcttctcctgtctcagagttctatcactcacatatttataaataaattcatctatccaatagtgatctaatcagtgcctgacatggcatatccaaagaaaaatcagacatcaaagctgtccactaggagcttacttacctaactggatatatgaatagatagatatatttaaaggcataagctgacatgtagcataaaggggattaaaaacaggatgccatgaaactagagaataaagactaattctgaatgtgaaaataagcttcttgaaggttggcatttgaataatcttaaaaggataagaagagatgtgggattgcactgtaactacagtggagagctctgaaattacactccttgaggtcaaatctttttttttttttttttttttttttgagacagagtctcactctgtcgcccaggctggagtgcaatggtgccatcttggttcactgcaagctctgcttctcaggttcaagcgattcttctgcctcagtctcctgaatagctgggattacaggcacgcaccactaggcctagttaatttttgtatttttagtagagacagggtttcaccatgttggccaggctggtctcgaactcctgaccttaagtaatctgcccacctcagcctcccaaagtgctgggactataggcgtgagtcaccatgctcggcctccttgagatcgaatcttgacttccaacttgcgtgaatttgtgtaggtcactgaaacttcatgcgttcatattacaaatattgctacatatatgacagtatatgaaacagacaaaaatatgtgccttcatggagctcatattctagtgggagaaatagacaataaacaataaagatataagtaaaaggactgccccttaagttagcaggtgataaggaaaggaaacaaggtcaggtaagggagataagcagtaccagtgtggtgttaggggtcctaggaggtgggtaggcttcactgaaataatggcattggagcagagacttgaagcacatgagggaggtagcctgtgttatctgtgggaagagtgtgcccagtggcaagaacagctggtgtaaaggccctggggtaggagcacgactgggatgttcaaagtgtagcagaggggccgttgtgactaaagcggaggaagacaagagtagaaggagatgtcaagttatgcagggcttcgtatgcctttggaaggactttggcttttactcagtaaaatgagcaggcattgcaggctctggagcagaagattaacagcatctgacttagatttaacactttcattttgacttttatgtagaaaacaggctgtattgaggcaaggacagagacaggcatatcaactgtggtagccaggaatccaggcaagagatgctaatagttcagtccagagcagcaacactgaaggcagagagaagccatcagattctggacatattttgaaaataggagcaacaggatttgctaataagttgatatggaatggaaatgaaaaaaggagttgaggctataatcccagcactttgggaggctgagccaggtggatcacctgaagtcgggagttcgagaccagcctgacaaacatgaagaaaccctgtctctactgaaaatacaaaattagctgggcgtggtggcacatgcctgtaatcccagctactcaggaggctgagacaggaggcagaggttgcgatgagccgagattgcgccattgcactccagcctgggcaacaagagtgaaactccatctcaaaaaacaaataaacaaaaaaagagagttgaggctaactcctgggtttttggcccaagcacttgaaaggatggagctgccatcaactgagagaggattccaggtcagagttgggggaacatcaagacttcagttttggaaattgtattagtcagagttctctagagggtcaaaactaatagtacatagtagtatatatatatcctattagatattatatatagatatagtgtgtgtgtgtatatatatatatatctcctattatatattatacatagatataggtatatgggagtttattaagtattaacttccacgatcacaaggccccacagtaggctgtctgcaagcttgaggagaaaggagagccagtctgaatctcaaaactgaagaacttggagtccaatgttgaagggcaggaagcgtccagcacaggagaaagatgtaggctgggaggcgaggccagtctctccttttcacatttttctgcctgctttatattcactggcagctggttagattgtgcccacccaattaagggtgggtctgcctttcccagcccactgactcatatgttaatctcctttggcaacaccttcacagacacacccaggatcaatactttgtgtccttcaatccaatcaagttgaccctcagtattaaccatcacagaaatgttaagtttgagataacttgcaagtgcaggtgcagagtagccacctggacataaaagtctaatgtttgaaagagaatttttggttgaagatataaatttgagagttgttggttctgcacagtggctcatgcttgtaatcccggcactttgggaggcaggcagctcacttgaggtcaggagtttgagaccagcctggccaacatggtgaaaccccgtctctactaaaaatacaaaaaattagccaggcgtggtggcgggtgcctgtaatcccagctactcaggagactgaggcagaagaatcgcttggacttggggggcggaggttgcagtgagctgagatcgtgccactgcactccagcctgggcgacgactgagtgaaactccgtctcaggaaaaaaaaaattgagagttgttaacatataaattgcgttagagctttagactggatgaaattcagggagtaagtgtaaaagaaggccctgcattaatcactggaacaatcaatattaaggttttcagggagaaaagaagataacagtaagcgactgacaaagaggcagccagtgaagtataaggacaactaagggagtgtggtggcctggaagctaggggaacaatgtgtatgcagaagagatgataattgcccctatattagtggatacttaggagcattaacgcagtaataacatagcgtaatactcaactcataggaagtgtgcagtaaatgttagctcataatagtaatggtggaggaggtggtaatagatgtaatgcaagtagtggtatttctgagcattttttgtggtacataccaaagatatttaggagaggtggttctgattctttcagctagttattaaagcatagattctcatcatttttcatgctatgatcctttttggcagtctggtgaactcttctaagaataatgcttccattttctgtgcctaaaataaaatacataggattatacaactatattgaaatatgataatcataatatttaaaaagcaaatgtgttgtacactttttaattagtatattcaatgtcaatatgtaatagtctaacaatttcatcatggtgatgcatatgaccaatatttcaagatatctgcagcaagtctattattaaaaaatatgtaatctctattgttagcaaatcatccatgtggatattctgatggtttggtacctactttaatgatagaaaggactgctaagtttagtcacaggttgtgaaaataaatatgtacccttttcccacatatgttcatagagtcctaaattctatctttggaactccagattaaaacccttgagttacaggtaaaataaatcccatatataggaaattgacataggaaaattcattaatgatgtgtaaattataatacactatgatattatattagtgtatttttcaaaagaagaaaattgttcttggaacaccttaataagaacaggtagataattcaagtaattagcacattgtgccagtaatgttaaaatctctgcttcagttctgagtattaaatccattaattccgtataaagaaaaaatgagatacatgagccccaatgagctgttattcatgcatgaaattagccaaaagatagagaaggcatgagaatatgtttactttttctctacttctggaaaaaaaaaaaaaacttcaacagtgtttttactagcagattaataggccacattccggacagtaggcacaccagaagcttgcctatttcaatacattccactcttttattctaatctccagtgatgaataatacgggcatcacaatataagagaaagattttggaggaagtaaacaatccacttgatccactatcattgtagggaggaaatcaaaatgccataaacaaaaccctacaaagaatttttgctaaagatggaaaatgctcagttcatctaggagagtttctatgttactattaaaggctttgtaaaaaaataaataaatattataccccaaatagttcaaatatttcttttagaatcatgaatgccctttggaaaggattgtgaagtgaattcttttggcctcaaataatttgatttgcaaacttgcaaaagattatttcttttcgttttagctttctgttttgcattgtatgccaaaagggaacatatggaacttctattagcttcttttattttgttttttttttttttctttttctttttgagacagagtcttgctctgtcacccaggctggagtgcggtggcgcgatctctgctcaccacaacctctgtctcccaggttcaagcaattatcttgcctcagcctcccgagtagctgggattacaggcaagtgccaccacgcctagctaatttttgtagttttagtagagacagggtttcgccatgttggcgaaactcctgacctcaggtgatccgcccacctcggcctcccaaagtactgggattacaggcgtgagccaccgcacctggcctagcttgttcttttttttaatttaatgctgtgatgataagctggtaaagactctctttacttttaggtcaacgtaagaatgctttgtcaagcagtaaccttgattttgtggttcctttaaaacagggagtgtggagctggtacatttgtcaattttgcatccttagagagggatggaaagcttccatacaactggtgagtattgttttggaacaagcttctacatagtttaactatgctgtgtgtgctccaaagtcgattttactatcctttggggatagttttgtctgattatccttttgtaatttcggtgatggtagactttcaatggctagatcttcacagaatataatggtttatataagctcagtgcagttctgaagtagggaaagcatcatggtctgctctgtatttacaatactaaacaagggactgaaacagtggtgcacacgcaggagcccatacctgtgctgaaaaagggcttaaatgcaggagcgccgctgaacaagtggtggctaaaggcacgagaagagattccaatgaagcagcttgcgacagatcggcttctccattttattttatattttattttattttattttttattgttttgtattttttgaggagacagaatctccctctttcgtcacccgggctggagtgcaggatgatctcaactcactgcaatctctgcctcctgggctcaagtaatctttccacctcagcctcccgagtagctgggactacaggagcgcaccaccaaatctggctaatttttagatatttgtagagatgaggtctcactatattgcccaggctggtctcgaactcctgggctgaagtgatcctcccacctcggcctcccaaagtgctgggattacaggcctgagcccccatgccaacccagcatctccattttaaactcacatttcagtgcctgaggcaataagagccaccacttctgttaaaaagttgtacagcccagtattcagttctcatgcttacagataaataaatatcaaagccagtgaagtttcataagaaaacatggcttcatttttctttatgcttgagtattaaggacccggaaggaggaagtgttcgaattttaaagagcattgtcaagagattaaattggttgacattatacctgacaatgatagatgaagattaacaatcctatccagttcaatcaatgcccaacaaaagtactaattaagtaaacatttaacatgaagctaacatgtactacttacatggtctagtttgtttcttttgcaagaaactatgcaaagtatatgtaaatgaatatatgtcatattaatcattgttcagttatttctttctgtttactaactccctaaaatggttaatcttaaagaaatacacatgggagactggaaattttacagaatcaatgagggagggagaactttatttaggatataaattttacttccctcagtgtagctgatactcactctagttgaaaatctagttgaaaccagatttcttttaataaggcaatatgttgtgccatttaaaaattttaacatgagtagaattttgctattaaaaaacaacccaactgtgaagaaaaagaaatccatcaacccttgatggtgaaaagttaggaaacgttactaggtttgttcaaatatattagcactctttccaaaattaagaggttgactcactgatacttgtttcatgcctggttcacccttgggaggcccaatgggagatcagtgatgagtggcccatctaggaaccaatccaattatatgtatttaatacttgtgactcatgagagatagatattaactaacttcacagccagtcacaattcatggaatttatgggagaccagtcatgggagagctgaagcaaaaaagaattcacttcaggatctttctataaaatcaagcacattttgcagctcttcacaaagacagttttgccgactctagcattttctagctgactgagaatagatatctcagtgaagatttgtaataactgaagtgacaaggtgacagtatttttccccctaattctcagaataactatagatgcagtcacaggatattttaaaatctatattaatgggtgttctatttgacaagtggtttgaatatctgaaaccaggcatttaaatcaacagtctgaattagaattgaagtgaagctaaactattttgctcctacttagctgaatatcagtgaggtcacagactaagtagttgatgagctacttatcttgaatgaatgatatccttgtatcatccatacctctgttttaagggttatatttataaattttatagtaatttaaaaacaatacagaaagtcacacctagtagtgcagctttattaagaatgtctcttaaaagcttagtcttcaccggaatcagtatatgtaaactgaccatttttattttctcacacaagctgctgtttagctgtcaaatgatgttacagaggtttcttaaaataggcttaagcataggaagaataatatccaagaataagcttcaagataactaatgaggcatataagtgcttcatttaactgaatgcaaaatgtaatcacctggtagcagactaattaacacaaagtaagttgaaagaaatatatctgattacaataaggtcatgtgtgaataaaaactgattttgtcaatattgtagcatttaagcccgcacatttatatttcacagaatggattaatatttaattgtaattaaggtgcttgtcatattaattaatcccaataggtaatttactgatatctattcacagtttatattactaactcttgcaactttttcatctttccatctgttgtctattaatgcacacaggcgtaggagtatatttgctttcttaaccctgctaccctcatgtctttggactgattatcttttggcattttatattaatccttggtaagtgatttttttttactgtttaacacaaactctttaaaagttagctttcaagaagtaaacaaaaaggaaagtttctttttaactattttgtatgttcagtaacatctaaagttattaatcatgtattgaagtgaattaaagcagttaccggtacaaagatattaactataaggttttccgttaaatttttttccgtgatgttgttggcaagcgttttttcccatttagtactagttatttgtttcttcattgagtcaatccattggcctctcatctttgcaaataatgctttccattttccattatcatcttcatccattagagagctccaaatttccaagaaggtagaaatgcattaagatggagaaatcagagtctatacaatcctctgtatctgaggcctccttgtttttataataatgctaactcagtgactattaaacagctgactatacgcaagcctctttgtatgattatctgatttaattttcccccgcaatcctgcagagagtattactagtcccattttagaaatgtggaaataggggcttacggagatttactgtcttagtagcacattccactatgtacagaatccaggttccaaactcaggtctctctgaaatctattctttcctctgtaaagagcagactcctttaatttcttattttcttaacttctggatcattttaataatcaaatcttgaagtgttccttttgactttttaatatgtaatgataacagtaaccttgaattctgagactaaagaattaagaactctttcttttcctgtgctataagataaaaggtagcagtttccaggggaactgacaagaaaatcattgtccttaaatattaatacctagtgtttaggtactaaattatgtacagacagatccataaatgtggacaacttgaaaaggtctcagaagaaaacaataaaaatatctcatagactggaaaaaaaatagcttatggggtggtggtgcgggtatgaaaagcaatctggagcatttatttattcaaaaagacaattgaccaaatgttctccagctcctccaaggacagaataaatacagctggcagaatttaggatttcaagttgcactggaaggaacataaaaaaggatttcctcaaaatagagattgttaattccagaattcatatcttcttttaaaaaaagagactagaggaaagcttttgaaacaaagtagacatgatgtgtaggtaataaagtcagaggaatgtgctagatgctgaggacccattcactgttattctaagttcattgttacagtttttagtatagggcttcagcacagtcaactccgtattttcagtatttgacatcaaatagttttcaggtatgaatagcacacataaattccatttcaaccttcaaaatatacatttacttttaactgaacatctactaatcatcctcaaatagtgtgcctaccattaaaatactaacagcaaatacccataaagtatcccagattgcaaataaaatgaaagaaagatgcatatatcatttccttgcttaattctctgagactttctcattttccacagtgcgtttttaagcttctgtaaggtaggcctgtgcaagtaagcatgtattccttaataggcctcattgatgaacatatgctcaaatttcagcaaccctcacaaggtctgctatttctaataccaatcaaatagcacgaggcccaacttatggggagaaaatacccttcagtaatttttagaagaatcaccttgaaactgtaaatggttgtctccagttgagaagagaaggtaaaacatagagctgcatgctttctgtaacttcagtaaatttcacacgtatcaactagtaaaaacatactggatataaactatgttctcagcccttttgtacaatgccagatacaaaagaagtgaaattcatgctccccgctcgtggaaatacagcttctactcacacaaccactccaattccctgtttgcttcatctaataacttgtggttattttcccctgctttcattggctaaagagtcatttttaatcctcctaatgatgtgtttgtcttcatatttcacctaccctgtgaacaacagctgcaaataacaagagccatctccccagacgcacactgcctaacacactgtccaacttcctttctaaactgtcggtttcttggaaatatatgttcctgttgattttctaaaacccatctgatgccactagtggtttgtgtggaaatcaaaaaactctttctctctctcatagtgttgctcgaatctcttcctggggtggtagcagaatcagtgtggagcaccagtacccagttaggttggtctcaggattgtgttctgcaaggatttctgactttcagaacttaagagtatgtttcctattgaaagaaatcatctaagttgaactagctatatctagattcagtgttaaatctttttttttttttttactgccataatgaccctcatgctgtactcaggtatttatctgcttgttctcaatcctaggcagttggcattttaagcaagaagtggcatttagttgaaaatgctcagctttactcctgatgattgcacattctatttgaagaatgatataatatactaaagtcctttttaaggtttggggatggtttctgcttagctcatcaaagagtaagcagcacttacaaaattggagacttttagagttttgttttgtcttgttttaactattataaatctcatgtccttgctattgctttttcggaatgaattgcagtatggatggctttccaagactgtcataaccatggctaatttatgcagaatgtatcttaactttttgaagtcattaggattttgaaccttacctaatataagtgaaagagaaaaaactaaaagtgcacaatcctctatgcatatatgctgtaggtatgtctgatgggggttatttattgatttggaaaatcttttgcaatgaaaaggcgaaccctacatgtcacacaaaatcgtcactgtaacatgtgcacatacatattggctctttccagaatgtgcttaagttaaaattgctagcaaagccttaatttgcgtgaattttcccctggttttagtctcggaattagcacagcaattgaaaatgtaggaacattttatcagtgttgctgtggagtttcataattcaatcctgtcatgttccacagccttaggatacagaaactccttggaatcagcaagatctaaatagaacaatgaaaattgtatacaaatcatgattacttatgccaataagtatatgataatatgtcatacaaaacatgtagtggaattatacgttatattgaaagttcattcaataatgaatgagattgaaagaaaaaaaatgtgtctctcctccatgaatcaagtttctacgcagctgccgagtagtagcagcttaatatttcagcactgaatttattcagtgttaccctcttacatacatttgttacttcctagtttcttttaaagcctgtttggataggaaagtatttttttgttcactcctgatcacaaaatgtgttggcagcctcctgactttaccagagctgttagtcatctccgctgacattctgctttccgaaagcactgaagtaattggctcttactacaggaagtaaatgtggaactcctaaaactaactaaattaccatcacggggctgaataaaaaacatgatcaataaatattcctttaggttcccaaatgcctataagatacagctatgtccaacatgatagtgttttttgaggggatcagggagaggcaaagtaaaaactggactgatttttccctctaaatctcaagtgtggaagacaaagaggatgagggagaaaaaatagaacaagaaccattgaatggattgttttcacttagaagtgggaagaaattaaaactacctgaaaaccacaaacaccacttgccttcgtggacgtgttcctacatttcttgacctgcattattttctcttcatccacaagtcccatcttttcaatcagaacatcacaagcccaagtctagtattcaattgttaaaggaatcattaggtgaaattcagagggtaacatggcagagattattttgtttcagttcaactgaataagcatttattgaccacccactaggtgtttcattaactatgctcagccctggggggaagctatagtgagtgtagcaaggtgtgtacctgcaactaacaatcacacaatgtgagaaactctccgtttgcaaagtgctgtgaaagcacaaagtactgcttcgtcctgctaaaagctttcaggaagtggagatatccaaacattcataattttaaatataaataaatatttggacacattaaagtactaagattacaactggttatttactatagactgtttattttctgaaaagttgggtgcttctatcaaaattatgtaaagacctctgaaaattacttgcaaaaaagtttgctgtaacatcacttgtacagtcaatcatgtttctgtatttactatttatagacaacaataagaatacaatcacaaagtgcttcaatagatactgttagccttagctaacttaggtaagttatcttacttggttgggtgaaaatcattaccttaattatctcctaaacaaatgtaactaactaaagcatgcattagcatttcctgtgtttgagcttatagactagtaatgatgaagagcaagcaggtaataggtccagttcttcagatagcttaaaaattagttcaagatggaataaaaacaacgccatagtagaattatacaaggtacatgtccacactgacagcacacattcacatccccagagaaaaatgtcagaaaatgttattttagtctttaattaagaaaacaacattccaccgtctctttattagttctccatttattcccccattcttccttcctgcctgtagaaattggagtgttcaggtggtagatagatacttctatatatttacaaactgctttagcaacttaatcaacagcagttagaaatttcatttctagaactcagtttttggcaaatgggaagtataaagtgcagatatgttcatgcaatctagtagagttttaaaaaatgaatctgaaattattattatcttctcatgtaaggaaaagtaaacaaacctgatatgtgtttaatgaaaattaaataaaactgaggtacctgatgtaattatttaaagctgttcaagtttaattattatgttaatcaattcttctgcccagataaatttgtcttttcttttttaattatcaggagtaaaaatggtttaaagaagaggaaactgacaaagtaagtttttcttactatgtcatttaaaaggatgtttgttataataatcttaacgttccaattaaagattgcttgtcttcaaagagaagggacgcttaagaaagaggcaaatgcatattacaatagctaagcacaataatgtactggttgtttatgcctgagtggcagtggccactagaaaagtgtatcacagaaatcacatcagaaataaggacaatgtttatcatatcaaatctgagagagtggatcgttagcaatttttaaagtcttggaggaggaagtatggtattctaaatacagtatatgaaaatctaatatttaactacatcaaagggtttcaaaaatccttttagtattttgaaattctgtgtttattgcaggaaaaggcttttactctatttgatgttataatagatactttgataatgctttctcaagaaacctgtataataaatagaaaagataattaatctagcctgtggttttccttatctattaaaccattaaatgagaagaattactattgtggtaagtgaaaattaacccccagttgatttcaaaagcctattagattatcacctccatgccttttcttagttataattctacatatgaaaagtggaactttcctttatatagagtttgttcttgatacctgcctggatagaacattggtgaattagtacaagaaggaaattagggggtccagccaggtctgtggcatctatgcttatggaaagaaatcatgagtaatccatgacataatccaaaagaaaagttgatgtaaaaatgtttctagttagtcttgagtggcatataattttatggcatatatgaaaacagaataattttttctaagtcaatttcattttttatttttattttttaatttattttattttattttttggagatgaagtctcgctctgtcacccaggctggagtgcagtggcacaatcttggctcactgcaacctctgtctcccaggttcaagtgattctcctgcctcagcctccccagtagctaatactacaggcacacgccaccatgcctggctgatttttgtatttttagtagagacgaaatttcactatattggtcagactggtctcgaactcctgacctcatgtgatccaccctcctcagcctcccaaagtgctgggattacaggcatgaggcaccgtgtccagcctctaagtcaatttcaaaccagcatacattccactggcttataccaactgatgtaggagagataagaccagactgaatagaggagagggtaccatcacctgggagggatgatttcacagaaacagaaagactttgttaccaaaaactgttggttgggttggcaggtgagctaaagaggcagagactagagcatttagaagatagcgtccttggacgaaaaggagagactgtcaaggcttgctcctcccatgactcaggcaaagaaaagaaggagaagcaagacccagacaaaagatagggtagagattaggagtggtagaacatacccacaagcaaaaaaaaactcacatcaattcggcttccaccttcccccctctcattttcctttgactcctctctccttctctagaagacatttcttgaaaggctttcctctcacctttttatttgccttctctaccatttctctttccctccaaatgccccaccactaccgtatccccctggttcccattttctatctccacttgtcttcattccatccttcctttccatcacctcctctttttctttttcctctgtagatatttgtccttttggtctctactcccttccagctttctttttcttctccttgtcattctccttctcccttatgtccattcttctgtttgctattccttcctctctctctcttttccctctgcttcttgcttttacttcttttaacccattaatactttgtctggtttgccttctgtatacatgtgcccattttcctagtaacaagatgaaagctagagttgttaaatccaactttaaggtcgatacactgcccaaagacaccagccagagagtgcagttctaagggggttcattccaggagaggagtcccaactttagcccattcttttggaaggataacaagtttgaagtgggaaaagctttgaaccaggacttactctccctggattccagtgagaattctactgcttagtagacatgtgatgttgggctactcacttaactctcttagccgtggctctctcagctggagcatggagctaatgttgtctattcctacctcagggatcaattaagcaagataatgcatgtgactatttatgaagtgtagcgtgttttataaatgagttattgttattaagtaaaaacatttcagtttaaaggtattctctggaagatataacgccctctaaaatttactaaaatgttaacataaatgaattaatcagattagctaatcaacaactttaaatgagcattattaaatactatgtattttctaattggacataagaccacagttaggccaggtgcagtggctcacacctgtaatcccagcactttgggaggctgaggcaggtggatcacttgaggtcaggatttcaagaccaccttggacaacatggtgaaaccaaatctctactaaaaatacaaaaattagccaggtgtggtggcacctgcctgtagtcccagctacttgggaggctgaggcaggagaatcgcttgaacctaggaggcagaagttgcagtgagccgaaatagtgccactacactccagtctgggtgacagagtgagactctgtctcaaaacaaaacaaaacaaaacaaaacaaaacaaaaaagaccacagttagatgatataagctgagtaacacaccacaagaccaagggaagggtcaactataaagaccctgccaaagtggaaaggcttgagttagatgacagaatgtggaattctgcagaagcagagagctactttagagagcaaattggtttaggtaggctctagaggagataagcagctacagaaaactacaggagataaaacttgattcttattctcaaaaaaaagtgagaacttctgctgcggatgcagaaacatagctcagatgtgttacttgattgaacctctgagccatttccatacttttatagatatgcaagcctctaaagataactcactccagtgagaccctgggagctttctggacaaaagtttcatcccactgatcctgcctctgctttggggagactgtagctagcagcacaattccttatacttgtaaagctgttgaaacttacaaagttctttatgtactgtatgtcaaccctgtagctgtaactactgtattttatggatgagaacattgactctgaagagttaggcgattctctaggataacacagtcaataaagcaaaaccataactcaaacaggtctttggaatccattcctttgttattttccatatgccagagttttttagaagcaacacagatgggggtgtgtgtatacgagtatgcatatatatactactgtactgctacagtaagagccaagtggaaatctagagatttctcctatcaaggaagctggatatatatgcccttcttttcaattgcaatatattaaggattggtaacttgaaccaaaaaaaaaaggtgagtgctaaccttagagaagtaaaacttctattttctccaagaagattaagaagtatgatattaaacaatatataatacctatcaacaagaattttaaaatgtatgtatatttctttgtgtttggcaaagcccggttcaactggatgactttgatgcctatattaaggatatggccaaagactctgactataaattttctcttcagtttgaggtgagttggttaaggcattttctaccttctgtaatggaaagggcctgggaattggggggtttgtgttgcggtcatgtccctgctcactggcagtgcgtaacaaaaagggtattggcctggggattgctgatctgctggtttagagcaagggttgtcaatccttgcttagtaggcaaggcctcaggtggcacaaatgagatgaggggaagaagagaataggtgcaggtactgaggtgagcaaacatgggtatagtagaagccatcattgaaaaccagggaaatcgagagtacaagaagaaaaatgcaagctgaggcatgaagcctgagacagaatttccctttcaggggatttgtagtgtttctcatgcttcttaggccacagtagtggcggatagtggataaaactgaccccctttgtgtcctgggcacataacatcctggagtagggcttttcaagctataggactcctggcattctacttaataacttttgtgcagttttattttctttccttggacaaattggggagataaagttacacatgatttgtgttaagaaaaaaattgacaacatctctttttttccgaaggacacatatttctttggatctaaaaccatatgtcagaagagatggaagtgagtgagtctaatatctcagcagtgtgggggaagataattagttctcactttttctttctacatattttatagctcataacacagtctaaatggccccccatccttcaggtttctatagcatggcttgagtggtcagtgattcagggaaaaggggaagataaagtgatttttctaaattctgtagttttttttttttataaagccttttaagtgctcttttctattaaggtagctgctttttcttcagtttttaaaatcatttctcctttccacttctcagccaaggacagctttagtctgcaaaaagcatcagtggtcctggtgtggagacactaatggggaatttgaggatgagaagaatcttatacattaccaaatacaaagaccgctaactaccacctgtgtcctgaaaaattccacacagagcctgctcacttatccattgtatccaggtgcataggatattatagatgctacaccaaatgctatactcaaagaaattcaatttgaattggaaatgaatgaggaggatggcatttcagaaagtatatcaaggaaaggaggactttttttctaagcaaacatgaggcaaaactctgaaaaaataaatagctagatgattctaacgatgatagaaattatggtatagctacacttttaccttattaaagccacattttcttaattccttcaagatggcatgcccttggtggcacagctggatcataacctctgctggcaactcacagtttatgtcttgaaacccaagcataactattactgtttctgaattgcatgaaaaaaaattcaacaagtcattttccagtaaacatattcttttagttgtgagtgacaaaaacatagctcaaacttgtttaaactaaaggaaagggggtttattcaaaggatactaaggtatctcatacaatcaaagaaaaggttgagtagctagactacgtgcagggaagcagcacagtttcagggatgactggagccaggggcccctctatttctcatttctgcttctctctctgttttggtttcactttgtttcactgaacaaagagaaacaaagagaaacgcagccagagagggcagatgtttgtgttcagtgaaacaacaaacaacctctttttctgtcacttttgttttgttttgttttgttttttgagacagtctcactctgttgcccaggctagagagcagtggcgcgatcttggctcactgcaacctccgcctcccaggttcaagtgattctcctgcctcagcctcctgagtagctgggactacagttgcccaccaccatgcccggctaacttttgtatttttagtagagacagggtttcaccatattgactagtctggtctcgaactccttaccttgtgatctagctgcctcagcctcccaaagtgctgggattacagccgtgagccacgatgcccagcccaacctctttttcatagtgaaaagcagccaacaacaacccttgagcaccacagccttttgtttccatggtttccaaagggaattactgtctgtctttcttgtttgtagtttgaaaattaacaggggaggattttgatggacgagcctgtgtcatggtgcccattcaaaccaatcacagccagagagggcagatgcacagaatctctaaatggaaccatgtgggctcaagtagcaaaacctaagaagggcattatctcccaataaagagagggtattgggagaaccaaaccataagcgattagcatgctatctttagatatcacaaaaatatgaaaagcagaattataaattttatgtgctaaatgttcaatttataatatgctgagggcttttattcattcaatggataaatgaatacatttagcctgacttcataggatttataagaaatgtgctaaactaggaatctaaaatcctgaatcctcactacagtgttgctactaattaacattctaaaaaatatgtttttttcttaaccaattgatatataatgagtttggggtgggcttgggggcggatgatgtattagctacagattttttatgtagtgaacatgctcatgtataagtttcaatttatccaactactttgttggaataattcttatggattgaaactgcccaggcaaagtatatacaaaatctgcattttgagtaaatttcccataagtggagtaagttttcccagtgttcctaaaactatacaaacagtatagtatagtatatacttcctaaaactatacaaagagtagatatcaacatttgtaatcattgataatgtaatattacaaagaaattgctttctcatctgttaacgttaagctacatcatcttcatatagcactattagtcatttgtgttatttcattttcctctgtttcttttattttcatgtaccttataatcttcatcattttgttactgatttctaacagctgatttatgattaaagaggttaacattttgtgaagggctgaaaatgaaataccatttttttctcatttttttacattggggttttatttggagtttgtacagaagttgtgtatttaaaaaataatcatgttctgcttttttttaagtacattttctcatcaccttagtttctttatgtataaaatgggtgagttgaactagatcaatggttctcaactggacaagtaccagtcagcccccagatgaaatttgaaaatgtgtgggagtgtttttggttgttataatagcttaggaggaggatgctaacagtattttatggaagagggacgaggcgttaaatgctcttcaatgagtgggacattcccgcacaatagagaattgtcctaggccgaaagtgtttgattgagaaatatgggttaaatatgggatgaggctacaatcaagctttataacccatgtgtattagtcatgggttctccagagaaaccaatgggatgtttatatagaacaaatatgatgtatatatagagagatctattttaaggtattggcttttgaggttatggaggctgacaagtctgaaacctgaagggcaggctggcaggctggagatccaaggaaaagttgagtttgcagttttgagtttgaaggcaatggggaggcagaattcctccctccttgtaggacctgtctcttctcatcaggccttcaaactgactggatgaggcccagccacattacgtagcataatcagccttcctcaaactctacttacgtaaatgttaatcacatatgagaaaaacaccttcacagcagcagactggtgtttggccaagcaactggacactatagcctagtcaagttgacgtctaaaattaaccattacaccacgattttaaagtctttaatattgttatttattatgatgctctcttcatacatttctattcttagaacattattggtcatatatgtaattaattgggtggtaagtcctgacattatttacatattctggtaggaaaatacaacttactctctagggctctgttttaagtcacaggcttagactgtatgttttggactaacatttgctcaagcagtggcccactggtccaatttacttccttcttcatttgacagacttcagatattaccagtcctcagtcccattctgccccctacatcctcagggtcagcgtcagggtttcctcatcaattttcatagaagtagtgtgctcccatgcctgatttcaggatgtatgctggacctttcacatggcagccctcacatttttttgaaatacattgatagttaattgagacttaaggaaaaaaatgttcctaactctaatgagaattcaagagggtatgagatggccaaatcaccttggtctagataattccagcagctgaacttgtacttgttctgtttatattaatgcctagtatttgtattcattttgatactgacattgaaatatcacattcacattgagaaatcacatcatttataagcattttgcaaattgaaactaatgtctggatttatagatactaccaatacagccataagtcatacatgaagctatatgagttactaatttgtgtttactgaataaatttcttttttactctgaatctgattttaaatctgctagaaagattgattatccttctgataaaaatatacaccgttcctttaaaagtcttgggacccagggattaaaataggttcctcattttttacatttcacatgggaaagattttgaagaaccagactttatagctgaaatgtgagagcccagaagacatatcacatattgctcattctgctattaatgtctgtgcttagtgtttgatcaggatactagtaaaggccctcaccatctctgttcagacatgtggctgcaaagatcaaaacaaaactacagaactggccatgcagttcacaagaggtgacctttgatttctggtagtagcttttacttgctatagatggaacctcttctgtcaacaccactggcactttctttctcctcactttttccaccccttatggacacgtaatctagtaatcttagtattgtttgaataaaccccctttcctttagtctaaactagtttgagctatgtttttgtcactcacaactaaaataatgtgtttactggaaaatgacttgttggattttttgtaatcatgcgattcagaaacagtaatagttatgcttgggtttcaagacataatgtccaccctatcccaaagcaaacaccgaaagcaaactctcacctgctgacattgttacaaaccctaagaccagaatgcagattgtgctctcctcagaagatgatattgcaggttatgggctgaatatctgtggccccccaaaattcctatgtttaatccctaacccccaatgcaatggtatttggagatggagcccttgctaagtaattaggattagataagctcatgagggtgaggacttcgtggtaggattgttgcaggacttttccttagttcagctaaagatgaggtccttgtccatcccacagccatgaaaatttaggttcacaggcaatttggagggtgagtaaaacagggttttattcggtgaaaaggaagaaaagggagaaacagggactctcactaggctggagtccctgctagagcacttcccactggcagcttgaatctcaggttccacacaggaagaggaaaggccaggttccttccccactgcaaacatggtgaacttcccgaggctccacctctgtgagcaggctagttggaatttctccaaggaccccctcccacctgactgtctcaggatcagccaagataagatgcctaagaatgaaatctaccttgttgccatcttgatcttggacttcccagcctccagaactgtgagacataaatctctactgtttaaactatcactctatggtgttttgttatggcagcccaagccaactaatgtaatgtatatgcttgtgctttgctttccaagacctgtatgcttcaaacacagccaacaaaacgtagcctgctactgggtttgggtgaccgtattagttcctatggctgccataacaaattaccacaattgtcgtggtttaaaacaacagaaacttattctcacaattgcagagccagaattccaaaatcaaggtgtcagcagggccacactccccctgaagactctagggaagaatttttctttgcctctttcagcttctgttggccacagcaattccttggcttgcagctgcataactctgatctgtctccatctttacatgccttttcctcttctccaggatgatctcatctcatgttctctaacttaattacaactgcaaagacactttctccaaattagatcacactcacaggttctgggggttaggaggtagacgtatctttttggggatcaccattcaacccactacagatgactgtatagcctagaagaaaagggtgataaattatatttagaaacaaaactgacaaaagaaaattcagaaatgatttatgtgggtttcaggtccatcactccatagtttgtcttcataaagatttaagccagtggaatttccatatggttggaaagaaaataacttcaaagctgctgaactggaaacttaatattttattttccacttagtgacaggctaaattacaaaggcttcaaagcatactgtgtttacatgcagttcccactttgctgcaattcaactttggcaacttccacttacagtgttcagccaattaaacctctcttatcaacttagagtatttacagcaggaaggcaacacacaattaaagttctgtcagttagtcagcttccacaattaaagttctgtcagttagtcagcttccacatgtgctcaaacgctcagcctcaatctgtttccaccattccttttgtatctgaggccttttcccatggcttatcagtctgtccccaaagcaagagaattgggggaagagttgttggtctgctggcataaatggcagaggaggaagaaattatggagccaggcaaagcaaaacaaagaatcatcacaaaagtattttacaatgatcatcaatagtgctgtattagtatttgttgagttaaattattccatttgataatcactataaaaaaggaaggtgtggagaaattactagccttatcttacaggtaattaaagcaaagtttaaaagagtttaactacccttccaagaacatacagtttataagtggcatgtcagaatatgtgagatattttgaaaaaatatctatgcaggcattttctaaaggaggtagatttctgaaataatttaagcaatggaagcatcatttaaataaacttataactaccaaaaggaactaacctaaacatcacactgatttagttgaaatttactaaaaataagttgcttcttacaagaaaaatagagtcaacctttgaataccctttaaaatggaacactcagttataaaataacaatgggaagcatctgcctaaatatatttggcaagtaagtgcctgagatggaaaaaaccaattttgtgagttgaaaatcaaatgtaacatagtttgtatataaaactgacatcaacttagtccaaagaacttcagatattgtcatcttgaaaagccaaaagagatgaggaatcaaaggaagagagaaatctgggcaatttttgttggttcatccatgttggctacagtcaggcaacccaatgccattaagcgcaaggtaatttgccaccaaggatcttctagttaaaagcatcagaagacccaataacttgattaataaagcatgtgctttgcaaagagcacttgaataaagacacaaagggcatgaaacagatatccctattcaatcctagaacgtggtcaagtggctccaattctcttcaacagtgttaaaagaccctccgaaattcttctcctagggaagtattcctccagctttgattccttgaagtaataattgggaggaattatgaagagtaaaacttgtgctcaatattaacattctataaatgtaaataaaatttataacaagtgatttttgcctcgcttagtagtcttatagaaagatgcacactatgtgggtaatcccacttatacacagttatgtacactgtttactaacattcctctaacatttgtataggaatataactagatccactgcattggttgcacattgtacaactccagtgaacaccgttcatatagaccacaatgtgaatgatgcctccaagaaatacaggtggcctgaccgtaatccccgtttcctgtaagacacatggcatagcaacttagaaatccccctttccccataacataccctttttgaagtgtgacagttatttatataaaaatttcccatcagttcaccttctgaaatgaggtttataagagtaccaatatacgcaggcagacatttggatgttcttattctcactgaaggattttccccaacaactacagatccatctttatgtttgaggtttcattaccagatatttagtgactgttaatcccatactttgtaacatggagattgttccctactcattcctcactattttttactactttctctaaggctcattgcctacaagaaaaaaaaagcctagatttcttcagagaataggaaatatttatacaaattgcataaacttaagttactctattcctccaaaaatctgaaatgcatttttattttcaaatatttcataccctgagtgttatacatatagttcttacttctccaaatgaccactaagttatccaaggtatttatgtgttgtattagatagctattaccacaataatgctgtataagaaacaacctcaaaatctctacaataacatttacttttctcactcatgggtctgtggaacagctggggcagttctgcttcaggctgtgggtcagagtcaggtctgccctatgtgcctcctcattctcggactagcagcttccctgggcatgtctttttcagggtagatggcaggcacacaagagggcaaaccaaacaagcaagtgcattgaaagcttctgagtggacttgatttctatctaagatcattggccaaagcaagttgatgatagtggggtggagtaccttccacctctaaagggagctactgcaatgtcatatagcaaagggcttgtgagcaataaaccagtgtgaacaataatccaattcacaccacgtatggaactctcaaatccattctctgtcctttacaggagttgaaattgattggactggatatcccacactttgctgcagatcttccactgaatcgatgtaaaaaccgttacacaaacatcctaccatgtaagatcgtcaattgtgccaataacactcatgtcttaagggttgaaggactgtcattgcagattaatcaatttcaccaatctctggccatacccacttgtggtccggatctcaaggccacgtctgagattgcattgatctcactctcctttgatgtctttagatcttagcatatggaggaagatttaattattgtgcttttaaatgaattgcatctgaacaaaaagactgatcatttggccctttagagattaaagagccacagtcaaattggggattggatcatttgtactctcataaaatattttcagccaattcattggtaatggaaagaggcaaatgggaaggcgatgcagtatattaaaatgccttctctaacttctgacaagttatatagttgcttagcattttgtaataaaaagcagcattcaaggaaaaaaaggtaatataaagcacttacaaaacaattaaaatacattccagtttagatttcacttttctctctgctacacgctgtggagctaggcatgaatggaaaagtgagaagagaaaggctgaaaaagctctagaaagagaagtctcttcttgatatggtttcttgatgaaattagatatattatcataataacacttcacatctgtacacagttcagaaattacttctttaatttaatgtccacctacaaaagaaacccatgcatcttctgttctctaggtctccttaaagtagtgaactctctggatatctctaggtgaaatgaaaatcgtgtgcttaggctatatactatagctgtccaatcaatctcacagatattgtagttcctgaaatactctgaacaacacctaaacaatcctggaaacaattctttcaaggacaggagagctggtagtgaaaaaaaaatagtggttggaagatattcacttatttatttaaacaacaaaccaaagttgaagaatagctaaaatatcaggctaaaaattattatctgcctactctgtcactgactgatttaacttaatattggatagaaagggccaaaataatttttccttccatcttgaattttaatatttttttctccttattctctacagatgacttcagccgtgtgagattagtctccatgaatgaagaggaaggtgcagactacatcaatgccaactatattcctgtaagtagaaaaaaaaaatcaggcatcccaaagctaaccagccagagaaagactagcagggctataaggatgtgtcaaacagttcaaaagagagcctttcccaacccagcaattgaattctaaaaagtttgcattactccgtttcataataaagaatagaaagaaaaagtccatagattactaatgtttctatttctttataaaggtccagtgaaagggaaagtagaaaggttaaagatcacctctcttatgtttaaatttcacattcagcaaccaaattcaaagggttccaccctagcacctgcacttttaaaatataaagacagttattattgtcataaaaaggtgtggatgtgatttttacagccttctggataacaatgcttacaatcacacagactaattatggtcagttattctgatagcctctttgattaaaacaggagaaaacattacataggtgtgtgatcctttgccaattttatcaccagtaagttttcagtttttttcccataggcgtgaagcagcatttggtgttgacagtgtctggttaggtgataattttgtcacttatctttcagggatacaactcaccccaggagtatattgccacccaggggccactgcctgaaaccagaaatgacttctggaagatggtcctgcaacaaaagtctcagattattgtcatgctcactcagtgtaatgagaaaaggagggtacgtacttactgaaactgctcccacttagcagcaaaacctgccctagccactgccgttgatgaaatgcttgctgttttcaaagtcaaataaaacatagagacaaatcgctaaatttaaaacattgtattcgggaagcaagaattagaatttgggggtaaacacacagacccggtggtctttgcaatgtctaaaggaaaaaagagaaggttggaagtcttctaaaaaggagaaatattgcatattgttttgcaggaaagttcattagcactagtaaagttttggggagctggcaagctctgattggtgaatgcatggtggtgggtaaaactagtctcagagtcccaacaggctgtttcagttgctgttagataccactggtttcaagttactaaaggcagtttcagcaaccggggcttacagagaattacattcctggaacaatgttatgcgttctgagtgctttctttttttttttttttttttttgagacggagtctcgttctgttgcccaggctggggtgcagtggcacgatctcagctcactgcaaacctctgcctcccaggttcaagcgattctcctgcctcagcctcccgagtagctggggcattctgagtgctttgtcccctgacccctcaactctgttttagttagatatgataagaatgacccaagtcatgtgataagaattcacactacgtagcagaaatggtttgctttatgtttcatcttcaccacggtcctatctaattctttagaggcgaatacctttgttttccctaagtgagcacacttaattcctttcctagcctgtttgttttaaaaaattgttttgtccttgctccaggtgaaatgtgaccattactggccattcacggaagaacctatagcctatggagacatcactgtggagatgatttcagaggaagagcaggacgactgggcctgtagacacttccggatcaactatgtaagtcaccaggcagagagcaggtgctgtccctatgctgacacctgctgagaccagtttggtcggggagaccctaacccagcggcgctagaggaattacagacacacacacaaaaatatcgagtgtggagtgggaaatcaggggtctcacagctttaagagctgagagcctcgaacagagatttacccacatatttattgacagcaagccagtgataagcattgtttctatagattatagattaactaaaagtattccttatgggaaataaagggatgggtctggctagttatctgcagcatgaacgtgtccttaaggcataggttgctcatgctattgtttgtggtttaagaatgccttaagcggttttccgccctgggagggccaggtgttccttgccctcattccggtaaaccgacaaccttcagcatgggcatcaaggccatcacgagcatgtcacagggctgcagagattttgtttatggccagttttggggccagtttatggccagatttgggggcctgttcccaacagacacctacaccaccaccaccagggaagtgctgggagaccaacccaatgagcactttgagctttgcattgctgcttccttcaagaggaaaaatccattctcagtgtcattgtttcccatttcatcagtgatggtgtggatgatatggttggtctggagaggctgagaagacgcagtaaaaagtctgcactagttcatctcgaattagctcaagatcatagaagacactattaatcattgtttatgaggcatcattgaggacagaagtgttctcattacttatattaatcatatatgagtataattggggtatataaggcacacttatgttttaaattaaataattaaaccctgatttagtagtttgggttttgttttgttttttttcttgttttgttctggtttggttttcattatttgtaaggtacttctaggtcttattatcataattccctatctctcttgaagggctattgatttctgatggataacacatccaaaaaaaatgtctgtttttctcacaaggcctgacacctttctgctgacaagtctctgagcaaacgctgaatatttctgtgacaggcttaggtgttaacatcaattgaagtcatgccattgacctcagcctatagaatatacagtttttactattaatagtcttctccacttgaacatgctgtctatgaagacaaaattgaataggaaagttctcactgagatgttcttccctgcttagaaacaatcctttctaatagttaaggaaatagcaaactgtagcctgtggaccaaatttacccactgccttttggataaagcccatgagctaagaatggtttttacattttttaatggttgaaaaaagacaactgagtatggtggttcatgcctgtaatcccagcactttgagaggctgaggcgagcagatcacttaagcccaggatttcaagattgcctgagcaacacagggagatcccatctgactaaaaattcaaaaattagctggtgtagtggtacacacctgtagtcccagctactcaagaggctgaggtgggggaatcacttgagcccagtaggtggaggttgcagtgagccaagattgtgccactacacttcagcctgggcaacaagagcaagactctatctccacacacacacacacacaaaaaaaaaatcaacaagaaaaatagtattttatgtgaaatgctatatgtaaattatgtgaaattcaaatttcaatgtccatatataacattttattagaacacagcctgcattgttgacgaattgtctatgactgcttttgtgctacatcaagcttgagtagctgcaaccaaaactatatgatctgcaaaaactaaaatatttactaactgtctctttgcagaaaatgtttgctgacccttaaaataggcaatggaaacaaagattgcccgtatcaatacaacgttagaacttgatactacctactgattgatctctacaggagataaatcacttcttagccattgttaattgccacttgttaactggcagttaacaatgtcttttatgaccaggagaattcaggcaaatccccgtatgactctaacaggctgtgtttcgtgttgtttcggtcatttaaaattcacattgcttccttgttaagcacgtttttactcaaatgcagagtttcagcttaagtgtcaccccctttgtggcgtcttctctgggcttggacaccgttagcccattccttctctggggcagagtcttaagtaagctgctttatcacagcacaccatagatagttacaattctcgcttcttgtgtctgcctccccagtatactgtgagtttcagaagcaagtgctgtatccctgtggaatgaataaatcagtgaatgaatgagttatttcaaaaataataaggcacttgtaaagcatcaatagactttccgtcagagaaaatatttgtcaatccaaatgccatttgaactctgttttttgttcttagatatttcaattgaaaagccagtgcaaactgataaccaaatacagtacaaatctgtccctaggtttgcacgtagtagaaaaaatttcagagcacaaaatagggtctgttccattgcctattctgttgacaaagaagagtcacatagattattgctgggtcagtactatgcttcttgtccttggtcttaagtgatgacctatctttcaatgacaatcatgtgaaggacttgaaaaataggaataaaacattgaacagtagtgtttgtttgtaaggaatttacttgttacaagcgtctggtaccagagtgcccccttttggccataagcataatgaatctaaatgttaagctacaatgaaggctaagttgcccaaagaacattgtgctatgctaattaatatatttttcaatttgtttcattttttgtttatacccttctttatccattccatattgatatgtggaaactttccaattataaaaagataaaattacataaataaggaactcaaggtaagagaaatttaggaatagctaagtaagataaaaccagaagagttttctcctttaacaagaaaggagagaaatgaccataacacacaacttgtcactttctactacttgaaatttggcatcaactgagtgagagctggagactaaagatcatcaaaaacgtgtttgttgccagggactttgtgccctgctattcagctcacagggctgaccccagttccaggacccctgccgtgtagctgcggagaaactaactacaatttaatgatttcctgattttaaatcaccttgcactttttaactgaatacattttcacttcaaccgtactggaatatatatattggctacaatgtacacatgttatacaaattatgatcagcatttaaacagggcaagcattttcctgaactttcctggcaaccaaagttatctggtggctgagtattcttaaatcctcatgatgttgaataagtaaattattctgcacaattctttatgcccaagatagtttctcaacatacttcctgaagagagcagtgagggtagccagcgtctttgtagacttcatgttctgtgtgtctaagccagagcccttgaacatagtaggggaggcactgcatgctgctggggatatattaggtgccaagggtacaatgggtgtaggggaggtgataacttatgtatatttaaacaaatcttacatatttatttatacattttatttatgaattgtctttatacgtttattttctgcccaagaccactgactctttgaaattcatttctctttcaatacctgaacttaaattttagctcaaaactgacagcgaggccaagcttccctccttcccagttatgatatagtattccagcctctgagtgaattctaggctcttcacaagtttgaggactgagggatgaatcagacctttatgaagcctgggtttgggatatttctgatggttgataacaagtggagaatatgtaactcttacaagttagttgggactaaaaagagttgatctggaaagatatacattctagttaatatgtactcagttcagagagaacaacaatatatttgatgtatgggttaataggaataggaaaatatacaagttatactcacttactggggactcccagaatcaaccatacaattgcacggagctggatgacggtgagtgatggtaatgaggtactagtaagtagtaatatcacacacatgattacacttaattcacacaacaactcttgttataagtatcattaggccatttttagatatgagaaaactgaagctcagtgagtcaagtcctctagtatcaaagcccaagacaaggattctcatataagtgattttgtgaaagtgcattcttagggaaagcccataagggagcaagggaagcagattgacagagaagaagccctacagagcattcagctgaaaatctcacctgtgctggatcccacagagagtgctgggggcatgaacagcaccatggtactgtctcactctgaaaaaggctggatttttgtaccccacaattagtcagtcattagctgtgggctgccctcagcaggagaacgcaacctcttaggcattttctatcgaggcagctctgtgcagtggaaggcaactatcaagagataggtactgctgtgctgttagcagcaactgggaaaagtgtgtcccaggctggcaaagtgtatctaaagggcaccaacagcactttctacagtgtttaattcattagccaaaactgatgcagcttctaaatgacagagccaggatgcaaaccctaatctgcttaagtgttgtccacaggtacagattagcctacttatcctactatttgaagctttatacaattagcgtggttttttttttcaatacctattttatgccagatatggtgctcaaagctggaaaggaaagtgtactgaccaggagtggaacgtggctctacctttttgcatgcttaactagcagagtcctgggtcatcctaacagtgaactgaaaaattaatgcttgtttttggcttttttctctaaaggctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcaggtaacctcatcaactgcattttctattaaatattaggagttggttttgtaaggggaacagctcaccattccataagcccttatcaggtttagttgaaaattaaataaactctgatgttttttaaactatgattaattgatgtctcactatatacaatgtttattctggctttcctgtatctataccctataaaatagatgttattattccaatttttaaatgaaaaaaatagagaagggtagagatgttaagggattcacacaagttcatgcaactagaacatggaggagttagtattcaaatccaggaatgccaatctgcaaagatcatgcccttaatatgtgatattatcctactccatcaaggattctgggtagttacaacatggacaaatacaaggtcaaattatagaaagctgatcacagcttgacataatataaataggcataaaaactagaaaaggaaaagaaaaatgaaaatattcagcttaggaagataaacatatttgctatgattcctcttcgggattgtctcttaaattgtcagacagtagaatgaaaaaggatataggatataaaaaaatcaaggtccacactaattcccaacaggaaaagttatcattaaatttaatttgttcttcctactgtatgaacagagctccatcaaaatctatctctgtgatacaatattgctgtaaaatccttatgcaacctcaaaagaacaggggacataaacgtgctccaatggcaagtgagaggtggcagtgggatgaagatgtgaagggaagcattggcagccatgccaacctaagcaaataaatctacaatcccagacctactgccttggcccttgtgaattagaatgactagaatgaagaagtatatgtgtgcattcatgtgtgtttgtgtggagtgtgtgtctccctggaaaggaaaatgcttcataagctactaagtttctgtttagggcagatattgttgctgtcaatccactgtaggcattcacaggttaaaagatgtgctttagcaggtaagattatctgttctcaaaatggttcttttcaagaacagaaaatgaagctcttcaactctggggtcaaactcacagattcctttcatggaagatagtaagtgcagttctggatatgactttacaggtgctcacccaatggcagatcattttatctgagaaatcctgggagggaagagttgtctagtagaaaaagcaacccttaaactcaaggtttatagagtgggatttttctagcaaactttccatataaatttgcttgaactttctcttttcccatcatttcacagtgattcaaagctaagagccatttgactctttattgaggattagagggaaaaaagggctgacttcaacacatagaactagggactgtgatgggcagttggtcagcgcatgtcagtccacttccatctgtgccccgagcattgggattgggggactggctgagactgggtccaaatttttcatttgattttaaggcaactatctcaaaggtccctgtgagatggaagcaggcccaggacccactaaaatggcaggcatgctgtaaggcaggtctggggtggtgaactgaacttagggttgaagatacacaaatctctgtggtcccagacctagagttagggtatggacatctcaactggagttttgagctgatctgagggcttaactctgatgctgttcaaaagacagggtattgtttatgtgtatcagctctctgaattcagaaatcagttcccgagagtactcaacatggaatccctacttttctgcagaagcagagaccccgataaagggtgtggccaatgcagtgcaaatgtctctcaggaacgtagccatgatagtcagaaatgtgacattagaaggaacaccaaccacaactccatacttaaaaatcagttaagtggaaaatattgtcaggagcttagtctgcgtttttccacaagggtactatttgtagttttttagaaatcatcagttttatttcaacagtaaagtagcaccatctgggctggccgaggtggctcacgcctctaatcccagcacttcaggaggccgaggtgggaagatcacctgaggtcagaagttcaagaccagcctggccaacatggcaaaactccatctctactaaaaatacaaaaattagccaggaatggtggcacatacctgtaatcccagctactcaggagggtgaggcaggagaatcacttgaagccgagaggcagaggttgcagtgagccgagatcatgccattgcactccagcctgggcaacagagcaagactccatctcaaagaaaaaaaaaaaagaggggggagaaaaaaaagaagcaccatctgaataatatgccatcggaacattcttttgcagtgctggcgtgggacggacaggaacattcattgccctggacaggctcttgcagcacattcgggatcatgagtttgttgacatcttagggctggtgtcagaaatgaggtcataccggatgtctatggtacagacagaggtaggaacataatctatatgtatttttaaattttccctggactgaaaaacttaccattattcaatgatatgcttcaaaacaattctctcaaacttctttgtatctttctttcccattttcttattgtatatgttcaaactgctttgaggcataaaagaaatagacactagcctccagaaatccattcgacatatagtgattatacttttattggcatcataattcagagtgcatgggtagattcgtaagagtaaaacctctttgaacagactcagagtcaattgcagataacagccatcctgggtaaatgccaccaaatagagactgttgaactggtgaaatttgatttatatttgaaatgttggatttgattcaatacatttgtcattagtttatcctccgtgtgactctatcccaattcacttttgatgatgattagaagttggatttgagctttctgtcccttttatgattttaaagattcccagtccccaacctaccagcattgccagttcccttcatctcaatgatgaagatttattattttaacaacatggaagcatcccctgaaatatccaacagtgttacgtgctccgtcttcctcctcttctcccgagtcctccctccctgaaagcctgaggatgcacttagtctggagcgacaacccaaggcaacgccggcagacagcaccgcctgcctcagagcagccgtgggtgtgtacccttgtgggcgcaaaaacccaagtacaacagcttgttcataagcctcatcacccagccatactcgcgacttcttagcttcggtcttacaataatcctttttctcaaagagtatgtgtgggtggagcgcttgggtagaacacaacctggcccgacctgtaatcagggtatttttaaaatgctttggtcttcctcatgcttttcctacccagcaccactagatgtcagtatcacttcaaaagcctagagtaatggcggccgtctcagctgtttctgctttcccactccttttacttttctttcctcctacctccccattcttgtctgaccaatttttggcaaggctgtttcaatacattcatttctgaactacagcaggatcataccacttgggaaagagttatcctcgttaatattcagacctctcattgataattaggaagcaagtccaattggtttcctcacttggtttcaatcatgctgcctagtaatttagtgtggtggggacatcagtatcactttttaatcataagtttaaaatgtctggtttcccagaggagtccactgtctggtgagtaaacagtgctttattaatcggtccatatttttggcttttacttccataaatttgcaccttgatatgtgattaaaaatccacgttatgtatatgaatcaccaagcttcaaagagccacaccttattttaagtattttgcatttaatgaattgtctcctcaatttacttaattcataccttttacaacttcatagattttggggcctggcgtagtggctcacagctgtaatcccagcactttaggaggctgaggcgtgcggatcacctgaggtcagaagttggagaccagcctggccaacatggtgaaaccccgtttctactaaaaatattaaaaaattagcctggcctggtgatgggcacctgtaatcccagctactcgggaggctgaggcaagagagttgcttgaacccaggagacggaggttgcaatgagctgacatggtgccactgcactccagcctgggcgacagagtgagactccatctcaaaaaaaacaaaaaaaacttagtagattttaattatggcctgtttgcttttgacttttctccaactacagattcttaatctctttcacatgacacatcctccatcccatttttagggtcattatctttctttgggtggttatcaagcagccaccatgtcgctttctgcaaagccaagaaaacgttttgttttctccctaaatgttttaccctaaattttggttgttttatttgtttatgccagcattttatgttgatatctccgcggacacagcctttttaaagtacagtatccccatcctggccaacatagtgaaaccccttctctactaaaaatacaaaaattagctgggcgtggtggcacacgcctgtagtcccagctactcgggaggctgaggcaggagaatcgctggaacctgggaggcagagcttgcagtgagccaagatcgtgccactgcaccccagtctggtgacagagcaagactccgtctcaaaaaaaaaaccccataaaataattaattaaaattaattatgaaataattaaataaaaaataaagtgcagtatcccttccctgaactctcatggggagttcaaagtcagcaaagggggcagaggttccccgggttacttactttttccaacttttctagcttgacccttgattcccgcaggacttcctggtggatgttttccagttccagttatttatctgtgtctttttttttaacttatgtctagaacatcttcttcatttacctttattttttccttgttcctctgcttaccatggttcatcccgtattttgaatacagattgatctgcctaagattctccttaagcccattcacattcaaattctgctgccaggtcacaaaagttaacaaggaaagaacaaagtaaaaaaaggttattcttttcacatgtatcatcctagagtactcctttgacactaatgattttcaagagaatgaaatggttctccacttgagctctgtttttatgtatataatcaacccacatagaccatatttcctcccatcactggtatctaattttccagccttctctacattgccttgaccccaccattccacctcacccaaaaaattgcagaagtagctgataggatgagccatgtctccaggtgcaacatgctgcctggactgcactgtgacctgccctcttcctcttcctcacctgaccagacacacttcatagacttcttcacgcaagtagaggcgtatttagaaagaatgccagaccctgaggggagcctgaatctccactttactgctgcacaagtcatgtcacctctcaaggctcccatttctcttctgtaaaatatgaatgataactttcactaatttttgtaaagcagacatgatgggaaataatataacctagataagtgatttgaaactgtgaagtgctacttatgaatgatgttctcctctcttctatttttatcgaatattttgtttggttttcctctaatatccttccctggaggtcagttggggctttgctttgagcagcccatcctcttgatctgcagtttgaatttcgggactttcaaggacaagtccctccataaatagtctttatttacttttcttgtggtcttgttgtttggttgttttttgttttgatacaaaatgtagccactaagcagatgcagattgaatgtccaggcaatctctggtcttatctattccctgtgttgacataacaccagaaacaatggattaggtgtccatgtgtgatgaccacaaggggtagctcagccactgataggataccatcaccacaaaagggaatatattttctccaaaccgtgttgaaaaatacaggttaggctgaggcatcaatccagtgatgttcgaaatattaattttgttttttgtatgaagttgttacacaggaagcttcttaaaatcctatgaatattttgaccggatctcatttaaatgttatttctagtgctattacttatagagaaactctgggaaacaaagaaaaaggaggaacactgtgaaattacccttacttcttggcagaaagatatattttggtgatttcattttggctttcattcaagtataacttttacatgattgtgctcatattatatgtatgtatatatgtgtgttactttacattctatttacattgtagtttctcatttaggattttactatgtagcctgtatagtatcaaaaattacctacaactctataaatctcattttaaggacagactaatgtttcattaaagatacactattgcatacttaaaccaatctcctttttatagaacattaaattggattattttccactttttactattatctgtgtccacaccatttattagcactttattaattctacctccacaaacaataggtaaaatggactgcctcaacaaacttgtcatcattaaatattattcttttccttctagctttgtccactacatagatagaaaataattatttcaatgtactttgtattacttgactattgttggcatattttaatatttcctcagtttacttcaaaaatcatttaataaacacagctaagtgctaagcattaggaataaaaagacatagtttctaacttccagggaatatttggcctagtggttgatgtcctttacttatttgtctatttgtatatgttactgatttgaatgactttatcacaaaaataaaggcatcaatattctgtcataattctagaaaatatttttctttcccagtttgtggtttaccctgtgttttattctttttaactttttaaaatatacagtagattgagatttttatttgtaatgtattctactgctcttaattttagaaattcctttcctaaaggaatcagagagaaattaaccaatattttcctctgtatttttaaagacaatttattaaattacctggaatttgctttggtgtatgataatgggatatcctttttttttcaaaatagccccatgatttgattgaatattcatttcctttagcattaataatgatttaatgtacagcatggtgaacatagttcataataccgtattgtatacttgaaatttgctaggaaagtagatcttaagtgttctcaccacacacacacacacacaaatatatatacatacatatatatgtatatatacacacacatatatataaacatatatataatctggggtgatgaatgtgttaactagcttgattgtggtaatcatttcataacatatatgtatatcaagtcatcacattgtacaccttaaatatatacaatttttattatactgcaataaagttaggggaaaaaaattccactgtttttttaaaaaagccatgatgttctaagctctgttattaatcaaaatacttgtacagttgattctcttggattttctagttataaaactgtgtctctgtaaataatgaaaatggtttcctttaacaccagatcttgatcattaaaattgtcatagtataaaatattatatctttgcacatgtctgctctgaaacctgtttttgtcttttgttccaggagcagtacatttttatccatcagtgtgtgcaactgatgtggatgaagaagaagcagcagttctgcatcagtgatgtcatatacgagaatgttagcaagtcctagttcagaatccggagcagtaagtggagaagagctctccacgagtgttcagtcttagaactattagagggggatgtgatggatgggacaaaagacagcagtagccatttgtattgactctgacttcacatgagtatttcttcccagctcctggcctcacatgggtggtcacagggagaaacaagtactgtagcagatctttgagtttcaatgcaccttggttggtgttggcaacaaacaggagcttctgcacatcatgatgactttacctccattccctctacccagaaccctaaattattctgttattggatctgtgcctgtaatatcaggatactaccatccaaatctatctagatatcttgtgcaaatattttattgattacaagggctgtatacggggttacaaaaagacatgagctggattggacactcctaaaaccaaaaacaacagtgacaatagagtctcaggatagcagagtctgaaaataccttggtctcccccattatgtgagcccttatttgagagcttcatgaagacacttgtaacatattcaacgtcctgtactccagttttgactacgagatcagattttggaggtgtaagtaatcttggctgaggtaacagtaatctgcccatttagttcagtaaacagactgtagagtgtctgactatactgggggaagaggagccaatgacagggtagggagatgacagtggtgcatgatgggagaatcatgaaagtctgggaagcatatggaccagtgggaaggataggattagcactgcacctctacatccatcaagagagacagagcgcacaatggagcaggaaggataaaaaataaagaaagacagagacaaacaaatttgctgggagagggaaagacattcagacccacagaaaggaggcagcacacagagaaagatgcacagatcaacccacatctgcatgggttgtgagactgagcatagtgagagcagtggtggagcaatagaagattgctgtgacaccaggctgcttactgtctttctttgtctcattcacaggagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaactgtggctattgtgagcctccgtgtgtgtgcttccaggaggctttgctcctcttcatgcacccgacactgccccttccctggcttccctccatccctgatcatcttcatgaagccacagatataagatcagcttaatattttatcagtgaccttagtgttggtgaaggatgccaaatgaacagctctgcaccccaccgtctcttgtcactgaaaaggcttggccatggcagaccttggcagagtttcttgcaagatctggccagtgagtctcagtttcaccttgcagggtgaatggcagaggatgcccataccctgcaggttaacagcttgggctcctcaggggttgtcagttcctactcacctccctgctaccacctcctcctcttcttctcacccccgactcctttatttccctttttggacattttaataatatgtcgcaccattctcaggaacaaacatggttaatgaaaggtggcaaagggatgtgtgacattcttagattttcacacatgggcagtcaggagtgaaatgtgcaaccttggaagagctgatacaatgtatggtaagctgaagtacgtttccaacactgctgctcagagcatacagaagttttgcatcctggaacattgcttcccatgaaacaaagcacttcataaatattttatgtttttcttgagcaccctttcaaggtagggatcaaatagtgccagatcaattttcccaaaaggaaagaggaagtatccagagtttagactgaaggcttagagtcaaaactacaggaaggtcacactgttctctggaacactgttgctcttcagtttgtagagtttatgatggaaaaggcatcagtctgtcaaaagacttgtttaatcctgataatgactttggaattatctctcctgggtctcagttaataaactgaagaatgacctaatcataactccatatcttgcaacaggtataagaagtatcagatacgataattgacccaaaggtgctttgtgtcttgttctctcatgtatgttccgtaaggctactctaaccagttctgtttccacaccaggacccaaatttaagcattcagaagggaggcttccagagcctctgtattattaactagggtttttaaaattcatttgagtaatgctttgttctaaaagaacacaggggccttagtgcatgtgttcataatagcctgtatggcacacaaaaagatctaaaaacttgagcgttacaaaacatttcattttgagtgctattttttttttctttttttttttgagacagatcctctctctgttgcccaggctggggtgtattgatgcaatggcgtgaccttggctcactgcaacctccacctcccaggtttaagcgattctcctgcctcagcctcctgagtagctgggattacaggtgcgtgccaccacgcccagcgaattttttgtatttttagtagaaacagggtttcaccatgttggcctggctggtctcaaactcctgacctcaggtgacccccccacctcagcctcccaaagtgctggaattacaggtgtgagccaccacaccaggccttgagggctattgagatcaaattccttggctgcaaaagataatttatgaagttaattgagaaactaccattaggatctaattaataaatgtaatagttgacagcagtatatccattacttcatatgatgatttcgtttaacttgaaaaaagtgatggatgacagcattttttggaaaagcattttaattcggggtctacaatttcccactgtaaagacaacattgcctccaaaatgtaaaactagaaaagttactacttttttttaatgtcagattttataatgtctctcctttcctaaaagctgttcctactcccaaaaaggtgacacagctctcaaatgaggctgtggtgtcaacaggcaaagcaggatcagatgctttggatttgaattttctgcaggctacttgatagctgcttgctagaggattggccc

SEQ ID NO: 14705 - DNA, 55061 bp, Human; identical to SEQ ID NO: 14704

SEQ ID NO: 14706 - DNA, 55061 bp, Human; identical to SEQ ID NO: 14704

SEQ ID NO: 14707 - DNA, 55061 bp, Human; identical to SEQ ID NO: 14704

SEQ ID NO: 14708 - DNA, 55061 bp, Human; identical to SEQ ID NO: 14704

SEQ ID NO: 14709 - DNA, 55061 bp, Human; identical to SEQ ID NO: 14704

SEQ ID NO: 14710 - DNA, 16520 bp, Human
acacctgctactccgtgtggccgggtccagccccaggcaaggttccaggcatgcccctgggacagacgtgggagggagaccagcaggcaggtccccctcagggaggtatggagcgggtccccggggccaggtggagcccctcacacctgtgtcctcaaggacccacaccaggacaatggccataggcgggcacctgcagccgccctggccagcagtgagacgggcagagagcccagccagatagcccggttcctgccccctcccgcctgcccgcacagagagggctgcatgcaggtgagggtccatcacctgaagagcttcaccagccccgaggccatgagccactgaatctctcagggggttttggcgcttgaggttccccaggtcattctgctgcccagagagggttgaggacctctgacctggagccccaaaggggaagggtaccctaagaccagccagccatctactctcaggtgggaaaggggtagggtttagatatggccccctcccctccacgtcctgaaattaccttgggctgtgctggccgagagccgcggggaccagatttgagctggacgtgagctttattccagacggagcagctactttgtaagcgatctccctgggatcgatatcatggaggggcacagatgggcttcagctgtgctgggtggaagagaaaacatgccctgtcggcccctcagcaagtgctctgctctctggactgagatgcaggtcagcagcaagcagggaggctttgggggtgctgggggctgctttgaaaggcacccctgagctaagacttggctgttgggaaggaatcacctccctccctccagccgtaaaaagaactggacatcagcttccaaagaagtcatcagcaatgcaactgttcacatggaggatactccctgcttgaggggtcagacaggcctgctgggcaacccaggaggcttggatgaccgtctaccccagtgtttttgggatggaaagttccacattctgagaaccctcagtccctgggcaacctggggtggttagtcaccacagcttgtggcttgggcccatgacagcaggtagaaatgacgtggactgccgccagccgggcacagtggctcacgcctgtaatcccagcactttgggaggctgaggcatgtggatcacttgaggtcaggagttcgaaaccagcctggtcaacacggtgaaaccccatctctgctaaaaaaaaaaatatatatatataattaatatatatatataaattagccaggcatggtgacgtgcacctgtggtcccagctactcaggaggctgaggcacaagaatcacttgaacccgggaggtggaggttgcagtgagattgcaccagtgcactctccagcctggcaacagagcaagactctgtctcaaacaaacaaaacaaaacaaacaaaaagacgtaagatgtggaccgctggagaatgggggtgctgcctgcagtcaaaacggagtgggggtgcccagctcagggccagaatgatcctattcccggcacttctcagtgaggctctgtggctcacctaagaaaccagcctcccttgcaggcaacggcctagctggcctggtctggaggctctcttcaaatatttacatccacacccaagatacggtcttgagatttgactcgcatgattgctatgggacaagttttcatctgcagtttaaatctgtttcccaacttacattaggggtttggaattctagatcgtatttgaagtgttggtgccacacacaccttaacacctgcacgctggcaacaaaaccgtccgctctgcagcacagctggggtcacctgacctttctcctgtcccccccacttgagctcagtggctgggcagcaggggatgcatggccactggccggccaggtgcagctctcagctggggtgttcagaggacgcctgtgtcctcccctcccccatccctctgtcacccttggaggcagagaactttgcccgtcagtcccatggggaatgtcaacaggcaggggcagcactgcagagatttcatcatggtctcccaggccctcaggctcctctgccttctgcttgggcttcagggctgcctggctgcaggtgcgtccggggaggttttctccataaacttggtggaagggcagtgggcaaatccaggagccagcccgggcttcccaaaccccgcccttgctccggacacccccatccaccaggagggttttctggcggctcctgttcaatttctttccttctagaaaccagcatccaggcacaggaggggaggcccttcttggtagcccaggctttggcgggattatttttcaaagaactttaggagtgggtggtgctttcctggcccccatgggcccctgcctgtgaggtcggacaagcgcagggagtctggggcctctcagagtgcaggaagtgcgcacagggtgctcccaggctggggagcacaggtaggggacggtgcgtgggggatggcgcctggggcatgggggatggggtgtgggaaacggcatgtggggcgtaggggatggggtgtggaggatcgggggtggggatggcgtgtggggtgtgggggatgggccgtgggggggtggggcctgggaaacagcatgtggggcatggggtgtgggggtgaggtgtgggaaagtgtgtggggtgtgggggatggggcatggaaagggcgtgtggggtgcaggggatggggcatggaggtgtgggggatggggtgtgtggggtgtcggggatggggcatgtggggtgtgggggatggggcatggaaaggcgtgtggggtgcagaggatggggcatggaggtctggggcatggggtgtgtggggtgtcggggatggggcatggaaagggtgtgtggggtgtggggatagggtcaggggatggcgtggggggtgtggcatggggatggcacgtgtggcatggggatggggatggggggtggggcatggccgagtggggctggggctgggaatggtgagtggggcatggggatggcgagtagggggtgtggcgtgaggatggctagtggggcgtggggatggcgtgtggggatggcgagtggggggtgggctgtgagggacagtgcctgggatgtggggctgcagccctagctcacagcatggccttatgaccccggccaccttcctgccccaggcggggtcgctaaggcctcaggaggagaaacacgggacatgccgtggaagccggggcctcacagaggtgagcagggactgccactggttttgtcctggggcccagtgggggccaacatcacctccttcccctcccatggcaaagagccagcccgcggggtggctactgcagtgccccccaaggagggtgttccctgctcgagaggaagtgaccgctccagcttggccttccctgggactggggtgcaggcgattttatcttctttgctccattctgttccttccagataatcgtgtgttcttcatcaggttttcctcagttcttgagagcttttctgatgcaaatctgctttcaccccagggcggtcaccggctctgctcacaccagcctccaagggtgtgggtgtcccgggagtgtgggtgtcccgggggcgtgggtgtcccgggagtgtgggtgtcccgggggcgtgggtgtcccgggagtgtgggtgtcccgggggcgtgggtgtcccgggagtgtgggtgtcccgggggtgtgggtgtcccgggggtcgtgggtgtcccgggagcgtgggtgtcggggactgcagggacatgggcctcccctcccactcctgccgcccagggcacctcctgtgaggactcggagtccgtgagttcccacctccttgagcccgattctttggtgtccccgcctgcatcctcagcctccttccaaaccagaccagttctctaggggcgtcgacgtgtgaaactgattttaaagaaaacaggcggtggcctttctctcggccccacgtggcccagtagcgctcaccttccgtcccttcttccgcgctcagtaaccaatttaggccgctcctgcagaactcgggctcctgcccaccggcccacagcgtccacctgaggcctcgtcctcccagcaaaggtcgtccctccggaacgcgcctcctgcggcctctccagagcccctcccgcgcgtcctctcagccccgctcgcctcctcccggggcctccctctcccgcctgcccccaggcccgtctcccctcgcgggctgaggcaggttcgggcagcacggccgccccggggcgggggtcactctccaccaccgcgtggtgcccacagctcacggcgctcccgggtgacggtcccctcggctgtagggcgtcctgaagagcggcctgctcggagctgagcgcacggggttgcctcgccctgggcgtctctggccctcaccagccccgtcttcccatgggcaaaacggcggtcctgtttgtccacaagtaaccgtcggggttacggaggggccaggagctgcggcggggggctgtgctctcaggaccggccccaggaggatccgcgcgaggtctggagctctcaggggtcgcgggggacagaggggccccaagcggaggcggggaaggcggcagaagcccaggaccgccaagagctggcgaggaagcccggggctcgctgtcgggggagccgggcaggggccgcgcctcggaccaggacggaggcctggggaaggcggatctggccgccggagacgcggtgcgggtggagacgagggatttggatttccgcgggcggctgcacggatttccacgcgcggttcacgtgggccccaggggggtgcccggcacccggggccgcgccgccttctcctcgccggcatcgacccgcagcctcacgtttacgcggcggcgcccgcagcccccttcggcccggcttccgcgcgtgcccccgagcgcgccctcgggatcagcccccggaagcagagaggccaggccgggaaggatgggcgacgggggtggctgacccgggagcacggcagggaggacacccagccaggcccgcgagcagcgccgctcccctcctccaggacgggcgggaacctgcgatgcccccgccgcgtgggccgtggggcggtctccgaggcactgggcggggcacgcggtgggcgcttcacggaactcgcatttcccagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacggtgagcccagcctcggggcgccccgcgccgcggacactgcaggcggcggtgaaccaggccgcgtggggccgcctgcgtctctttggctgcggctgtgggcggcgaacacgcagcggcgcccgcgcggcgctttctgcgggggtcgctttccgcccggggtgactccgctttcctgggcgatgccccccacccccaggcacgcgctctccccgtgcggccgcaccgcgcatgccggttttcacatcagaaaatacgatttgcaaagcacacttagggtgtcccccttaacttcccaagggagtccccccagtccccgaagggtccagggcagcctgcgcatcgcagacgcgcgcggctcgcagaagggacgtggtgagaagctggcccacagcatgccaccagcggcacctcctcagggcacgtgtcggggagaaacaacacttagggacctgggactttctccagctcacgctcacgggtcacctcacactccaagatcacctcaaagaggacacctcacacagggcacacttcacactcacaggtcacctcacactcacaggacacctcacactcacagggcacacttcacactcacgggtcacctcacactccaagatcacctcaaagaggacacctcacacagggcacacttcacactcacaggtcacctcacactcacaggacacctcacactcacagggcacacttcacactcacgggtcacctcacactccaagatcacctcaaagaggacacctcacacagggcacacttcacactcacgggtcacctcacactcacaggacacctcacacaagacacctcacacggggcacacttcacactcacaggtcacctcacacccacaggacacctcacacagggcacacttcacactcacgggtcacctcacactcacaggacacctcacacaagacacctcacacggggcacacttcacactcacaggtcacctcacacccacaggacacctcacacagggcacacttcacactcacgggtcacctcacactcacaggacacctcacactcagggcgcacttcacactcacgggtcacctcacacccacaggacacctcacagaggtcacctcacacaggacacctcacactcagggtgcacttcaaacccacaggtcatttcacctcacactcacaggacacctcacacaagataccacacggggcacacttcacactcacaggtcacctcacactcacaggacacctcacagaggtcacctcacacggggcacacttcacactcacaggtcacctcacacccacaggacacctcacagaggtcacctcacacccacaggacacctcacacaggacacctcacagaggtcacctcacacccacaggacacctcacactcataggtcacctcagtcttacaggacaactcacactcacaggtcaccttactctcacaggacacctcacactcacaggtcaccttactctcacaggacacctcactctcacaggacacctcacacagggcacacttcactcccacaggtcaccatacctcacacagatcacctcatactcacagatcacttcattctcacaggatacctcacactcagggcacacttcacactcacaggtcacacctcacacagatcatctcattctcacaggacacctccctctcacaggtcacctcacactcacaggacacctcacagaggtcacctcacacccacaggacacctcacagaggtcacctcacacggggcacacttcacactcaggtcacctcacacccacaggacacctcacagaggtcacctcacacccacaggacaactcacagaggtcacctcacacaggacacctcacaaaggtcacctcacacccacaggacacctcacactcataggtcacctcagtcttacaggacaactcacactcacaggtcaccttactctcacaggacacctcacactcacaggtcaccttactctcacaggacacctcacacagggcacacttcactcccacaggtcaccatacctcacacagatcacctcatactcacagatcacttcattctcacaggatacctcacactcagggcacacttcacactcacaggtcacacctcacacagatcatctcattctcacaggacacctccctctcacaggtcaccttacactcatctcacactcacaggtcgccacacctcacactcacaggatgcctcacactcacagaaccacatctcatatgcacaagacacctcacactcaggacacctcatgctcaaagaagcctcacactcacaggaggtccagctgtctgaggcaaaggctaacatgaccctttccagacaaattgaggatggtcatgcctagcatttttatacacctagttttgaaagcatttctcatctgttgtattctcacagcaccccgtgagtttaagttcaggtggccaacagtttcttcagcaatcacttttttctgtggagtgcttttgctgtttgtggaatattttgcatctgctactgcaccctctccccgtatgtgtggccaccctgtcagaggtggagctgtggctcagagcctgtgtacctcgtcccaggtccacagctcagcgacagaagagtcagggttgaacctcgggtgttctgacttgggagcaggaaatgtgtggtcacccatagttccagatgtcctggggaggggccaagattagaagaaacctacctcagctccagaggaaagtctggcttcctgagcccaccccgccagacccaggtccaagtcccccaaccccagttcatggtgtgtccagtgcttaccgttgggtgctctggtgaaggtgcatctcacgaggcttgctctcttgttccttcagaagctgttctggatttcttacagtggtgagtggatgatcaccaccagtcctgcctgcaacccttctcagcttactgacaccagcccactccacagatggggaccagtgtgcctcaagtccatgccagaatgggggctcctgcaaggaccagctccagtcctatatctgcttctgcctccctgccttcgagggccggaactgtgagacgcgtaaggccccactttgggtcccatatttgcagagggccctggggagctggtggaggtggcctggccaaccgggctgcagggtgcacaacctggtggggtgtgtaggccgggcattcagggctcagccccagttggaaattggtctaggtgaccttgaaatcccttccagtctgaggtctttgacagggacccaaggttctgattatcagactcagtggccccttgggctcccggccctgggcaattctcagccctcgagatggcccagctgagagtccctgtgtccctgtcccacttccacatcccaccacgcaggaccgcttggtaaacttccccttctctactttccattacaaaggtttgaggggtttttttttttttaaccatctgaatattaaattatcacaaagtttgaggcccccaacctcccttgggttcagtaattcactagaaggactcatagaatccactgaagtggatacactcacaggtaccgtttattacagcaaaggatgcaggcttaagtctgcagagggaccaggcacaagcttccccttgtcctctccctgtggggtcatgtggacagtccttaattctcccagaatgacgtgtgacgagacgtgggaagtactgccaacttgggaagctctacgagccccggtgtccagaggttttatcagggctcaatcacatagacccagctgaccacccgcatggctgacctcagtctcagcccctccagaggctacgccgatagtgcggcccaaggccccaccatacatcacattgtcagctagaccatccagcatggctcaaggcccaggtaaacaccaacattccctcaggcaagaccttccaagggcttagcggtcatttcccaggagccaaggcaaaggctaccctttctctggcacagcagttcatccttgaccacccaagaccacattcttacactgaatgagctctcctgtgcagcagccattttcttctctaagcagaagagagcccagcaagctggaggaggctgaagagagaggcttcctgctggtcatctgggtccagaatgcctggagatctctgctcagccctggtgcccagcagccctggtgtgcatcctgcagggcaggccttcccgccggagtcctggacttgctcagggccactccccttgcccatgtcaaccaaagtcaggctgccggttctgcttcttctgtctgagcccatgaccagtgctgggactaactgtccccaggcgggctcacggtggtacgaggccagcttggagaactgtctcagctctctggtcctctcgtcagttgggtctctgattggaaagtcccttggacacttttaccatccccattggactttcactttcccccaggctcccatcagctgctcggaagagtggtcaccctggaggccactgcccaccagccaggcaccccccaaatgcaaccgcagccagcactgccagccactggcaaggctgttcagacatgtggctcctctgatccacgccttgtcctttggatcagtccacggagcaggtggtgccaagctcaggctctgtcacccacagctcagtgccaccttccaggcagaacaccactgctgacccagggcatggccaccccgggggctggctctcgctgacccccagaagcccctctcagggtgtccccttcctgtccccagacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacaggtgaccaggcttcatgtcccagtcccagatgacaccagtccctgtcccactacggattatcttactggacaaaagacgggtgggagtggcttcacatctactgagcactaactatgcactgaccaattgtgaggtgggatctgggcaccaagggtggcacaggccagagcgacagtgactaggatgggcaccctgggggcaatccctgaatggcctcaggccccctgccaattctaggcagaccaggggagccaagcaaggcactatctcacgtccaactcccactcgcaggacctccgccagggttcatgaatctacttcggcacagccaatgtctgtactgactgctgcccactctgcattccaaaactcgtaaaggctcctgggaaaatgggatgtttctccaaaccagcctggaacgaatgggctgcacttccaaaagcagggacaccccacacccactgtgtctcaaagaggcggacgtgcccaccctggccacacagcctgggactcagcctgccacctcctcgggcttcctttctggcccaagaccttgattgaagcagatcaaaactaagcatgggatcaaaacaacacagtttgattcatctttaggtagaatttcattcaccttctactaaagtcaaacaacacatcttctccctgaaaagtgagcagagggcggttttaagacgtaagccctctgtttcctccaaaaccagccctgaccattgtctcctcagccagccacttcttcaagggcctctcatggccgggccccaccagtcaggcccagccgaggccctgccttccaccacccctgggccctgggagctcctgctcctgggggcctcccatagcctcggcctcaaggcctctcagaggatgggtgtttctgaatctttcctagtggcacgttcatccctcacaaatctctgcatctttctgacttttgttttacacagttgaatatccatgtggaaaaatacctattctagaaaaaagaaatgccagcaaaccccaaggccgaattgtggggggcaaggtgtgccccaaaggggagtgtccatggcaggtaaggcttcccctggcttcaggattccaagccctgagggtcttgaagccttttgaatgtgaacaacagctctggaagggaaaatgggcaggtcagccccaagcccaccaggctccaagtcagcacacctagcacctccagctcgcggcacccccatgcttttagtggggcaaggaaggagaaaagaaaacgacactcactgagggtctaccctgtgcagagaaccctgcgagatgccccatccgagttgtcacgtcgtcctcacggttactctttgaggtgggatctttgcctgatctttgcaaaatcaggagcattggatcaaagctatgtgaagatcctgtgaggtgaacagtgaaatctcacagcgacatttgtattcttgggccgtgcccaagagcacgtctcggctagagaggggcacagcctcccagagccaggtctgagcagctttgcctgggagggatctgcaaagaccccaggatttcagaaagaaattgtgcaatgccagaggttccttggcatgcccgggagggcgagtcatcagagaaacaatgacagcaatgtgacttccacacctcctgtccccccgcccaggtcctgttgttggtgaatggagctcagttgtgtggggggaccctgatcaacaccatctgggtggtctccgcggcccactgtttcgacaaaatcaagaactggaggaacctgatcgcggtgctgggtgggtaccactctcccctgtccgaccgcggtgctgggtgggtgccactcttccctgtccgaccgcggtgctgggtgggtgccactctcccctgtccgaccgcggtgctgggtgggtgccactctcccctgtccgaccgcggtgctgggtgggtgccactctccgctgtccgaccgcggtgctgggtgggtaccactctcccctgtctgaccgcagctctcaagtgtctcaggggctgtggctctgggcttcgtgctgtcacttccacagacagacagacatccccaaaaggggagcaaccatgctgggcacgactgctgtggccaccgtgctctcagccactttcccatgcccaaataaaacgataaaagactgggggcttctgcccatcctgcctcacttgaccaagagcccagaagaggatgcgacacccagggcctcatgggaccaccggctggcaggggttctgctcactgggtttatgggtgagacgagcactcccaggagggccactgggccgggaagaactgtggagaatcggggcacgccctgtcctcccagctgccagggcacagcatcccttccccacctcaacacccagaccccagattcaccccagttcacttgtccccacacgagccacaggctgccacctggggcaggctggccccaccttggggttagatgcaggtccccttgccccagaaggagactgcagcccctgcagacctagaaatggccacagcccatccccatgcaccagggggtgaggtggcaggtggtggaaagggcctgaggggggcttcttccttccaggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagcccacctgcacgtgatctgctggcctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaatgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccacccactgggttgcccatgattcatttttggagcccccggtgctcatcctctgagatgctcttttctttcacaattttcaacatcactgaaatgaaccctcacatggaagctattttttaaaaacaaaagctgtttgatagatgtttgaggctgtagctcccaggatcctgtggaattggatgttctctccctgccacagcccttgtcaatgatatttcacagagaccctgggagcacctgctcaagagtcagggacacacgcatcactaaatgcaagttcccaggccctggctgcagtgggaggacctggcaagctgcactcttgctgagtccccagggtggtggaagaagaatgagaaacacatgaacagagaaatggggaggtgacaaacagtgcccccactcagactccggcaagcacggctcagagagtggactcgatgccatccctgcagggccgtcctgggcaccactggcactcacagcagcaaggtgggcaccattggcactcacagcagcaaggcaggcaccagcaacccacctcgggggcactcaggcatcatctacttcagagcagacagggtctatgaactacagccgtgggctgcttccaaggcaccctgctcttgtaaataaagttttatgggaacacacccatattagtgtccatggagtggccgtggcagagacgtccagccggacagaccagctgacccgccaagcccagcatggttagtgtcaggacctctgctgaagatgcttgctgaccctggccagaccccggttcctaatgccccctaaacgggacgggagccagtggcgggccctgatccaggtcagagctggctctgctttctcttttgtccgagtgaccatgcctcagtttcctcatctgtaaaacaggagcccaccgtgatgcttatggtgggatgagatcagcatggatggaacaaggccctggaagggcccatgccatggtcatcgacagcaaagccactctgcagacagatgcttcagtgaattggtagaaaattctgcaaccagaatgcccggggctcctgagggcctaagcccagcccagggttctggaagccgctctgacttcttgggagtggaagttggcaggactcttcctgggaagaagcggagggtggggatgagaggacagttcaggagcccacccagacccacaggaggaaactaggggagtcatgcggggtcctggtggagcgccagcctcccttcctgccaatgggaaatgcaggcgcccacctcatggtgctgccggaggagggggcccgggactccccagaggcttcgctgaagggcctgggcgcccccaaaggctacatgtttcatatgggacgtgccacctgccacggctcagctccagctttctgtgagtggcgagatagaatacggggaggccactggccatgggcctgggacagggtgggatgaggcggcaggcttgggccaccaaagccagcatcgccacccagcattgatgacaaagactgcgtgtctgccatgagcatcctgctgttggtgcacacaccgcattggtctctccatacaaacatgcctagaggcgatgtcagagggtggagaccaggagaggcaggagtcagacatctggtgccaccaggaaggcccttctcagaggaccaggctgtgcgtggtgcccgccgtgggaggccagcctggcgttggcatccagcatcatcagtttgtgcagttgggtggggctcagtgagtgcctcctgtgtgccaggcacaatgacgcacaatgtgtgcacaccaggctcatgtgcaggtggctgcgagacagggcgacccatcaaggcagatgcaccatgaggcagtggccagtgctgtgggtgttaggggcattgctccccggccactacggcatagcaggcagtgatcgccacactggccaagctttagaccatttattccagagaccccagaggcaaaaagcccggctgcacctcccagtga

SEQ ID NO: 14711 - DNA, 150780 bp, Human
agttgtctatgtcacttgtgcttatgtcccattggccaaaacttagtaaccaaatcttggtaagcacccttgctgcagtgggagttgggaaatgtagatctttgtttaggtaagaaagaagagggcatggagggcacagtccttacattccagaccttagtcatggcgctacacctcgttgtaagggaggctagctattgcagcctttcgctgggtggccatgtacccagctagatctcaggggcactcttactaaagtaatgcatggagaatggatagcatgagaagcagtttctgctacaagtgcctttcataaaaagaactcctataagaaaaacaaacagggcctaaggaaaactaatccaaagggtaaaacatggggaaaagacaaaaaacaaaagaaaaaagaaaagcaagtttcccaggtagaaaatgaatgaagactgaggtacataagtgagaagtcctgtaaaattgataatccttttcattttgtcacaaaagtccctacttacattctaaaattccattaaatgtcacctttctgatatccccattttatttctctctctttgggcatttaccatgctgtagtgtactctaggccattcctagctttgtaactctctcaaggtgactctgcaggagatgcaaagtagttaagaggagaacccccaatactgatgtgtttataggtgaggtggtctgatgtcttagatttgctttaaaatattcctgcacaaaataaaaaggggaatagatgaaacaagattgacaaaatgttgattcattgacgcggtgtaatgggtatctgggtgatcatagtacaattttatctcttttgtatatattttaaaatttccataatatagcaaaacatgagcccagtccctcaaggcagccagatttgggttcaaaccctagtttgaccttttactcgctgagtgactttaccctgctacagcttcagtttctccaaatggaaataatatatactccattaaggttcttgtaaactctcaagtaagagggaatctgaggctctagcacacggcccggcccttaatagttgtactaatttttattttatttttcgaaacggagtttgctctgtcacccaggctggagtgtagtggcatgatccggctcactgcaacctccacctccagggttcaagcaattctcctgcctcagcctcctcccgagtaactgggattacaggagtgcgccaccacgcccagctaatttttgtattttttagtagagacggggtttcggcatgttgtccaggctggtctccaactcctgacctcaggttatcctcccgcctcggcctcccagagtgctgggattacaggcgtgagccactgcgcctggccagtagttgtactaacaagggtttctgcttgcgagcaacaaagactgactctagttgtggctaatttctttcacacacacatattaagtgccagaggtaggacttgagctcggatctctgatttccagacctagaactttttatgtgttattacagtcgttaaaaaccttacctggatttgtgctttgcaatttacgctttcgaacatgcaggaatgtagtttgggcatttgtctggaacttcggattctcgggactccagggtggccaaggcgcggaggtgactcaatgacattgaccggcctggatgcacgtgggttgctgagccgatgctgggaaggtacggggtttgcccggtgcaggccgccggaactcacgcacgcccctgtctctctcactcctggggtcggctctggccggtggcctccagctcagctagcggccggacgcgcagcccgccgactagccctccaggtcctagcgcgactcccggatcccggatccggcggatctggccgaccactcaccctcccctttccgcaagttagggggcggggcatcgggtttctggctcgtgatttgccggagctcctgcgctccccttctccaccccctccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaaggtgaggagcaacggggcctcgcgggtccgggcttcactgggcttctagccgtgccgcctctgggcggctggcgccgggagagcgctggctgggtccggctgcccccgcgccccggttccgcatcagctacaccgcttgctttcctccctcccggagttcgcgtggcagcgggctcaggaggcatccctcgttgcagctgttcctcgcggggatcctgcggagcagagaggcctagggcagaggcagttgggtgcccgcacgccctccgaggcggctgatggctttgggcaggcatattgctcgaggtctgcttccagggccccgcggcattggctttgtcttaagctttccagggtgtctttttaggtgtccttatagtttccgtgttctgttgcctctttccagcatttttgaagggacactgtgaactgttgcttaagtagtgttagggttgtgagtttgtcttatcttttaaagtattataccatgtcaggactgccaatagattttacgtttcatttgaaagcctgttttaattgtatgacaccccagtctactgtgtaccaaatgcatcccgtgaacttactttccttttcggtatagtggtgagcctgattttggcactgttctaaacacatttcatgactgttctgtatacctaggctgtcatgatggcagattgacaaacaggttggagtgcttgtgtgtgcttctgagctctgtctccagtcaatgtcgagtctgtcgttaattctggggcacagaccacctaacctactttataaggtttgttgaggcacttgaacacattctttaaaatgaaggtcccctgaaaaccatctgtcagctggttcagtgtgcttgttaaacttccttttaaaaaataattattaaaacattgccacataacttgatttatagtcatttaattttagacgttgaagacactttagagacgacctgccccatcctactctttaaagaggagggaaccgagccccaggtgggcagtatgagagctggagcttatcgacatggaagtgagtggcacctatgtttgttttgtgtccaattcagcgtgcggactttcactgttttctgtgttcccatacagtttagtgttctttaatctttatcattctgttcatctgtgttggccacttcaattgcagctgtaagacttatgcatttacataggaggcaagttagtatggtgtaaagtgtgggctttggggtcaggcgcatgaggctttgtatattggacaggtctcttccttgggcgtcagcttcgtccttgtagctatttttttcaacaaatatttactgaatatctcctgtcttccacttctggggaatgaatatggtttctgctttcttagaaattttactctagtagggagactgtaacaagtgtaaaatggtattaggggagatgcccgggtgctataagaaaataaaatagagggatttgaccaagccaagattttgaattctgtgttctagatactgttctgttgctttgcttgaactaatttattcaatctcacaacagtcgtatgtcccccatttacagaagatgaaagtgaggcactgagtgttaatgtgacttgctcgaagctatagtgccaataagtggcaaacaggatttagaactccagaacctgtgctcttaatcatactatgctatctacggtaagggagtgttttcctttggaactgaaaattgagacaagttttgaaggatgaagtgaccttttctaacaaacagaggagatgaatgttataggtgagagagcagtgtatgcaaaggtcctgtggccagagggaatgacaggttagaagaactgaaaaaagcctacagaggctctgatgcagagagtagatggtgttggggaagctggcaggagtcagaccatctggctcttatagatcacattatgaggtttggtgtttgtcttagagcagtgggaagacattgatgttggaggtgggagggatgacactgacattttagattggagaggctgagaggaaggctgttactgtacttactgttgtacacttgttatacacttactgtgtaatacatacgctttgatgattcttacctggttttttccttttaatgtgttggcagagactgcatcttgtctatttctgtgttcttagtacaatgtttgacacaataggtgctgaatgtgtaacaatagagtagcattatgtttgtgccggtaaagaattcctccttggggtgggaagcatctctgaagttcactatcactctaggggaacttgagctgctgcttagcttctctctgcgcttctcttctatgaacttgaaatatgctctactgagtctgtttgaagctgaatcttttgaagattttaacccctcccatccctccctccacctctgcaaaccttttggttggttgaaaagcagccagctaactctagggtctagtctagagaattctgaccattcttttagccagtcaacagagtttatttatttttagggtatatgtagagttcaccttttagtcttatttgttttgtgtatcagctttttaagcacattctgttttaatgcctagttttttcttctgcgtaaatgttttcagtggctctaggatgttggttttatggtaattgctatagttattattgaactcttatatgccttgcatgatttttctttgcttttctttttttttgagatggggtctcgctctgttgccaggctggagtgcagtggcgcgatctcagctcactgtaacctccacctcctgggttcaagtgattcccttgcctcagcctcccaagtggctgggactacaggcgcacgccaccaccaccggctaatttttttttgtattttagtagagatggggtttcaccatgttggccacctcgatcttctgacctcttgatccactgccttggcctcccaaagtgcttggaattacaggcatgagccaccgagcccaatggtgtgatttttcatatatcttttatccttataacaactaggtaaaaaatcccaattttacagtagaggaaacaaagctcagggcagttaagtagttgcttaaaagcacaattggctgaagtagaatttgaaccttagataatatgattctgaaggctttcttttctttcttccttttttttttttgagatggggtctggctctgttggccaggctggagtgcagtggcatgatcttggcctactgcagcctctgcctcctgggctcaagccatcctcccatctcagcctcccaagtaggtgggaccacaggcacgtacgaccacacctggctattttttaattttaatttttattttttgtagagatggggttttgctatgttgcccaggctggtctcaaactcctgaactcaagcaatccacccacctcagcttgcttttctaattacaaattgtctcatttgaatcatggtctcattgtgtgatgcattcatgaaatttgaatgtttaagccctgtgttacttgacatccattattttcttttgtaatcagtaaatatggaaaagaatgtttaggcttatatgaatgctttagaattgcctggaggttaatgtttccaacatgctgataaatttctgacaaatcatttgggaaaagaaatttctgagattattacagaaactagtttctggtgtaaaaaaatgtttatagacatttatatatttatacatctaccatttggattttattctgttcctgagaggttcagaacagaggtaaaaactgctctagtccttttctaagaggaaaagatgtgacatttttgatgaagagtgagggaaaaggatttgtttaaatgattccaaactttaaaaaatgtaggtgggagaacaaggatgaaaaaggaatttgggaagaaacacttttttggtggggctggaaacatagtgtttcattgtaggtatctggagttagatgcccgcaggagccatgctgaggtgctgggtatcagtggctggcttttgggccagggatacgaggctagagttagagttagaactgtgagccctgacggatatagtgagtcagttaatatttaattgaataaatgcttcgttttataaccctaaattaggatttggaagaaggaagaagagacaagaggagttagaggtatggtttgagaggagccaatgtagtgtagtgttaccaaacctaggaaagaaatttcaagaagtagttagcattcattcattcatttgtctagagatctagctctttactcagaaagtgtttgtggagcattttctaagttccaggtactatggcacgtacagaggagagaaaaagaaattaaaacatattccctaactatgtcccaggtgcagagaggctaaggaataaaagattgatgaggccaggtgtggtagctcacgcctgcaatctcaaccctttgggaggccaaagtgggaggatttcttgagctcaggagtttgagaccagcctaggcaacataatgataccacccccacccccggctatctctacaaaataaaataaaataaaataaaaattagctgggtgtggtggcacgtgcctgtggttctaggtacttgggaggctgaggagggaggatcacttgagcccaggaggtcaaggctgcagtgagctgtgatcacaccaatgtactacagcctgggtgacacagcaagaccctgtctcaaaaaaaagtctgggcacgatggctcatgcctgtaatcccagcactttgggaggccgaggcaggcagatcacctgaggtcgggagttcaagaccagcctgaccaacatggagaaatcccgtctctactaaaaatacaaaattagccgggcatggtggcgcatgcctgtaatctcagctacttgggaggctgaggcaggagaatcacttgaacccaggaggtggaggttgcagtgagccgagattgcaccactgcactccagcctgggcaacaagagcgaaaatctgtctcaaaaaaaaaaaaaaaaaaaaaagattggtgaaagaatttgaaaagatctttgatctttaatgagaataattttagtagcatggtaaagtgttatatacaaaaaatactgcttttgacaacactcttgaatagttgaagcaaaattatattttttgaaagataagcatattgcataactttcaaaaattagtttctttattttaaatgcctattgacattttcgttagaaaaaaccccacaaactgatgggatcaacctaataagatcaaaataaaagtgaatttaaagaatgttggaagatacagttttgtgatttcattcacaaaacctaatacagcatccatgtggcatactctctttggtattgtttgtttgtttttgagatagagtctcatgttgtccaggctggagttcagtggtgtgatctccgctcacggcaacctccgcctccggggttcaagtgattctcctgcctcagcctcctgagtagctgggattacaggcatgtgccaccatgcccagctaatttttatatttttagtagagacggggtttcaccatgtcggcctggctggtcttgaactcttgacctcaattgatccgcctgcctcggcctcccaaagtgctgggattacagatgtgagccaccgtgcctgccctctctttggtattatttattcaagaaacctttggtttcctagagctgctgtacaaatgaccatggacctggtggcttaaaacaacaaattcattctcccacagtactaaaggcctgaagtctgaaatcaaggcatgagcagggccatgcttcgcctgaaggctctaggggagaatcctttcttgcctctttgagcttctggtggctgcattcattccttggcttgtggctgcatcactccagtctctgcctctgtcttcacatggctgccttctcctcctccttcttgtgcgtctttccctctcattcttttataaagacacttttcattggatttagggccatgacaagatctaggatgatttcatctcaagatccttcactttgttgtattggcaaagacactttatcacaggttccaggacgtggacacatcattttaggggctatcgttcaattcacctacacgtagtatgtgtcagacactacttagagctgggaatataattgtgactgtttctgctcccattgtggttacatttgagtaaggagactgtgctcgtataaatagaaaagttcagagagtgagaagtgctctcgaaggaaaaagataggttaatgggatagagagtggtagtggtgctgagttggggatgttacctaatgagaccatgggggacatttctgagcatgtggcatttggacaggaaactgagccagccagccatgtgactatatgggggcctagcattgcagaccaaggagtgccagggcaaaagctctgaggggagattgcatttggcataattaagggatgaatgtggctgctgtggttggagtgaactgaatgagggggtgatcttaggagatgagggaggaggagtgggtaggcgggacagagtcatcaggggcttgtatttggaatttagtaatgagagtccagttggaggcatttaagcacattgaatttatgtttggaaaagacgtttgtgactagtacgtagcgaatgtcttagtaggggtgggagtaggattggggactggggtgggaagagtggaaacagagagacccatcaggaagctgttgtagaagaccaagctagagatgatggtaacttgtgctagggcactggagttgctgagaactggtcagacttggaatgtattttggagctagagccagtatcttgctgtggggtttgaaggcagatacagatgtacctcatatcttggctttattgaccctgcagatactgctttttttttgttgtttttacagattgagggtttgtggcaaccctgctttgagcaactgtattggtgtcatctttccaatagcacatacttacttggtgtctctgtgaaacattttgataattttttcattattactatgtctgttatggtgatctgtgatcagtgatcttcgatattcttattgtaaatattttggggtgccgtgaaccacgcccatataagttggagaaacataattgataaatgtgtgagttttgacttctccaagcagttattcccctatgtctctccctctcctcaggcttccctaattctctgagatacaacaatattgaaattaggccaattaataatcttctaagcgttctagtgaaaggaagagtcacacatctctcactttgaatcaaaaactagaaatcattaagcttagtgaggaaggcctgtcaaaagccaagatagactgaaagttgggcctcttgtgccaaattgtaaatgcaaaggaaaagttctggaaggaaattagaagtgctactccagtgagcgcacaactgattaaaaaaagtgaaacagctttattgctgatatggcgaaagctttagtggtttggatagaagatcaaaccagccacaacatttccttaagccatagcctaatccagcgcaaggtcctcgcttcagttctgcgaaggctgagagaggtgaggatgctgcagaagaaaacttggaagcagaggttggttcatggggtttaagaaaagaagtgaggccgggcgcagtggttcacacctgtaatcccagtactttgggaggccgaggcgagtggatcacaaggtcaagagattgagaccattctggctaacatggtgaaggatcagatgattgttagcatttttgagcaataactgttttgaacaataattaattggacctgaacctacagtatctgtaaggtatgtataaacagggaaaggaaggaattaagagtgacttttgaagggtagacacacaaggtcgctattgtgtgattttgtgtttatatgcagtctccagaatagactgatccatgaagacagaaagtagattagtggttgcccagggcctggaggagaggggatgggagtgactgcgaatagttaagggttgtctttttggggtgataaaaaatgtcctggaatcagtagccatcatggttccatgccttgtggatatactaaaaaccacggagttgtatacttttttaaaagggtgaattttatggtatgtgaattacatctcaattaaaaaataaaagaatggtccgggtgcagtggctcacacctgtaatcccagcactttgggaggccgaggcaggtggatcacctgaggtcgggagttcgagaccagcctgaccaacatgaagaaaccccatctctactaaaaatacaaaattagccaggcatggtggcacatgcctgtaatcccagctactcgggaggctgagacgggagaattgcttgaacctgggaggcagaggttgcagtgagccaagatggcaccactgcactccagcctggcgacagagtgagactccgtctcaaaaaacaaacaaacacaaatcttcgaatacttatgttaacaaagtaaagcaaagaggccaaggtgggaggatcgcttgaggccagcagttcaagaccagcctggggaaaatagtgagaaccccccagccgcccagtctctacaaaaaataaaaaaattagtggggcatggtgacatgcatccatagtcccagctattcaggaggctgaggtgggaggattgcttgaatgcaggagttcaaggctgcagtgagctatgatcctatcactacacttcagtctgggcaacatagtgagatcctgtctcaaaaaaaaaaagtacaatgaagctaggtgtggtggcagggatgtgtagtctcagctacttaggaggctgaggtgggaagatcatttaagcctaggagttagaggctgccatgggctataattgtgcctgtgagtagtcactgcagtccagcctgggcaaacatagtgagacccccatctcttaaaaaaacaaaaaaagtaaaataaggtgaaattaatatattttacttaatatattcaaatattcaaagtattatttgaatatgtaaatgtaaaaattcactaatgaggtcttttacattttctgggtactaagttttcaaaatccagtgtgtagtttactcttagagcacatctgaatgtggctcgtggctgccatattggatggaacagctctagggcacagattgtgctactaatcaagtcccaccttgaggtgctgggactggccttttgaatgcagtgttagtcagcccttggccaggcagggtcgggggagctctcaggcttgatggagagctgtatagttgaggaacatggtcgagatgagggtgcaggtgtgagccgttagttgtcaacacagcagttagagaggatctgagtggccactgacaacatctgctacagcgggatggggaagaatggcctggcggaagagtcaagggtgggatgatggagctctagagttgacatgtatagtttcctggtgcttgagcttagtacagaggcagagcccagagaatcttgagtcttgaacatctctctcaaatattaggtgttcaacttggcttttggcagacactgaagattggaatggtctctaagatcctgaagactaaatagtctatttgaaagaaaagctgtgcttccaggaaaaagccagacctaattaagtgtcttcagagaagggcatgggctctgttacaatgcatgatgaaataccgtgtcataatacatggataagaccttcacctggaattttagagatgaagcaagatgaagtaaactaatgtttactttgaccttggtgagatcattttatagctccattaacccagttttgaggatagtttcttctttgaagcagaatgcattctgataatgaatttatctcataatgagttatttagtattattcatctgaatgctactgcgggtatgttaacaacagtagttttggttttggcagaaatagtgttcagattgttctttaagatatttgccagtggatttaccagttttaactgccacgtgaggccacatcttgcttatgaaagtaggtgctatctaatcttttttttttttttttttttgagatggagtcttgctctgtcacccagactggagtgcagtggcgtgatctcggctcactacaacctctgcctcccgggttcacgccattctcccgcctcagtctcccgagtagctgggactacaggcgcctgccaccacacccggctaattttttgtatttttcgtagagacagggtttcactgtgttagccaggatggtctcaatctcctgaccttgtgatccacctgcctcggcctctcaaagtgctgggattacaggcgtgagccactgtgcccagctggtgctatctaatcttaagaaaggatttttttccagccactgcaaacaggatttgtttccctgtttgcagtggctggaaggcatgcatccagtttgtctaaaagcctaccatttcccccgctttttgtgtaagttattgtgtgctgatgataatatatgcaagactgtgctagccatgttagacattctcatttaatcctcatagcagcattatgacctagataagtactattattatccccagtgtacaaatgaagaaactttctatatatctaggaaatgtcagagccaagatttgaatccaggtcagaatctgagtctagaccagaactcttattgactatattattctctaatggtaattcccaagtggttctggtataattttaagaaagaaggtgacagttacatatttggatttagttttcatgtaaaaccttacattttttggcactttactgtttataaaaactcatttgatccttttaataactccctaggaaatcagggaggtgtcatcacctacattttgtagatggaaacgggggcccagagaaatgattagctcaatgactcacagctgagagttgacccaagtcttgtgactctgagggtcaatgccacttcctatgtgccaagccattttcaggcatttcttttctatgtgtggaaaatacaggaaatcattattcctgtgggagagaaccagtggcaatatgttactggggagtcattttgcacacgctgacctctctcattttggctgtgattggctagcctttataaacagaattgattaaagttctttctcagaacctttgttgctaggaaataccttacaaagaattttggactgggcgtgtagccagtttgttacatgcttaacaaaaacaacaaacgttaaaattctgtgtagaggtccaaattagcagacttctacaaacgttttccttcatttagaaaataaactttatgttgtggctttacacaaatggtctgagtgttgacctgattcttcatttttgaccttccatgaatgtctcccaggaggaaacaggaacagagcctttatggggctcattccaaaccagttcagacttgtcgtgggaatggttcacattggtagttgttctgttatagttgtgtttgcttgtacgagttctacttcttctttttttttttttgttgagacagtgtttcgctctttttgcccaggctggagtgcaacggtacaaacttggctcactgcaacctcggctcactgcaacctccgcctcccgggttcaagcgattctcctgcctcagccatccgagtagctgggattacgggcatgcaccaccatgcccagctaattttgtatttttagtagagatggggtttctccatgttggtcaggctggtctcgaactcccaacctcaagtgatctgcccgcctcagcctcccaaagtgttgggattacaggcatgagccaccgtgcccggcccgagttctacttctagttactgggtaaccgggaggcatctatgctttttacagctttaggccacattattacaagttcacatgtgtgcaagctctgtggaacaacatcatatctttgagtagatattagtgtttatctgggaattgccactgtttttcttatctagaaataaaaaatttcagaaagctcttgaccaatctgtggttaaatcttataaccattacagcctcagcctgtgacctttgaaaagttaaagtccttgggactcaactttgtcataaaattggggataatactcttgtaactcacagttatgcttgaaggaatatatgagagatagtcttgatctttaatagggacacagtaataatttcccgttcacagttccttcttgttcttggtcttttacttggtaaaggttttattttataaactatatctttttgtatcttttacctccacttttatacagagattacattttttaaattaattaaataattaattaattttttctgaggagtttcgctcttgttgcccaggctggagtgcaatggcaggatctaggctcacagcaacctccacctcctgggttcaagcaattctacctcagcctcctgagtagctgggactacaggtgtgtgccaccatgccccgctaatttttttgtgtgtgtttttagtagagacgggatttcgccattttggccagtctggtcgcaaactcctgacctcaggtgatccacctgccttgacctcccaaagtgctaggattacaggcatgagccatggtgcccgactctttaaaaaatagttgtacaaatttttcagttcatttaaaaatgttgctataagaacattttgtttcttatttgagtcgttatcatcttagaaagttctaagaggtggtacctgttggttgccttttgctggtttttttcctccatttttttccttctagctttaacagtgactactgggaagttctctctctgtctctgtctgtctctctgtatctctctatctcttttctttttctcctttcttttctctcttttcagtggggtcttgctctgttgcctaggctggagtacagtggtgtgatcttggctcactgccacctcaaactctggggctcaagtaatactcccacctctgcctcctgagtagctgggattccaggctgtaccaccgtgcctggcttagtcacttttcttaatgtttttaagcattaagatacgctttcttcacaaacagttcaatgaatgagaaatatccttgattactgatattgctttttcatatttatcagccaaaccacttctgtaccagaaaatgtgaaataagaaatcatgctgaagacatcagcaaatataaaaagaatattttattatgttctggccactgttaaatttgaagctccttgagaccaagactctcgttttgtgtttttaaaagttctgtgtggtctgtgacatttctgaccctgctctatccttttgaatgatcagaaaggctttcttcaaatttgcttggcccctcgacaattcttgttttgcttttctggagatcgttttgatgcttttggtttctcttacataccaaggggctgtgtctgtagatatgatttcccttttgtaattatatttatggtatattgcctagaactacatttattgatcagacacgttcgctagaacctaactggaagaaatatcctgaaaaaatgttctaaagcccatcaagtatttgcaatttattttgctttcctttttttgtagcatgttctgtactattcaagacagtgcttaatggtgtcccgtaatcttggttcagtgggatatgatcctaatgaaaaagtaagtatttaaaagatattctcaacaactaaattaaacttatcatggttttactttctcgtctccacactgtgttcagtggacagatgagattttgttaaggctgtgtggtcattgatcactctagcattgtgtgtttctataggtgctcagtctttaggtattctgtttttcattgtgggccacagtctgaatctttttaattttgtatttatatctttagcaaaaattgaatgcatttacaatgtgtttcctttgtttccagcagaataactaagaaaacatttgttcttaaagactgggcatttgagagatttaattaaactattgagtttttctttcatttacttaatacttttttttttttttgagatggagtcatgctctatcacccaggctggagtgcagtggtgtgatctaggctcactgcaacctacgcctctggggttcaaacaattctcccacctcagcctcctgagtagctgggattacaggcgcccaccactgcacctggctaacatttatatttttagtagagatggggtttcaccatgttggccaggatggtctcgaactcctgacctcaggtgatccacctgcctcagcctcccaaagtgctgggatttcaggcatgagccaccgtgcacctggcctcatttacttaatatttatattatttatttatttatttgtgagatggagtcttgctcttttgcccaggctggagtacagtggtgtgatcttagctcactgcaacctccgcctcccggcttcaagagattctcctgtctcagcctcctgagtagctgggattacaggtgcgccccaccacgcccgtctaatttttgtgtttgtagtagagacagggtttcaccatgttggccaggctggtctcaaactcctgacctcaggtcatccgcctgcctcgagctcccaaagtgctgggattacaggcgtgagccactgtgcccggcctatatgattcatttagattgaaggtaattttgtgtattataaatttcaggacaaggggtttctaattaaaatgctattacaataatgtttgagccttgtagggactagaagaagtgattggaaataaaatatggtttcatgccttcatggcaatgaaggcatcgaagtgggcgggagttttggttaagaagggattgttcaaggtgagtgtcatcaaaatacaactgacaggaatgattatttgagaatgacatgtctgaggtatcttctgaatcatgtgctgaagtgcgcaatactgctttccagattcttttgaatctggaggcctggaggaagaaagagtctacatatcttcagttcagtagaaatacaatgtgaaacacagttgcagggtgatatggtttggctctgtccccatccaaatctcatctcgacctgtaatccccatgtgttgagggagggaggtgattggatcatgggggcagtttcttccatgtttttctcatgacagtgagttggttctcacaggatcttaagatcttacaagtgtttggaagttcctcctttgcactactctcccctgctgccttgtgaagaagggtcctgctttccttctgccatgattgtaagtttcctgaagtctccccagccatgcggaactgggagtcaattaaacctttgtttataaattacctagtcttgggtagtatcttcatagcaatgtaaaaaccaattaatacacagggcaaatgtgattttcaattttcctttttattttttatttttgagatggagtcttgctctgtcacccaggctgtagtgcagtggtgtgatcttggctcactgcaacctccacctcccaggttcaagcaattctcttgcctcagcctcccgagtagctgggattacaggtgtacgtcaccatgcccggctaatttttgtatttttagtagagacagggtttcaccatgttgggcaggctggtctcgaactcctgacctcaaatgtcttcctgcctcagcctcccaaagtgttgggattacaggcatgagccactgcacttggccaattttcaattttctaatagccacattaaaaaaaagtaaacaggcaaaattaataatatctcaatatctaaaatgttatttaagtacataatcagtataaaaagtattaacaagacaccttagattcttttttttgggccctaagtcttctaaatccagtgtatattttatacctctggcatatctcagtttgattagccacatttgaagagcccaataacctcatgtggccagtggctactatattggatagtgcaggtctattgaattagttatgataaactccctgttatgaaagctgtagtttaatttaaaatcttcatcataggtgatatgctttggggttcatgtatccatgtgttgcattccaatctcgaagtaatcagctatcctaagtggctacactcttaagagtaattaactaacatttgttgaagaggacacattatagaggggtggaatactacaaacggttcagccatctttctccttatacactggtagccttcctcattagcgtaataactgttagaagtgggctatcagccaggtgtgatggcccacgcctgtaatcccagcactttgggagtttgaggccagtggattgcttgaggtcaggaacttgagaccagcctggcgaaaccctgtctctaccaaaaaaaaaaaaaaaaaaaaaacaccccacaaaaattagctgggtgtggtggcgtgcaccagtagttccagctacacaggaagctaagttgggaggatcacttgagcccaggaggtcagggcttcagtgagccatgattgcaccactgtactccagactgctaggctaaagggcaagatcctgtctcaaaaaaaaaaaaaaaaaaaaaaaaaaaaaaaaagaaaagaaaaggaaaaaaagaaacgggctgtcattgaggaagtttgtggtattcgtcaatatatgttattggctattgctttagggaaattctgtgcctttgtactattagaatgtaataatgtagttggcctttaattctttacctttaaggataatactcgggcccgatccctaaatgaatagttctgtgttcagccacttgtctggtggattcttgatggcttagtctgacagtatggttagccaaagcagaatattgtttttttttgcctatggtgagcctttcttgcagtcttttggagccttacaaagtacaggaagttaagattccactgaacttatcaagcaggttttatgattctttttatgtcttaataaatgtttgtatgtgtggacagagtttggtctggtacttgctttcattataacctcatagtgaagttacagaaatagctaactgacctcccacattggtgaccactggtaattactaaaaataaataaatgtatgtaactgtctgggtttagcacatttatttatttatttttgagacagagtctcgctctgtcacccaggctggagtgcagtggcatgatcttggctcactgcaacctccaccttccgagttcaagcgattctcctgcctcagcctcccgagtagctgggattacaggcacacaccaccacatccggctaatttttttttgtatttttagtagagatggagtttcaccatgttggccaggctggtctcgaactcctgacctcaggtgatccacctgtctccacctcccaaagtgctggcattgtaggcatgagcgaccgtgcctggcccaggtttagcacatttaaagagatacgagggataaaggtgtagaagtggaatctccttggaattcacttagcatgtttcgtcataaatcctgaaatcaattctgctccctgctatctttgccatctcctttgctgtgcccttgcctaaggtgactgtggagaaactgtgtttccctcagtgagtgatgaatattctttggcacctattcatagtacaggtacatgttcagactaagttggtcgcttcacccttcacttgagggctgcacttaatcagacctttctccttcccggattcctgctgtccttgtaaccattcattaaatactgacctggtttgtttatacctactgtcccaagtgcaagtagacttggtctttggtgtaatacatatttgttaaataaattgattctcgtttgaatctgttattaactcatttcttattccacattttatcagtgacttacatcatgtgcaaattatccgggtgaaatttaatcattactgaaaacgttattttttttaacttgagttttaacaagctaacttgttgtcttatgtatgttcatgagaataaggaagatttaacttatggtagcttgcttggatcaagaccattaagtttcagttggccttaagttagtgtgagccagtacagtactgtgttgttcctgtcacactgatgtgagctggctgggctcagtggcttacgcctacagtccctgcgctctgggaggccgagacacgggattccttgagaccgagagttccatatcaacctgggtaacagagcaaaaccccgtctcttaagaaaaaaaaaagtgatcttaggtgttattaataacatagtgtttagagcttgcattgttatactctgattacattatatcatgatatttctgacatgaatacctggatgtgaactctctgactttgccactagtgaactttgtaagtgatttaaggcaagtgatttggcctcatcaagccttagttttcttatttgtaaaacggagatattatcagaactgacttcgtgggattattatgctaaatattgtcatcatagccattacctgatagatgagataatgcacagaagggattcatcacagtgcctgctgtatacaaaacgtgtcctaagtgtcggctgcttaatgtccttaactgaattttgcacatttggaaagcaagactcaaagcccatggatagtgagtagctgggtgtaaactcatgcctgtccttttccagagctggtggacttacccattgtgctgtatcctttctcagaagagttgggcaagtgacccagtgtccagagttctgccgtcattccaacaagtacccagtgcagggccagctcagtcctcttggtctctgaatggagtgtggtgctagctatggagttagagcctgggagagagcatctaaacctagggaagggaaaggaagaaggagggatagagagagaatgggttaagagaaaaataacaacagcaaaaaagatccttaggaaatcttttacttcagatgacattattagtacagttatagagcagctactgccaaagttcttcattatctcttctggtacctgaattctcatctatcttcaaggatccaggatcctaatttatagttgttttttcctgagtgtcttcagggtgccttatgagtgactctccacatataggatcaagtcccagttccttgaatggcatatgagtccttccatcatctggacttttttttatcctagctttatttgctacaactctcctaagcataccatgcgcttcagtcatattgagaattccttgtagttgcttagtgctaccctcttcttccagtgtcacggcctttacacatgctgttcatgtgctcccttctctgtgtgtagcatcctgcacaaagccttattagagcatttaacacaatttgttgtgtttgtgccatattttactttgaagttgccaaatgcacttgatatttacctgtaattgttgatgcagaggggcagttttaaggttgggtttaattgatttgtatgcatattcttttataggcatagcctacctggaagaatatataggagaccagtaacagtggttgccttttgggcagggacttgggtgtctcttcagtgtatccccttttgtactttaaaaattctgaattatatgcatctatgatttatttagaagaaaattttatgtatggaagattaattgatatgattagttttattgggttttatgcgctaattggtaatacattaatagcccttaacagagaagatgtgtcaggtgcaggtatttgttttgttatagcttttccccagttagacagataggggcacactcctaaattcataacagtctggcatgtagcccaaaggggtgaagaacagtagccatagctaatgctgaatgagtatatattacatgctagacattattctaaacactttaagagtgttaattcaaatcattctcacaacctcttgtggcaggtgctgtttttacccttattttacataccaggaaatgagaggcaagaagggtgacttgttcatagcaggacacacaggaggagaacatagaatgttgggagttcagcctgggtggcttggctgcagactgactcgtaatgaccattctgctgcctgaacagaaattagaatggggattcttgcttaattcttccattgttatcatgatttgttgtattcgctgtaacaattgcttaatatgtaatttctaggagtggtgtttgtggtgattatcagatgtggtctgtttcacagttaatattaacatcatattttaaaacccatttaagaaagtgtaaacattgtgttctcaggatatgcttactgtttaagaggggtttaccatgaccatttaaatacagaaaagtagatgattatgcattctcagacctgagatgtgagcaaggctctgagtggcttcgagttttatcacattagaagtttacctatttttaaggcaggggcttggctcgggttggaggagttaagacatatatgatgtaaaggttaaaccaagacctagcaagcttttttcacttctgagattctggactttttcctgtatgttaaaatactgctctaggccgggtgtggtggctcaggcttgtaatcccagcactttgggaggccgaggcaggcggatcacctgaagtcaggagttcgaggccggcctgaccaacatggggaaaccccatctctactaaaaatacaaagaaattagccgggcttggtggtgcgcacctgtaatcccagctattaggaggctgaggcaggagaatatgttgaacctgggagacggaggttactgtgagctgagatcgtaccactgcactccagcctgggcgacagagtgagactccatctcaaaaaacaaacaaacaaacaaactgctctaggttatataagagtactttttaaaaggtcatttataactctaactcttcttttagaaatataactgacactttttttctgtagttccgttgaacttaaaaataattcacaaatacagaaattaccgtgtgctaatgtgtattacatccaaattacttggaatggtgtgttttgaaaaacgattagcttgtacaattttagagtaggaagaaaaccttactaaatagctttccatttgagtgctaccagtttatgtggaaatcaaggcctacagagattgatttacttaaagttaaataggtcattagtggcaaagctggacttgggtttaggtctctagataaacacaggatacacaacttctctactgtttggtctcagctgcttcaaaatttggtggttattcaaacttaacattggattcaaatggtgtaatctgcttagtctgggcatttttggatatatgcacaattaggtacctattctgagttactgaaaatatgccctgtcccaacagagatagcagataaattatacttacttagtatcagacttccctttgaaaacaactcatgacacttagaatttcccagaatttagaaaataaattgtcaagtaattttggccaaagtgttttttttgtttatttatttatttattttttgagacggaatcttgctctgtcacccaggctggagtgcagtggcacgattttagctcactgcaacctccgcctcacaggttcaagtgattcctgcctcagcctcccaagtagctgggattacttgggattaccagcacttgggattacgggcatgcaccatcacgccggctaatttttgtatttaaattatttatttatttatttagagacggagactcgctttgtcaccagacaggagtgcagtggcgtgatctcagctcactgcagtctccgcctcccgggttcaagccattctcctgcctcagcctcccgagtagctgagattagaggcgcgtaccactagacccagctccttttttttttttttttttttttttttggatttttagtagagacagggtttcaccatattggtcaggatggtctcgatctcctgacctcgtgatccacccaccttggcctcccaaagtgctggattacaggcgtgagccaccgtgcccagcctttttgtatttttagtagagatggggttttaccgtgttggtcaggctggtctcgagctcctgacctcgtgatccacctgccttggcctcccaaagtgctgggattacaggcgtgagccactgcacccgggcttgaccaaagtcttttagtgtctgaaatatcatttgaagattttcttttggctacagaatatgtagatacccccattgtgaatacattaacctactatgctttaacaaagtaattatagaacccgatcatatcagatgaattttgtagttccctggttgtaaacggttatactatttaataacctattttaatattaccctaagtatttatagtacatttaatattactgtaagtaatatagtatttaatgttactctaggaagtaatgtttattagggttatattcagtgttgatgttggaaaaacttggtgttttttggtcttaaaccatcggtttaaaagtaacaatttctaatgaatgtgttttttctctcttcagacttttgataaaattcttgttgctaatagaggagaaattgcatgtcgggtgagtagaattttcgtcttattttccattttactctgaaattatttattaaacccctttaagtgtgaatcactattaatagacattaatatattttaaaataggttattagaacttgcaagaagatgggcattaagacagttgccatccacagtgatgttgatgctagttctgtaagtatatttttgctttgtttaaatcaggacttaattttgggtcaagcagaaaaagtgagacatacaggctttttttcttggcctgcacaagatacattcaagtttaaaaactgtttacttgttcactgttgtgttaagcaaaacgacagtatcacagtatcttctatatgtgccgtaagtattttcttttcatagctttaaaaacttagacagaaaaattgccaggctgattgctggtcaccaagtagatttaagcaaagcatgagaaaatttgagtcaaagattaatgaaatgtttacacagtgctcccttatgagagcactttcccccagcatagcttcagtatcactaagggaatgctacaattgtttaacctttcctaaatgcttcaacgtgttcagctgaaagtttgacaaaaatgaaaggtaggctaatgctaattggatacaaacaaaagaaggtttagcataaagcagatatacttttatttggtacttttaacacagcaggcctttttttttttttttttgggacagagtcttgctttgttgtccaggctggagtgcagtggtgtgatctcacctcactacaacctctgcctcctgggttcaagcgattctcccgcctcagcctccggagtagctgggattacaagcacctgccatcatgcctggctgatttttgtatttttgtagagacagggtttcaccaagttggccaggctggtgttgaactcctgaccttaggtgatctgcctgccccggcctcccaaagtgctgggattacaggcttgagccaccacacccggcccacagcagggattttttttagtagtaatgttatgaatgagtagaaaaaaatcccatggggaaagaatgtaaattattaaatctttatggcatgaaatataagtagttgaatactaatgcaagcattgtttctcattgtctcatactacttttgataatgggaccctttggtagggtccatcagttaatgacagggatatgttctgagaaatgcatcgttaggtgaattcaatattgtgtgaccatcacagaatgtacttacacaaaccttgatgatacagcctagtacacacctatatagtatagcctattcctcctgtgctacaaacctgtgcagcacgtgactgtactaaatactgtaggcaattgtaacacaatggtaagtatttgtgtatataagtgtatctaaacacagaaaaggtacagtaaaaatatagtataaaagataaaaaatggtacacttgtatagggcacttactgtgaatggagcttgcagcactggaagctggtctggatgagtcagggagtgatcaaaggcctaggacattaccgtcactactatagacttcataaacactgtatacttaggctacacgacatttatagaaaaatagttttctttcttcaataataaattaaccttagcataccataacttttttaaattataaacttttaaattttgtctttactctttgactctttctttttttttttttttgagacagagtcttgctctgttggccaagctagagtgcagtggcgcagtcttggctcactgcaacctctgtctcccgggttcaagccattctcctgcctcatcctctccagtagctgggattacgggcatgtgtcaccacgctcggctaatttttgtatttttagtagagacggggtttcaccatgttggccaggctggtcttgaactcctgacctcaggtaatccacctgctttggcctcccaacgtgctgggattacaagcgtgagccaccacgcccggtttactctttgactctttcataataaaacagcataaaatgcaaacactgtataactgtacaaaaatgttttctttatatccttattttataagcttttttctgtttttaaagttttttatttttcatttatttttgactttttgaacttttttggtaaaaacgaagactcaaatgcacacattagcctagacctgcagaggatcaggctcatcaagacatcagtaggcatgggatcacatcaagttagaaagcttctacacagccaaggaaacaacaaaatgaagagacaacccacagaatgggagaagatatttgcaaactacccatctgatgagggattagtaactagaatgtataaggagctcaaacaactctataggaaaaaaatctagtaatttgattaaaaaatgggcaaaatggccaggtgtggtggttcacacctgtaatcccagcactttgggaggccaagcgggcagatcacttgaggtcatgagtttgagacctagaataaataaatggatgtttaaccagcctggctaagatggtgaaaccctgtctctactaaaaatacaaaaattagccgcgtgtggtggcacacatctgtagtcccagctacttggagactggggcaagaagcttgaacctgggaggtggaggttgctgtgagccaagatcgtgccactgcactgtagcgtgggcgaccaggcgagactatgtccaaaggaaaataaaaaggggcaaaagatctgaatagtcatttctcaaaagaagacatacaaatcacaaacaggtatatgtaaaggtgctcgacattactgatcattacggaaatgcaaatcaaaagtacaatgagataaaatcttaccccggttaaaacggcttttatccaaaagacataacgagtactggcgaggatgtagagaaagaaccctcatatgctgttggtgggaatgtaaattaatacaaccactataaagaatagtatggaggtttctcaaaaaactaaaactatcatatgatccggctgctagatgtacatctgcttctaggtgtacacctagcaccagggaaatcagtatatggaggagatatctgcactcccatgtttattgtagcatttttcacaatagccaagatttggaggcaacttaagtatccatcaacagatgaatggataaagaaaatgtacatatgtacggtaccattcagccatagaaaagaatgagatcttgtcatttgcaatagcatggatggaactggtggaggacatgttaagtgaaataagccaggcacagaaagacaagttttgcatgtactcactcatttgtgggagctaaaaatgaaaacaattggactcatagagagagagtagaaggatggttaccagaggcttggcagggtgtatggagcgggaggggtggggatgattaatgagtacaagaatatagttagatggaataaataagatcttgtatttgatagcacaacagggtgactacagtctgcagtaatttgtggtacattttagaataatttagggaatagaattgggatgcttgtaacacaaataaatgaatgatttagatgatggctaccccatttatcctgatgtgattattatacattgtatgcttgtatcaaaatatttcatgtactccataaacatatacacctcctgtatacccacaaaaataaaaaaagacatcactaggcaaataggaatttttcagctccattattggagctgaaatgtagatgcagtacattaccgaccaagctgtcatatggcgcatgattgaattctgatctacaggtagacttttcagactttgcaaaagtggtttcaaaagaattgttgttaggtttttctcatttgtaccttccctgaagcagatgtggtagttttacattttagagacttttcaccacttctggctgaaagcagtagggaatataccagagattatgatacataatttataataaaatttaccagaccccacaatggaagcaattgcacactcagtcaaaactttctcttactatgacctactttaggtcaatttctagaaagatactataagtaaaagcaggataatgatggtgggaatgtcaaaagtttcatttaaacctcaacagtagggtcaaatctgctatgtggtttctgtttcagtctcaaggaggctgaaaaggtgaattcctgtaacagcatcttttgcatcctcagcacgtgatcacagaggttactatcatagctaatcagctttataatatcagtaatatgaaaaagccatgctattcagatgtattaatttttgcatgtttgttttcaagaggtgagcattttaaatgtaacttggagtaaaaaactttataggctttgtatgttaatttcacatgtggaaatgtaaatactattccagtaggaaaatactgcaacaattgattgcaaaagctattcattgtctattataaacaactaatttttaaggtaattatgcaaggaaaaagatgaatggatactgcacatatcaactaataagtcacacaaggaaggaaagccagctaacttgcaaacaattaatgtttgatagaaaaatgttggcttttagagatgattatgcagtttacctctgttggtcccttccctccaacatgttcttcaaaattgtcttcagtattcttggtccttcgctcttccatgtgaattttaggatgagctggccaattaccccccttccccaatttttagataccatgaacaagatttttataacttttgcatgtctttttgtgaacataattttgattttttttgggtaaatatctaggagtggagtagctgggtcttagggtagataaggagttggcaacctttttttgtttgaaagtaaatacatttttgtctggatagcaaatatattttagattttgcaggcccctgtggtcgctgttacatatgcttctttttgttttgttttgttttgttttaacaacactttaaaaatgtgaaaactattgttagcttgagagctgtgcaaaaacagcccttggatcagatttggccagtgggtagacagtattttgctgatgcctagaataaatacatgcatgtttaaatttataagaagctgctaaatagttctccttcatggttgtatcatattttactccctccagaaatgtctaggtcagggtgcttttgtgtccttgccaacacttggtgttttcagtccatttgattttgtgttttatttttaagtggttgtgaagcagtatgtcattgtgtttttaattttagattttcctgatgaatactgatgttgagtacttttttgtgttattggtcattcatttatatttttttctgaagcatttcttcaaacataatgaaaaaaattagaaaagtagtaccagtatattggtatcagtttactgttatataccagtataacggtatctgtatacccttcacctagattcagcaattgttaacattttggcttgtttgctttatatttgtatccatatgtacattgtgtgtgtgcattttttttttttttggctaaacaatttgaaaataagttacaggacatggatgaagctggaaaccatcattctcagcaaactatcacagggacagaaaacaaaacactgcacgttctcactcataggtgggaattgaacaatgaagacacttggacacagggtagggaacatcacacactgtgtcctgttgtggggttgggggatgggggagggatagcattaggggaaatacctaatgtaaatgacgagttgatgggtgcagcaaaacaacatgagacatgtatacctatgtaacaaacctgcacgttgtgcacatgtaccctagaacttaaagtatatatatatatgtaaaaaaagcagcattaaaaagaatcccctggacaggaaaaagaaaaaaaaagaggccgggcgtagtggctcacgcctgtaatcccagcactttgggaggctgaggcgggcagatcatgagggcaggagatcgagaccatcctggctaacacggtgaaaccctgtctctactaaaaatacaaaaaattagccaggcgtggtggcaggctcctgtggtcccagctacttgggaggctgaggcaggagaatggtgtgaacccgggaggcggagcttgcagtgagctgagatcgtgccactgcagtccagcctgggcgacagagcaagactccatctcaaaaaaaaagaaaaaaaaaaaaaaagaaaataagttacagacattgtggcattttacccgtaaatactattcatctcgcagtaataagtatggttttctacatatctataataccttatgaaacctaagaaaataactcattattctataatatcatgtaatatgcctaccacattcaggtttttccagttgaccccagttgtcctttttaatatttttctttgatccacagttcaatcaaggttcatgagttacatttgtttattatacctctttagtctcttaatctaaaatagtgcccctattctccctctttttttgtttgatttttattatgttggcttttagatattttggctttgtatggaatctattttctcatgaatagattcagattaaatatttgacaagactacttcataagtgatgttctttctttttttcttttttttgtgacagagtctctctcagttgcccgggctggagtgcagtggtgagattataactcactgcagcctgacttcctgggcacaagcgatcctcccaccttagtttcccaagtagttgtgactacaggtgcatgccaccacgcctggctgatttttgtattttttgtaaagatggggtttcaccatctttcccaggctggtcttgaactcctgggctcaagagatcctcttgccttggcctcccaaagtgctaggattacaggcgtgagccaccgtaccccagccagtaatgttattttttttaatagtaatatcataacaagaggttcttaatgttgaattgttctgttgttatgctaagtatgatcatttggtttcatcaggtcttcccattataatggtacattttctttttttttattaaataatttttggggtgagtttttgaatccttgtgaatattttgtccctcaaccacctctcatctaatgtttttgcatcgataatgaaaattgcctgagcctgattactttggttacatttgtcttgtttgctgtctgtggagtaagctgttgattttctgctcctttttgaatctgcctgtttttatgtattatcttttttcttatgtatttgaggcctttagtatatttatttttagcatatttaatttaaagaatctatcatattattgtattatttcaagtttgtgggtgtttatttctattcctgactcttcctcataacatattgtttcctcgcatgtttaaattttggtgtgtgattctatgtttggtgcttttgttgttgaatttcaagatggtttgggttatggatttggccaggtaggataggtggtatatttgtttccatcacaccctccagggtatcactcatctgggactaatttttatattaaatttttggcataaagattgtcaaattttgaagataatgggaagaacaaaatgagattgcacacacacagatacacacctgttgaataggctcatggtttctaatatctagagacattttcgtttactttgaaccacagagatacgagcatagggtttatcctctctatttcgtaggttgattcctcccccacaacctttcactgagaatgtaatctttgagcctcctggctttagacagaagggtttccttcaaacctccaactcacacgggatctgtttcctttctctgatcgttaaaacccaatcttctagattattgagattcccaccttcactctccaagactggctcttgtggatgcagactgattttcatttttatattatttatttatttatttatttgagccggagttttgctcttgttgtccaggctggaatgcaatggcgcaatctcagctcactgcaacctccatctcctgggttcaagcgattctcctgcctcagcctcccgagtagctgggcttacaggcatgcatcaccaaactactgaattttcagtagagacagggtttcaccatgttggccaggctggtctcgaactcctgacctcaagtgatccacccgcctcagcctcccaaagtgctgggattacaggtttgagccaccatgcccagccagattttcagattactttttttttttttttttttgagacagagccttactctgttgcccaggctggagtgcagtggtgtgatcatagcaaactacagccatgaactcctgggctcaagtgattgtcctgcttcagcctcctgagtagctgggactacatgcacatgccgttgtgccctgcttcctttttctttttcatcccttgtagtttttttgtgagccaagctcttcatttgaaggatgtttgttatatttaatctaggtctttagatgtttctaaggaggatttgcaggttatttagttggcttattgttggtttgtcttaaaacaatatgacatcctattctttgttgaggaaattcccttaatttctttgagaaataaagactgatctagagcagtcttaaagtcaggctttccctaggaaaacaattcatttataatgatgagattaatgtgcctgaatccaggggatgaggctatagggaagcagtataaaatactccaatgggaattggtcagggcaggagaaagcaaaatgggagttaagcctcttattaagtcatgaatttttttttatgtttcattttccaggccctaggaaagcacgcttattattctctgggaagatttgtggagaatagtttatgaagagaagacaattctagtgcaagaatgtaaccagctgggattttgattgatattgcattgtgtctgtagatcattttggagtgtatagctatctcaacgtttttaagtcttcctatccatgaacatgtgatattcttccatatttaggtcacttggatttctttcagcaatgttttgtagtttcatactactataagtgtaattagttttttaatttcaattttttaaattagttgcaagtctgtagaaatacaaatgattttcatataatgattttgattcctgtaaacttgctgaactcttttattagttctaatagttttttagtggatttcttaggttttttttttttttttttttttaagatggagtttctgtcacccaggctggagtgtcgtggcatgatcttggcccactgcaacctccacctcccgggggtcaagtgattctcctgcctcagcctcctgcgtagctggggttacaggcatgcgccaccacgcacagctaatttttttgtacttttagtagagatggggtttcaccatgttggccaggctggtctcgaactcctgacctcaagtgatcctcccgctgtggcctcccaaagtgctgggattacaggtgtgagccactgcgtctgggccttaggattcttttttttttttttttctctcttgagaccgagtctcattctgttgcccaggctggagtgcaatggtgcgatcttggctcactgtaacctccgcctcccaggttcaagcaattctcctgcttcagcctccggaatagctgggactacaggcatctgccaccacacccggctaattttttgtatttttagtagaggtggagtttcaccacgttgaccaggctgggctcaaactcctgaccttgtgatctgcccacctcagcctcccaaagtgctgggattacaggcatgagctactgtgcccggccaggattctttatataagatcatgtcatgtgtgaatagagatagttttacttctttccatctggatgctttttatttcatattcttgcctgatttctctggctttaacttccagaacaatgttgaagaggtgagaggaggcatccttgtcttgttcttcatcttagggggaaagcattcagcatttcacccttaaatttgatttaggctctggtattttcatagactttcattatcaggtggaagaagttaattgctattcctagtttactgagggatttttatcaagaacaggtgttgcattttttcaaatgctttttctgtgtttactgagatgatcatgtggtttttgtcctttatttatatggtgtattgttacattaattgatttttttgggtgttaaaccagccttgaattcctgagattaatcccacttggtcatgctgtgtaatcctttgtatatattgctggattcagtttgttagtattttattaattttgtgttcatatttacaagagatattgtctgtagttttcttatgatgtctttgcttggttttggtgttagtgtgatcctggcctcatgaattggaaagctttctctcatcttctagtttttttggaagaattggtattaacttttctttaaatgtctggtagaaatcaccagtgaagccatctgaatctgggcttctctttggttagtttttgattgttaaatctacctttttacttattgtaggttttttcagatattctgtttctttaatcagtgtctgtagtttatgtctttctacaaatgtgtccatttcatcaaagtttctagcttattggtatagtattttcttatttttattttataaggtcagtagtaatgtctcctctttcattcctaaatttagacatttgagccttcccttttttcttggtcactggcctagtctgttcaggcttgttatggattgtcatagtctgggtggcttataaacaacaggaatttatttctcatagttctggaggctgataagtcaagattgaggcactgttagatgttgtccctggtgagggctcctttcttagtttcttagtggagccttcttgctgtgtcctcacatggtggaaggagcaagggaaggatctcattcatgaggtctctgccacaagtgttctgaaatagcattccagaagtacaaggtgatacagttagtcaagagctataaattggtggataggaaaggcaaaaataagaagattgtattgagtttctagttatacaatgaactgaataactccttttcttttgagacaaattctcactctgtcgtccaggctggagtgcaatggcaccatcttggttcattgcaacctccgcctcacaggttcaagcattctcatgcctcagcctcccgagtagctaggattacaggtgcctgccaccatgcctggctaggatttgtattttagtagagttggggtttcaccatattggccaggctggtctcaaactactgacctcaggtgatccaccctcctcggcttcccaaagtgctgggattacaggcgtgagccactgcacctggccctgaataactctttagaaacagaaaaaatctctggtggttggttaaatagtaaatataaataaatctataaatttcctatatatcaataaggtagaaaatacaacaagaaatgtaacctcgtagaagcaatggaaatgataaaacactgtatgatgtgaatttaaaatgaaatttttaggacttacatgaggacttcttatttttgtatagggaaaccgatttttaaaaatgctcttttctgtacattttctattaaatcctaatataacaacataatggggggggattgacaaagagtaaatatgcaagaatagcctagataattctgaggaaaattgatggggagtagcctaacatattaaaatacattttaatacattgtaagtcagcaagaagacataggtctatggaatacatttgttagattttaggcagtgggatgatgtgggaggatttttgagttgttaaagagggtctcatgaatattatgtggatttagaagacaaggtaattctaggattgcttgcctctaatttactgagatttttaggtatctcagagaagataagaaatataaggaatgagaaatgtttaatggctttagtgactaggagtttctaaatggacacatgggcccatttcattagtttggtgaatagtgagagcaaagaatttgggaatttaagattgttgtacttctccaaatgaatgttttaagtataaagactagtatgtctttccacaaaaatggtaaaatatattgtcacatttatatcaaactgctaaaataagttttgatattttttaaaaaatgagatctcatcaggttaaatgaaaagagttgagaatcttcattcccaaagaggaaaatgattctgtatatcaacagaatcattcaacctttgactgtattctctatctacgttcctaaattgaacctatctatacatattttgttgctttgtctgtgtacagtcatgttggatttaaatgagaaatatctgattttaccacgttgaaacaagaacctaaaattagggaagtattcactgtgactcacatcttacccaggcagcctgctgttgaaaggatgatccctggtgcgcactgtagtctcagcctcaggattctataatgagattgagtggggtttcctgtgagcactctggggtgattgacagtaaggtgagggcagtcatcactttttatgcctacccttgatgatatgtccctgctgtctggggagggaccgaggacgaataggacttggtgatgtctaagtaattagtgtatgttggttccagctgaacaaactggagggtaatgatcaggtaaatggaaatggaacacattaatgcagactaaggtataaaagaccttagggttaaacttttcaacattttatgggattattagaatatctttatttcattttttatatttacatgtctctgtatatacatacacttatttatatttttgtcagtgtatcttcagttttaccttagatgtatatagagatgaaagcaacttaaatgtgaaaacctcaaacgcattttttctcctttacatgatttcagaatattttcaaactttttctgtttggaaaggagttaaggttcttaattaaacattttctttttaatttcacaaaaattgttaatggacttgtttggagctgatgcctatcactgatcctcaaataggagcaaatgactaaagtcaggcttggaaaacttttttggggtgttaactgaaaagtatcaggtgaccttttatttgtgtgtgtgtgtgtgtgtgtgtgtgtgtgtgtgtacttgagaatgttatatttcagtaacattttcttaaactgccttttcttagtaaaggatattttaagatgatggctgtcctggtccatgtttcacagttggtcttaattagatcagaaatatttccagacatttaggttgcaataggaaatctataggattcttaatttattcttacaaaaggtatttatagttgccattcttcaatattaactttccttatcaacagcaaaaagtcttacggcaaagcctctggagagtgactgcagtactgcatttaatgggaagggaggaattgtttgccttagtatatggttttgaatctgggagtctggtaattaggtaatcaaagggtttaaaaaatggcataatggctttaaaacttgctattgctcacttttcttataaaacttagctttcagaaatctttttagattaagaatacaatgtacctactatgcaaatttaaaacaatagacttttcattaaagaactaaccaggagaagaaagcatttaagatgtgtagacatttcttttccttttctttttttcttttattgtctttggaaaaacttattttgcagaaacagtatactgtatcaattttaagtgttttgattatctttgacttggctaaattattttctctgcatttttgggtaaaatggaataggatgggattcctggtaggtatttgttcacattaatactatatttaattggagatcctgcagaatagtagcaggaggctgaagagaattatttagcattagcaatggctcgtctgggagttgtggactaatcaaggcgctgtagtgttagtggtggggatgatgggaattatgacgattatgacatgtaagcatgtctgtgtacgaattggacaggcaatgagttaatcaagaagtatgttaaatggctcccatgctgattcattattatctaccatagtgcctgtcaggttgtgtatttaaaaaacacaatcattgccaaattcaatatgtatatgagctgaattcagccattgtttgcttttccataaaataacctcagatttccttatatgtataaaaatagaaaattgtgtcaactgtgctgtgatttgtgtttatagtatggtatcttttttttttaacagagtcatttaaacctatgtttgctttgccctttcatatattcgtgtaaatattctctggcttgttttctatgcataaagggtttgggtttgaaagtgaaatttatgtgtctttacttttcaagatgaaaaaataattccagtatttcagagacaaattaatatttaacacatgaactatggacaaatcaaagcatgaatcttttccaccatcaaaatgcttgaatttaaattgggggtgggggtggaaacctcctttgctgtagcggggggtctctttgtgccaggtagacagacccattctgtgcccagcatggttggggttatctgtcaggaaactatctattagaaatgctagaaatgtatgtattttgggggaatggaactaataaattgaattccttttagaaaataaattgaaatgcagcataaatccatgagcaaactggattatatctctaggcaaatttaaagagttattgtacagatgaacaccatttttttttattattgtgagcactgccaaatttaataaaactttctaccaaactgtgactttcatgtattaacttaattaaagcagtgttatgggtaatactcagtgttaacctgtggatggctgttattgaaatccattatcaatggagtcagtattagtggtcagcagcatcagaagtaaaacttgcaaccaagaccctcccatgggtgctgtgagctcagcaggttaaattgtcaaaaaccagtaaagcttcttaaaggactgatagcttaagccacccggagttaaaggtaaactagtcattccagtcaagatggactatgactttatttagcagtcaggcaaaaattatatttgggcaggatttatatcagtatcttcatgtatgacttattcatttgtatgttcatgtaccttgctatttaaattcaataaaaccatccagctttttttaatctgtgggaagtgacttgtggatattttcttttataaaacgttaaggagatgtcttaagactttctgaattttttgttaataacttatactgaagttactttttacttatactaaaattttaaattaagaaaaaagtgaaatattgtattaatatatctttttggttttgtttattttataatttctggtaaacttaaacaacatggttttaaagggaatttatgtatttcagtgtaattagtacctgctgttatgaaaaagcacctaatcatggatttatttttctctaagcagctatttgggaaggatcagaagtcctatcttactgaaaaagcatacatataataaaagatttgagggccgggcgtggtggctcacgcccgtaatcccagcactttgggaggccgaggcaggcggatcatgaggtcaggagatcgagaccatcctggctaacacagtgaaaccccgtctctactaaaaatacaaaaagttagccgggcgtggtggtgggtgcgtgtagtcccagcttctcgggaggctgaggcaggagaatggcgtgaacctgagaagcagagcttgcactgagccgagatcgcgccactgcacttcagcctgggcgacagagctagactccgtctcaaaaaacaaaaaacaaaaaaaaagatttgatatacagtttaccttattctatgttccagtgtttctaaggccatgacttaactcatttttacagcctccctcattcagactccttagtggagggaaaggacatgattattccaaataatgcctctcactcattcagaatctatggtgtactggaaaagcacataattacataaggattgaattactgttactgttttaaattgagaaaattggggcttcaagtataaagccaatcttcgggttgccaaagatcactgggctagtaagtagtggagctgagattcaaattatgtgtaacttctaagttgtactgtttccactgtgcatgttgcttctcatactaagtatgaggaaaagtcccctcccaccacaaaacgaagtgaagtttattactttgaaggcagagtttttattagtgcctgttggaggctgggtactatgataggtactggaactagaagagtgactggaagtgataggattgctgctttagagatgggtatagagaaataaaacataaataattacaaattgtgataagtgttatgagggaaacaagttgttgagagagaatcatggttcccttcagtaatagggtgctcagggaaagtcttgctgaggggtaaaatgtaagctgagaatgatggatgagaaggagtcagccagctaggcagacaagaccgcgtgcgcaaaggctctgagtcaccccagtctgcttctgtcctcagtactctactatagagttcttgctagtgtgaccaccagttttctcatgttaagtccagtggacatttttcagtcctcttctgtttgacttcccagaatcttttaacactattaccctttttcagacactctcatcctctggctttggtgccattttaatctcctagttttctctctacttctgtggccctcctctgtgtcccctctacaggaatcactcaaggtttgattggtgggctcttcttaaaattgttttattttttgtactttctctacccttaccctgaaagatggcattctcttccacttctgtttctgtggttttaatcaaccctagactccaactctgttttctctctctctgtgacgtctctagttgaatgttttaccactacctcaaacccagcattacccaaactgaactttgatccttcgggcttcttgtatctgaatcctcctgcagaagcacaagatgtaggaatttatgttcaccatcattctttctttcatttctcatttccaatttatgagcaagtccttttcataaataattttggaatctagtcacctatcttcacttcgttattgcttctttagcaaggtcttttaaaatcttctagtgaatcttttaatcttttagactgataaaattaatttcatctggggcagtttatctaatgtgaactgtttcagtttctgaagttttgtttgatagcgaatgctttcttactctgttttggaattttagttcataggctcttttttctggtgaaagttaaaaatgtttattgctcttcatgcttcatcttctcccttccctttgcttccttgaccttcctcttcctctctctttcctagtttctctctcaccccggccattgctgcctcccaccttctccctgaccagtagttttgtgggtgcccccccgccggcattttggattcctaatctacatccaggtcttatggtgatagtttggacacatggcagattagtcccagcagcttgttcagattttgaccctgaagctgtggttctgcctccctaggtccacagtctccaggagttgtagtgagctgtagttgcagacaatacttggtggcctcctcttcaggccaagggcagttcctctttggcctggtcttcaccagtggctctggctctcttctcagtcttgtgagaacattctcgccatctgtactttgcatttggcacttcctgcttctgaggaaccagccagtggttagcattgttatgcgtttttctcctgttttgagtttgtgaaatgtttaccatttatttctgcttacctgttttcttagttttcctttctgggttttattgtcattgttgtacatttgaagtagagagagcttttgaaatatgaactcactgtgccatcctttttttgtgctaaatttattgaagtccacaaaaaccagagaaaaatgtcagatctcaaaattgtgtttttgctcaatttcaagcatcaatttatccaagttacccacttgatacctgacttgccctacttagcaagtcgaggcattgttttgctggctctggcactctggctatagccagtcactcaccccacttgggattgcttcctttgctgcttgttcctgctgctgctcagtggcagctgccaagttggagtagcaaagggaaaagtttagtaggcatcttttaggaagacagaatgctgtctggagatggcagtggtggatttatatctgagtcattcatctgaattggaacctgtacaaaggaaaagaggttctagctcagataaatagatataaattcattgttgctatcttcaggcattcatttatttaattagatgcactgaaaagcactctcgaggtgtggggacagggtgtggtgtatccaatggagagtttgtagaaattgttaagttgaggtacaactgcttataaatagtatttgaaaatgtcttattttgtaaacaactgagtatttagttgattgcaaatcttcctgtaaatcaatgatagattagtttagtttccgggtctatagtatattcctcaaatggatagtaggtatttttgtaaaggggactttataattaaatatagcaaagtgtcttccgtggactgtattaattaaatgttacagatccccaggctgcactgatgaaactcagctgggatgctctacatgtgatagggaaatttggtttcaaaattacacaacctatttgtgaaggtttcgtgtaatttttcttttcagtaagaagtgtttccatgtatcagtttttttacatttaaaaaagtaatttattttcaattgtggtaaagtatacataacataaaagtttaccattttaaccatttgttatcaaaagatgatgagatctgtggaggaaaaaatggagagctttattttctatagaaaaaacttgcagactggggaggcatagttttcactagtgaaaatgttgctctaaagagaaaaaaaaaggggcttggcttaagtagggaaagttcttgccctcattctctgtgaggtctgtgcaaacgaaggattcaagcttgttcggttcagattgaaccctaatctggtgccagaagtgtctctgtcagatgttccttcgaaaggctggtgcaggggaggtttctgctgcaattcttcttggccccagtcacaggaactgttctggcttaagaacagttcttaatcaagagccgtgatttccaagaacgaagggtggtgaccactcttctctcactctgctatggccgcttggacccattgtctaaatgtgggtatattagccacagggagtgcatctcatctggagagcttgcagttttatttacaattttatttcacacatttttaagcatacagttcagtaacattaagcacattcacattgttttgcaggatgaaaagttctggaaacgggtggtggcgatggtttcgcattatcaatttttacctagtatgcttttttttatacagtgttttaaagtgttggaaaaaacttatgcctttacagtattttattatattagcttatgttcattgtatggggttgtaggcagtgacagatactcaacctttaacaaataccgttgagcacttgttatgtgaagatgctccacatcttttgaactaggcagttgtggttcctgcactcttgtggcttccagttcagtggaagaagcagacattttataattacatacatttatgacattagtgtaatgaaaaattatagggtgttttgtaagtgtggaacaggaggatctgaaccagcctggggagtcagggaatgcttttttgaggaattcacattttggcagagacctgaagggggtgacaagagttaggtgaagctgggagaggacaatactagggcagaatagagcttggtaatttccagaaagttagatagggctaatgtactcttaaacaggaggcctgcattgttgttcacaatgttcacctatatgtagttgtgtttgttttttaaatttttaaaaattatcctatagtaataggatacccatctttcatacccttctgtggatatcagcacatgtgtagattatgtcactactagcacaatcagaatgcagagtagttccattacccctcagactcccttgtgagtcattacccctcagactcccttgtgtatcccattacgtgtcacatccttttccaccctgacactggcaaccacggatgtgtttcccatcactatagcattgtcatttccacacagcgtgtaaccttttgagactggctactttcactcagaatatgtttttgtgattcatccaaactgttgtgtgtatcaatagaatgttccttttttattaccgagtagtgttgcattgtgtggatgcacaggtttttttaaatccatttacctgttgaaggacatttgggttgtttccagcttttgacaattatgaatagaactgttgtaaacatttgtgtacagattctgtttctctagtataaatatctaggagtgggattgctggtcatatggtaagtataagaaactgctagacttttccagagttgctataccagaatacaatgagagttgtagtggttcttcatccacttcagcagtcttgtcaatatttttttttttgagacagagtctcactctgtcacctgggctagagtgtagtggcaccatcttggctcactgcaacctccacctcccgggttcaagcgattctcctgcctcagcgtcctgagtagctgtagctggcattacaggcacctgtcactatgcccagctaattttttgtatttttactagagacggggtttcaccatgttggccaggctggtcttgaactcctgacctcgtgattcacctgcctcagcctcccaaagtgctaggattataggcatgagccaccatgcccggcctcattttaaccactctaatatggtttggaagtagtatctcattgtggttttaatttgcatttgcctaatggttaatgatgatgaccttcttctcatgtgcttatttgccatccatgtatccttttcagtgaataagctttgcctgttttttaattcatttgtttgtttgtttttctgttgttgagtttagagtgttctttatgtattccgaatacaggtcctttgttggatgtatgattggcaaatagtttcttccagttggtaggttgtcttttttgtcctcttgacagtgtctactgcagatcacttgtttttaattttgataaagtcagctgatcacttttttcatctataggttgtgttttactgtcatgtctaagaactctttacctaacttcaggccacgaagattttcttcaagatttttgtagttttgccctttattgttagatatgtgatccatcttgagttaattctctgtaagatttgcagtcggtttttttgttttttgtttttttgcatatagatgttgaattatttcaacaccattcattgaaaatagtatttctctattgtgatggttaatattgagtgtcaacttgattgggttgaaggatgcaaagtattgtgtgtctgcaagggtgttaccaaaggaggttgacatttgagtcagtggactgagagaggcagacccacccccaatctgggtgggcaccctctaatcagctgccagcgtggctagaatgaagcaggcagaagagtgtggaaggacttgacttgctgagtcttccggccttcatctttctcttgtgctgcatgcttcctgacctcgaacatcagactccaagttcttcagcctttggactcttggacttaactggtttgccaggggctctgaggccttcagccacagactgaaggctgtactgtcggctttcctacttttgaggttttgggactcagactggcttccctgctcttagcttgcagatggcctgttgtggtacttcaccttgtgatcatgcgagtcaatactctttaataaactccccttcatatgtacatccatactgttagttctgtccctttagagaaccctgactaatacaattacttttgcacctctgtcaaaaatcaaatggggtgatatttggatgggtttcttgactctgttctttttcattcatctgtgtctattcccttgtcagtactacatagtgttaaaattggattcctctacctttctttttctccccccatttttccaaaactgcttcagctattctggttcatttgccttttcgtatacattttagaatcagcttatgtttatgtacacacacaaaaaaaatcctgctgagattttgattagaattttgttgaatctacatcagtttgggaagaattgacattttccactgtgttgagtcttccaatccatgaacatggcatgtctcttaatttatttaggttttctttgttggtggtggtattcttagacagggtcttgctctgttgcccaggctggagtgcagttgtgtgatcatagctcactgtaggcttgaccacctgggctcaaacctcccacctcagcctcctgagtagctgggattacaggcttgtgccaccatgcccagctaggtttttaatttttttgtagagacagggtctccctatattgtcaaggctggtcctgaactcctgtgctcaagcagttctcttgctttgggattacaggtgtgagccaccatgcctagcctgtttaggtctgctttgatttctttcattagcatttcatagttttcaatatgcagatcctgcacatgctttgttttgtttgttttttgtagacagggtcttactgtgttgcccaggctggcctcaaactcctgggctcaagtgatcctcccaccacagcctcccaaatagctcccaactgtaggtacatgccaccatgcccagcttgtactgttttgttagatttttaacctaagtgtaatttttttttggagactcttaaaattgtattgtttggccaggcgtggtggctcgcatctgtaatcctagcactttgggaggctgaggtgggaggatcattgagccaggagtttgagaccagcctgggcaacatagccagaccctgtctctacaaacaaacaaaaatatagtagggtgtaggggcacatacctgtagtcctagctgctctggaggctgagagggagaattgcttgagcccaggagtttaaggctgcaatgagttatgatcacaacacttacattccagcctgggtgacagagtgagactctgtctctttaaaaaaattattgtttaggccggtgacagagtgagactccgttattgtttaaaaaattttggtttccagttgtacattgctagtagtagaagtatgattaatgtttgaatgttgaccttgcattctgtgatcttgctaaactcattagttctaggagtattttcgtaggttccttggggttgtctatgtagataatcatgttgtctgtgaacagagacagttcgatttttttttctttataatttgtatgtcttttattttatttttttctgttgctctagttaggaattccagtatgaagaggaagaggagtagcagtggtgcacattcttgccttattcccaatcttagtggaaaagtgttcagtcattcagaattaagtatggtattagctgtgggttttttgtggttgctttttatcaggttgaggaagatcctgtctactcctaatctgccaatgaatgttgaatgttgtcttacacttttcctaaatcaattgatatgatcatgtggggtttttttccttttgattgtaatatgctattttacgctgagcgattgatttttttagtatgaagctacttttgcattttggttgtggtgtattgttttttatatattgctggattggacttcttaattttttgttaaggattttttacatcattattatgagggacattggtctgcagttttctttttgtgtactgtctttggtattagcataatgttgtccttataaaattaattgggaaatgtttcttctctgaatgagagtgtataaaattgttttttttttttttttttgagatggagtttcactcttgttgcccaggctggagtgcaatggtgtgatctcggctcactgcaacctccacctcccgggttcaagtgattctcctgcctcagcatctcaagtagctggggttacaggcgtgcaccaccacgcctggctaatttttgtatttttagtagaggtggggtttctccatgttggtcaggctggtctcaaactcccaacctcaggtgatccacctgtcttggcctcccaaagtgctgggattacaggtgtgagccacgcgcccggcctataaaattgttcagaattctccagtgaaaccatctgggcctggagatttcttcttcagaaggttttaaatgacgtattcaagttctttaatagttattggagtattcaggttatctatcttattttgagtgtgttttgttagctttgtgttttgccatttttgaggaattggttcatttcatctaaattgtccaatttatgcacatagaattattcttagaaaccttttattatccttttaatatctgcatagtttgtagtgataacctctttcctttcttattttggatgtcgtttttttcttcttttcttagtctttttagagatttatcagttttattgatgctttagaataactagcttaggttgcattgatgtcttttttctctattttctcttttaaaaattattgatatctcctctgttgtgttcttccttctactttaggtttattttgcttttctttttctggtttgtaaggtaggagcttagattattgatttgagatatatcttcttatttaatactataattttctctctaagcactctaagtgcatctaatatttttttttatatattgtgttttcatttttgttaagaatgttttctgagacttccttttttgcacataggttatttaaaattgtttaatttccaagcatttggagatttttctactgtctttctgttatttatttctaatactaattctctttgttcagagatcatattttgtattattatagtttttttcagtgtgttaagttcattttctgatccaggtatgacctgttttgttgcatgtttcatgtgcacttgtaaagattgtgtcttctgttgttagacttcagtactgtataaatgtcagtgagatacaactggtttgtggtattgtccagttcctctatatccatgccaattttctactacttgtctttcttttgagagtcttgatgtttccaacgatgactgggttattgtctgtttctcctctcagttctgccagtttttgctttatgaagcactgttgttaggaacatacacattaaggattattgtatctttttggtgaattgaccctgttactattaggtaatgttcttctctatcccttgtaaatttctttgctctgaagcctactttttctgatactaacctaggcattccagcctttatttgcttgatgtttgcatcgtattttttcccatcattttacctttaaactacatatgtcattatatttgatgtgactctcttgtacacagcatatacttgggtcatattttgacaatctcttttaatttgtatgtttaagtcttttttttttttttatttttttcgagacagggtctcactctgtcatccaggctggagtgcagtggcgcgattatggcccactgcagcctcagcctcctgggcccaagtgatcctttcacctcagcctcctgagtaactgggaacacctctagctaattttctttcgtggagtcgtggtctccctatgttgtccaggctggtcttgaactcctggactcaagcattcctctcatttcagcctcccaaagtgttgggattaaggcatgaaccaccacacctggccacttttatgtttaatgtagttattgaaatgtttggcttttgggctactgttttattattttgtttttctatctagtttttttcactgtttcactctttgtgtcttcttttgcattatttgaactttttaaaagtattcctttgaaatttattgtgtttatgactatctcgtgtagtttttcttcaaattaatactttattgattataatatacatacttaacttcctatggtctattgaaaattcatattttaccaccttaattggaatatgtcagtcttaccatcatgcaggtatctacattctcttcttatgttatggttttcttacgtgttatatctgcatgcattgaaaaccccatcagacaatgttaaaatttttgctttcaacagttaaacgtatttcaaaagcaatgttatcatttctgttgctcttccttcattccttatgttccagatttccttctaatgttattttccttctgtctgaagaacttccttaagcagttttagagctgatctgctagcaactaatgctcttagttttcctttatttgaaaatgtcttggctgggtgcaatagctcacgcctgtaatcacagcactttgggaggccgaagcgggtggatcacgaggtcaggagttcaagaccagcctggccaagatggtgaaactctgtctctaccaaaactacaaaaaaattagccaggcgcagtggtaggcgtctgtaatcccagctacttgggaggctgaggcaggagaaaggcttgaaccaggacagtagaggttgcagtgagccaagatcacaccactgcactccagcctgggagacagagcaaaactccatctcaaaaaaaaaaaaaaaaaaaaaaagaaagaaagaaaatgtctttatttcgccttcattcttagaggatatttgcactgaatatagagtactgagttgacagttctttctttccagcacttgaaaaacattatgtcacttccttctggtctttgtggcttctgatgtgaaatccatagtagtttgagtatcattcctttatagttaatgtgttgtttttctttgtttactttcaggaattttgtctttaattttcagtggtttgattatgttttctgatttctttttgttaccctgtttgagattcactgaccttcttgaatatgtaggtttatgtcttttaccaaacttgggaagttttcagtccttattaaaaaaaatattttctcagcatggtgctgagaacattttttttcttcttttctctgatagacatgtatgttagacctttaagtattgttccatagtctcttgttaattttttctactctttttttctctcttgtttcagattgtataatttctgttgatcagtcttcagatttattgactctttcctttgtcatctgtagtctacccttgagcccatccagtatgttttttttaatttgattattgcatattttagtttaaaattttccattggtttctttttacaaattctgtttcttttctgatactttcaaagtttccatttgtttcaagagtgttcataattgcttgttggaaaactttaataataacttccttaaaatctttgtgagataatttcaacatttttgttactttggtcttggtatttgatttttccttccctgtaagagatttacttggttcttgggttaattttagatattttgagtatgatgttatgagacataatcctctgaatttagttcatttctttttaggatgttaatatttttgtttcagtagcaattaacttggttggcttcagagtgcacattccagtttttttttgtttttttttttcctgtgggcggtgggtctttgtactcctatacagatccaccccacatatgtgtcaacaactcatcagtctgggatctgtggttagttcagtgtttaaattctttggtatacttattagaattacatccatacatgcccaacctagggatgagctcagaagttcataaacaactttattgtgtcacttctccatgctagcttctcccattctggttctttaggccttcacttttcagtcttcttacttagaaatctgaggttttattaccttgctctgctgttcaaattttgtgtttgtgtccaggacgtgtaaagagcacagagagagcagaaaaaaccttggggttttacctgccctcttgagactgcagtttcactgattgaagaagaatgtttcttctctcattgttttggctcttgctggcatctatgtctgcctctggtaccacagccacaaaattacttgggggttggggcaaaaaagaatagagcaaaaggaaaaaaaatatgggaattgagatttccataatgttgtaagtatcaggagctcccttttctgccttttgagtgagatgaataggggttctcctggagttctctccatcagtgtccccatgcctactttgcatttcaggcttttccaaggtcggtcagggagatcatgggaggaaaagaaaatgataaaactcaccacttgtttatagtaatttgaattcttttcttccttgatctgcctgctactgtttgcttttccaagtctataaatacttgattcgtgcattcttttgaggtttcatagttgaattcagtgggatagttggggtggagcatgcttagtccatcttacctgcagttagaatggccaggggtgtttcttgaaagctacttagaaaacaaatgtgggaaggaattagcagaatgcatctttgcatcctgtatactatgttgtgtatcctatattatggtaaaagtttggttagataacagaggaaaataaaggaggttttcattgttgatagcactatgtcctaaccttcatctgaggttactgggagagaaaggaaagtgttacagctaattgcttgaatgactcaactgcagtaatatatagtaagctgctattaatgatgcagtatagcttgcctcctgtggatgttattttctttccataggagataaacattgagaatcacagacttcccaaaatccaaacactttaccgtgacattcaagatccattcaagttcctactgatttttcttctaccatcctttcccatcagtcccttttcatacactttattttcaagccatctcacagatttctatactggcacctttcacatttccaccatttcgaatgtactctttctctgttagttctctctcactttttttcatttattagaaatccagttttattgttcaatagccaattctctgtgaaaccatttgtacatgttattttttattacatttatttatttatgtatttatttatttatcagacagagtctcactctgtctcccaggctggagtgcagtggcgtgatctcggctcactgcaacctccacctcccaggttcaagtgattattatgcctcagcctcccgagtagctgggattacaggcatgcaccaccatgtccagctgatttttttgtatttttaatagagacagtgtttcaccatgttggccaggctggtttcaaactactgacctcaagtgatctgcccgccttggcctcccaaagtgctaagtttacaggcgtgaaccaccacacccagcctttattactcttaattgcagttggtgtataagtctttcataccagaccaaactcctggaggggtagaggactgtgatttatcatctttttataccttgctgtaataaagtatacctgtaataaatttttgagtggatcagggaaaagaaaggaagtgttcatgatttagttaatgttaaagggatatgatgggtggaacatcaaatagttgaattacataagagagtggaaaacaaaggcaagtactgtttaaatggaattaggaactaatgttttgggaaatatgtttcgatgactttgagtgttggcaataatacttggaaattcattttttctgatctttttattatatacagtttttcttccagtagggcagattttttttttctctagtcttttctcttctgagggccagctgccacctcctataaggtagagtttttctaccttgtgctgtccagatgtttctttttatttgaatttatttatttactcttttacacaaaagaggcatgccaacagctgcactaagtgttctttcctaagccagccagatgtttggacttggagaaaagttagattttgaaataaaagacaggtggattatagcccttcattcaaccattcagtttttccttgcctattgctgctgccaggtagggtgtctttaacccgtctttatagtacctcttgtcacaaatttagttccagaaattaaaggactaactcctcctgaaatctctatgagatgaaatgagccttctttttttttttttttttgagatggagtcttgctctgtctcccaggctggcgtgcagtggcatgatctcggctcatgcaacctccgcctcctgggttcaagtgattctcctacctcagcctcccgagtagttaggattacaagtgcgtgccacgacatccagctaatttttatatttttagtagagatggggttttgccatgttggccaggctggtctcaaactgctgacctcaggtgatccacccgcctcggcctcccaaagtgctgggattacaggcatgagccaccacacccagctgaaatgaaccttcttacagactagattctatgtggttgtcctagtatgaggctggtaagcttgctgacatcatgcttgggttttcatctgatgaggttcagctggtggcccagcatagcgtatcaggctccctgtgtatgacagtgccgctggagatgggtcattcttcgactagtaggtgatttgatctcccctgatacatttatgttttttcacattttgggctctgattctcccccttacatgggcttcaattccaaggaaggtaggagttgagatacaggtacccttctgtttttcaatcctgctactcttgctgtgtttatctgagtgtggttctcttatactctgtaaactaagtccctaaagaggaacttctgttcctggtagctggacctacttaaggagttgcaggtaaattcagtgaatggcatagtcactttgggtctttaactattgagttaaaatatctttggccaggtgcggtggctcatgcctgtaatcccagcattttgggatgctgaggtgggtggatcatttgagggtcaggagtttgagactagcctgaccaacatggtgaaaccccgtctctactaaaaatacaaaaaaaaattagctagctgtggtggtgcacgcctgtagtcccagctacttgggaggctgaggcatgagaattgtttgcacgtgggaggcagagattgcagtgagctgagattgcgccactgtactccagcctgggtgacagagcgagactctgcatccacaaaaaaaaaaaaataaaaaaaaaaaataaaaatctttattaattattagtcttggatgaataggaagaaataaaaattgtttcttgagctccttcaaagtacttattctgtcttcgggtatagaatgattttcttttttgggaaatggggagaaagaatatttatttttgaagagaaaataaaacacttctagacatttttgttttctttttgttgttgttgtttgtttggttttgagtcagggtcttgctctgtcacccaggctaaagtgtagtggcacgaccatagctcactgcaacttccaactcatgggctcatgcaatcattctgcctcagcctcccaagcagctgggattacaggtgccagccaccatgtctggctaattaagagaaatttttttttttttttgtagagatggggcctctgtgttgcccaagctggtctggaactcctgggctcaaatgatcctcccatcttggcctccgaaagtgttgggtttacaggcatgagccaccatgcccggccccagatatttctgatgtctttaaatttcataccactgcttggtgaaaaatgactgtgctaaggaaaacttcttgagctccgtaactgcttttcatgattaccttcaatgtctgggagctaactataccaggaagcttttgagtggttgattttgctgctatttgtaatactcatctgatagtttttggtaagaaactaaacagccatataccgtaaatcaagagctgtcctgtcttttgggatcccagcaaaaatattggataatgtgggaaatggaatctgagcccagaaagccagcttttagagtttctaggaatgccatgatgtctgcatagatactaggagaaagatactcaccattaagatacataaatagaggaatggctgtagtaatttaggactggtatgatcactttcatgtactcatttttatatcatattagatgctcactagattagttgatgcttttcatgacagtcttaaaaataagttttaactgattaattgtagaaaactatgttcttgtttataatctttgatttttaaattaaaaatacatacactatatatttcctatgttaagaaatgaaaaaatttaaaagtcctgacttataattaaggctgttgggatgagccagacttcatcttcctgtcccaaattcccagggatgagaaaaagttgaagagaaaagacctaaagataaacaacaaaccagaattttgatggaaaatggtaaagagtactcatgggatcctggaaatgctggtcctggaaacagtgaggaattttgcaagagagatggctgatgggatcatgccccaggaaaccccagtctgaaacacagataggagaggatggctgcaaagatgggagcagctccagaggagacagccttgagcacaagaagtgacatccagctaggtgattcttccacactcagtgtccatgagggagcagatgattcgtaaacaggtagagccatatcttggaattctttagtagttaaaaagactgaggtggatctctgtatatcaacagagaacatctctaagacattaaaaatggaaagagaacttgtgtaaggacacatatggtataatgataccattaatggtaaaagaatcccaacctaaaatatctttatagttacctatgtaaaagcatacagcataggttctcaacagtggcattgttcacattatgggttagaggactctgtcatgggcgactgtcctgcacactagagggtttttagcagcatccctggcgtcttaccctctagatactagtcgtgtcccctcaggccccagtagtgacagccaaaactatctacagacattgccaactgtgtcctgggggacaaaattgctccaagttgggatcccttggcatatattgaagtctaataatgcatattcacctgttaagtgattaccggagagagacattgtaatggggacaggtgtggtcagtggagttgttagctttattttgaataagaatgtttaggtataacggtagggcgcagtggctcacgcctgtaatcccagcactttggaaggccaaggcaggcagatcatgaggttaggagatggagaccatcctggctaagatggtgaaacccatctctactaaaaatacaaaaaaatagctgggcatggtgacatacacctgtagtccctgcgactcaggaggctgaggcaggagaatcgcttgaacccaggaggtggaggttgcggtgagccaagattgcaccattgcactccagcctgggcgacagagtgagactccgtctcaaaaaaaaaaaaaaagtttagctattacatatatttacatatattacatgtaattaaaaacaaaacaaaagatagttttgcttttttttttttgagacagagtctcactctatcgcccaggctggagtgcgctggtgcaatctcggcagctcgctgcaatctctgcctcctgggttcaagtgattcttgtgcctcagtctcccaagcagctgggaccatagatatgcgccaccacactcggctaattttttgtatttttagcagagatggggttttgccatgctggccaggctgatctcaaactcctggcctcaagcgatctgcctgcctccacctcccaaagtgctgggattacaggcgtgagccaccgcaccggccagctttgcttttttataagatatctgttgtattaaatttaaaaatggttaatggtggctgggcgcggtggctcatgcctgtaatcccagcactttgggaggccgaggcagacggatcacggggtcaggagtttgagaccagcctgaccaacatggtgaaaccccgtctccactaaaactacaaaaattagccaggtgttgtggcacatgcctgtaatcccagctactcaggaggctgaggcaggagaatcacttgaacccaagaggcggaggttgcagtgagccaagatcgtgccactgcactccagcctaggcaacagagtgagactctgtctcaaaaaaaaaaaaaaatggttaatagttagaagaaatacaggtagcttacaaacgtgcaaatgtgcccaaactcactaataaccaggaaaatgcgaattaaaaaaatgaatcatttttctccattacattaataaaattagaaagataaatcatgttcagtgatggtgtagtgttgggaaattaatctctaatagtagtgtaagttgacctaagattttaaatgtgtagtttgtggtatttgtatttaaattaaatatttttcttatagaaatatacatatgtatgcagattggcatgtttagggaagcttattgcagcgcacaatacctgcaaattggaaccatgtccaatactaggagaatggttaaataagttatggttcatctagattactagaaatactgggtagcagttaaaaattatgaggtagaattctaaaaaaaaaaaaaactgagtgataaaattagttgtagaataaaatgtagtgtgattcagtttataccaagaaaaatcttaaacatgaaataaaactctgcacctttatttctgcatatccatatgaaaatgcttaggtaagtttggaaggacacatgcaaaactgatcatggctggataacaggaaatgggactaggagcctttaaaacggggcagggaataatggttatctggtatctatactgcttaagctttttttctttttaaccaaaggagtaactcatacattacttgggtaattacaataaaattgaaaaatgtaagaacatctaaatgacttgctttatatgcatagtgtcatcatttagtggcctgtgttgagcagtgatagctgctgctggggctctggtagggctttaagatcccatgacttttggtggctctccatattttgtggaattggcattagctgttcatatggtttggaaacacttttttaaaaatattgatttcagtggagattatttcccaaccctattcctagaatttcactctgttattgcttcagaaagatgtattcagaaatatatgcctgtgtatttatgacttcatcactagactttgaatgcatgtgtgatagctttctctttagtaagtggaaattaatcttaaagattgcaagctagagctgagcccacactcttactggtattttcttgtttcctcccctaacctaacttgtcatagtttttcttaggtagtattatttatttctttttttactacgtagtgacattcttcaaatgtatactttcactctggcttgtccgtaattggctggaaattgtgatggatctatatagttttttttgtgtttttaataaaatctgtataacataaagtttactattttgctcattttatttcatttatttaattattattttatatttttacagatggggtcacactgtgttgcccaggttggactcgaactcctgggcttgagtgatcctcctgcctcagcctcctaagccgtggggactacaggaactgggccactgcacacggcagttttagtctttttattttttattttttgagacagggtctcactctgttagccaggatggagtgcagtggtggaatcacagctcactgccaccttagcctccacttgggaagcctcttgggtctgccactgcttgtcagaaactttttactctgaattatgtcatatctcaggtgtttttacctagttattttgcacattacccttctcaaaggcatttgttcaagtttttcctaagctaatgaaggaaaacaaacctgagtcatctcttggctgtcactctgcctctcctactctttacatccagccatatgtacagtcctcaccccacccaccccacccctactctactttttcctctgctttattccgcagtcctttcatttgtggtctggtacccaccagctacactgacatgactcttgctaaggttttgcttgaatacttgatgtctcctttctctctgtcattcctccccttctcccttgatgcttctactaaggggtcagtggtatgagaagatagttctcctcctgctggttttcattattttgttgtttactgtatcgtcaggaatgcatgcttgcaagacaaagactaaaacaaaaaacaaaaaacccaaacagcaaaaaaaccccaaaacacctttgttttggttccgagatcgattcagtattagttcccttttgtgaaatgaaaacaggattgtagaaaatgggctgggaattttgcaactggcaaaaacgtattctctttttttcctgtagtttaaaattttaccactttgaaaatcatgtaagttatcttagaagaaaaatagtagtccactaattctaccatccaaaataaccatgaataaatatgtcttggtgctacacatgtagtttttcaaaatggaatcaaagcgaatctttaaaaaaaatcattttgttttctatgatcaaattgcctttctgggaaaggacatgccagaatgttagttttttaaaacttataaaagtatctttagatactttgaatgaaatagaaagagttctattctttttttttttagaaataggattttatctggttgtttgattttttttttttttttcagttattcaaatgaagattgatgcagttggctttcctttaaccttttagtctttcagggtaattttctttctttttttttttgagactcccaacaagtttattattttttaaattgtggtaaaatgcttataaggaaacttgccatcttaactatttttaagtgtacagttcagtggcattaagtacattcacattgttgtgcagccatcactataatctatctccagaactctcttcatattccaaactgaaactctgtacccatttaacagtaactccccattccaggctcgccacagtctctggcaaccactattctactttcaggataattttcattggttagtaatgtttggataatttgattagatttggtggatactgaagactggccgggttatgtaagctgttgctactttcagccaaggagtgcatctagtccgtattacatcatccttggagtgttctacccagtgtcttgcattgaaggacatcagaaggaaaactcctgtattctcagtcgtggtaaatagtgtccacttcattacagatctccttgagtgataggtttcaaaatatctctaggcatgaagaaacatttccaaacctgcttgtcttctctacctttctcagtatgtactagtttagaaggtattcaaaatctttcactgagaccattgagttttatgctaaatataacatctggcctagcactttttatcactcatatgcaatctatttgataaggacagggaccaaatagaatgtctttttcaatgtattttaggcatctaattgactaatatgaaattttctattaatccagagtttttaaatgcaggcataattcccccccaccccgcccgcaaagattcagtcttgctctgttgcccaggctggagtgcagtggcctgatcggctcactgcaacctctgcctcccaggttcagcaattctcctgcctcagcctcccgagtagctgggattacaggcatgcaccattacgcccaggtaatttttcttttgtattttttggtagagacagggtttcaccatgttggtcaggctggtcttgaacccctgaccttgtgatccacccgcctcggcctcccaaagtgctgggattgcaggcgtgagctactgcacctggctgcaggcatactttttaacctatttatatccaaacatttaaatttattttttatttttattatttttaatatttttatcattgtatatgtttatttatattattatttcaaattgtttattaggtatgaattttacaaactttacttatattagcggtaacggtggagcgggagagtattgcgccttctccaagctccccggcgagaaccaccaatagtgtggtggaacttacggccgtttccaagggccagggctcttttggcctgcagatgtcagcccacacatctccctgtgctgtggactgatttggtgatccattaggtgtcaggatttcttctgatagctttatggaatggatcagtgaggataacctcaaaaaatttgtatgtggaatcttcaccaacccagtaagaattcaggactctcaaagccccacagtggcgtccagcttgctcctctgcaacggactgaaggcttggagcaaactttagctggttaacaccatgatggacaggcttgccataagttgcacccttaggaactgggcgttttcggccaccacggcaaacacgaatcctatatataacgtaaccttgcttggcctcgcagcccagtcagcgcgctttatcaggctgggtggggcggagagccctgtggagagcagagagctggcggtactgccagcagcggaccctcagaagaaagcgcatgacatcagactgctgctttctccgtagctcctggatgtactcgtatgcacccatcttggcttacctgatggctgctgccagacggaagaaaagaagtttaatttattttttaaaagttaataaagaagatgatttttctcagtcctgtaagatgaaaaacacatctgttgttctagttatttggaaattaggctcatacgggtaatagttgatgctagtaatttttctctgaagaataaaataattcaaaatagaaaactaaatgcttggctgggcgcggtggctcacacctgtaatcccagcactttgggaggctgaggtaggcggatcacctgaggtcgggagttcgagaccagcctgacccacatggagaaaccctatctctactaaaaatacaaagttagccggggttggtggcgcatgcctgtaatcccagctacttgggaaggctgaggcaggagaatcgcttgaacctgggaggtggaggttgcgatgagccgagatcgcgccattgcactccagcctgggcaagagcaaaaactctgtctcaaaaaaaaaaacaaacaaacagaaaacaaaacaaaacaaaaaaaaccctaaatgcttgatgggaaagctaataatctgctttaaaaatctctattggttttctgagaacggagaagtttatgaagacaaactatacttagtgttagtatttaaaatgctttacttttctttttgaaacatatagccagtaaatcctgcttagttgattagtgtacctcagtttaaactttccatggttgttatgtatttcctttgccattaaaatatataaaaaggaatttatatttttcaagatgttgaaatttttgaaacaaatatatctactcagcctatgcaatattaagtcattctgcagaatagcatctgcattgcttgaatattgtttgtttgttttgtattattaagccaaaaaaaacacctcacacatttcatacaacaatgacaacaaaattgaaatagagtttcaaaagtttgttagattgttctttccaggttgactcttaagtgtctctttaactaaggcagtagagaattcaaatgttttcttttgcatggccttttgctactagtgaccctgggctagactgtgggcttgttgagatgtgaatgtaccctgccccctgaagtaagatttgttcctgcaaatggaggaaaagaagccaaccaatcctttataaacaatttgtgtttagtccttctttgtaaagtccatagcagttttgacctgcttttaatgcatgatttattcaattgtttattggagcactcttttttttttttttttaaactggaacaatcttaatcacccagtaaaatatattaggctctgagctagttcttgataggtttattttatttatttatttatttttttgagacagagtctcactctgttgcccaggctggagtgcagtggcgcaatctcggctcactgcaagctccgcctcccgggttcacgccattctcctgcctcagcctcccgagtagctgggactacaggcgtccgccaccacgcctggctaattttttgtgtttttagtagaaacggggtttcaccatgttagccaggatggtctcggtctcctgacctcgtgatccgcccacctcagcctcccaaagtgctgggattacaggcatgagccaccgcgcccggcctagttcttggtatgtttataaaacgtttgtgataacataggaaaaatgtctattatgctagttaaaaaacaaaagggtgaaaattatatatgcggtatcattacgaaagtgtatttagagaaaagactaaaaatgtcaatactattaggattctctctctcctttttacttttgaatgcatgttcattatagaaattttggacacataaacacatgtgcctatgtgtatcttttaatttcttttccttgataaaccaccaattgccatatgtattgccaagattaagaagactttatgtaggtgtagatttttaccttaaacataatgaaaaaaaaataataaaagttgcaactttttgtacctcaaagacaatggcttttaacatttgataatgaaagttattaagcaagctgctatccaagtgtatctatgagtaaatagctttaatcacataacattgggctaggggagattaaaaaaagaatttaaggcgtaaccttatgatctggtggaggagaaattgtaactgtgcaaagcagttaaaatgagattgttgggtagatgagattatatgctaaaatttgcactaactactctcagagtttagattagaggagattcatcctaaattgaagtacttgggaaagatccagtggtagatgtgaaacttggagtccatcttctataataggtggtatctgaggacaataaaacaagtgtggatttaagtttaaacaaagacttaaatgtattctttttaaaggattgtgaagtactcaatttctttcttacagaagaaaactacaatcacaattacaacaacaaaattgacagtaacaggatctgaagtggacagagggcaatagggcaatagaggagggggcatcctggtctgagggcagaagagcaacttgaggttgggggcataccaggcaacgataaccacgaggaaggccttgctttgaacacagggatatttagaagccctttgcaagcagggctgcttttccctacaattggtattattaaataattaccgaatgtatatatttggatattttatagtaagatattgacctgaaaatcccttgggcatttacctgatcttttacctttcaatactcaatataattttttactaaagtggaaaatatttattgaattgacaaagagaattcttagctttctaaaagactacttttttagttttttaagatctcatttaaaacaaagtatttaaaaattatttcataactgaagactctaacagaaatactcaggtatttgccacctttgacttttttttttggtagaaggtgggtcataaatgtttaggtatatgtttgtgttccagtttttatatctgccttgcaaaataattgtaatctggaagtttctgaaactggaaagccattaggaaattaggaaaagtcatttaaaaagatagtaatcctttcatcagttaaaaagaatagactccttttagaactaagcagtttactctttttcatattgaatgcttagcttctattatgcaaaataaatagatttaaacattatagagtgagtagtcttaaaaatggagcatacattcctgaattttgagtagctttagaacttaatacacatatcatttcttttaggaataaatgtaaaatggatgaagattgaatgtgagagtatttaaatgattctcaagattttctggttcatgtgttgtgatattgaactctttctttcgtcttaggctttaatttgtgcctggtgctgacctgatgctgtgcagggacactcactgcatccctccattcagtccctctaattatcccaacttcctggggagcttgcttagaactgggcatgagtgctctttattaaaatattgggctaccctggctacatgtaacaaggtagtttttgatatcaaatttatgtattgatgaacggaataggaagctaaaattgtttgctgtgattttacataaagagataggggatattatggaaattatttggttagacaatgaattaggctgtaataaatgaaatcatggttaatagagttcctgagtttatttgttgcattgttgctttttagtgcatactcaaaaagaaatacgactctataaatgataggcagaacaatcagatttgcaattttgtgtgtatttgcagatgatggtaattctttttgctgggcgcatctgttaatgcagaaatttgtctcctcaggttcatgtgaaaatggcggatgaggctgtctgtgttggcccagctcccaccagtaaaagctacctcaacatggatgccatcatggaagccattaagaaaaccagggcccaagctgtgagtctgaatgaatctatctactgcagctgtttcatatgtagtgagcagaaagctagagtttgtatttaaaaaaaaaaataggaaagaatgattgaaaatgctgttgcagttagttcatgtcacatgagttaaatgtggtcgaattcgctactggaaatcaaaggctttgtagcatctggcagtgttggttgctgatcctgcaggtggctgctggattcagctttcacaccagggagcagtttcagttcatttccaaatttgctaggaaaaaagaaatcccaattagttttgagtattaaccctttccgtgtaataagagcattttaaaaaattctgtgttataaacaggatccaaagactgtgttcaaattccattttaataatttaaaaattacttatacctagtacacttccagaaataaaaacagcacatttggtaattattttagtttgttaatgtcagtagaatgctcataatttacaaggataaatcattctctccacccccagttctgtttgaatagagtggaatccaaggaaaaaaatgatttctgatatcagaaacagtgttttttcttctattttcttttttctttttttaattatcagaactaattatatatagtgttaaaaactatgcaaagttatctctaaaactggatggaaacatccaacaccagcaattaagcctggagcgcttcaattagcgctcacatttcttttgaaagaaatgttttagtaagatgaatgtttaaataaaaagcctaattcgtgaacccatattatagatgtttacagtttattagcacagttagtgaaggtaaaacactttaaccttttaactatagcttgccaaaataaatatgtagttgagtgttgataaaatgaagttggtggaatgaaaactcttcttctctgatacagtagtttaaattcttctgtaccatgctcataaagcttagttcagctttttttttgttttgttttttgagatggagtttcgctcttgttgcccaggccagagtgcgatggcgtgatcttggctcactgcaacctctgtcccgccaggttcaagcgattctcttgcctcagcctcccaagtagctgggattacaggtgcctgccaccatgcccagctaattttgtatttttagtagagaaggggtttcaccatgttggtcaggctggtcttgaactcctgacctcaggtgatctgcctgcctcagccttctaaactgctgggattacaggcaggagccactgtgcccagcccgagttcagcatttaaaagtcgctgatacgtagctatttctggattatgatactggttcctttagaaatttgactctctttttagcagaattattttactagaagtatgttcaacactggctgatactgaagtggcgaaatttatgtttggccagtctgggagagccaaaaattacttgattggatcaggctggtagattgtagcaatgtggcttgtgggtgaggatagtataaagtagttgtggatggcaaagtttggggtgaggaaggaaagaagagtagacattagaagaaaaaaaattcagagcacaaaataaaagtaaaaccacacctccattttagttcagtttgatagaaacggcttgttggtagttgccgagtattattaatgccatcaggaataaaatgtgttagctgtcctagtagtctgggttttggaaattaccagttcgtgagtactgtaaagaaaggagaatttagagtttttcatccatctttgccaaggttccttttacataattctttgatgcaccagccattgtgaaattctccagaattgtgggcaaagttagcctcaggaaaaggagagagagttttgttgaatagtgtagacaaatgccagtgggcaggaagctatgtgggcatatactccccattgtggttaggacaaaggtagtgtgtggaaaatgaatcagttaggacaaagggagtgtggagaaagtaaatataagaggcagtttcttggaatttgattctgatcctagaaatgtgagttagaactgatcagtgtataagagaagtgtacttattcaagggctcttgaacagtaaatattaatacataaatgcactgtacattttgcttataaagcttttgcaatatgataaaattgaaagtgctttttgctttcatttctaaggtacatccaggttatggattcctttcagaaaacaaagaatttgccagatgtttggtaagttggtaatgaaccagaaactgttcatttctttttcagaaagcagtgtggtagcatggctttgtaaatgtgggtagtgatggattatagaattttaattaacccagcagttctttgaaaattgtgacaagtgaagtggttttagtctgaaactcaactgtttatttgaagagtaattataaaaacagaaaagtttacaaaatcaccattacactgaatgaatgatacctggtttattatatactgcatgatatttgaattaaagttaaaaacttcagatttttaactgtaaatatgttagggagtttagtgagttattgtagtgatttaattattttgtggcatttaatatcaaatcttaccaatgcctctattttgggtgaagttgtttttaatgatctaaatgtccccttccagctaggtgaattaacgtatgtttgttattaaattgatttttccaggtatatttataacttcattcaagatggtactgaaaccttattttttaggtactagaatatgattttgattaatgtttgtacatatgtttgttattagatcaattatgccaggtactatcttaatttattctaatatgttatacttgtttctgtggcatacagtcatgtgttgcttaacagcgtgaatacattctgagaaatgcatcattaggcgagttcatccttgtgtgaacatcacagagtctacttacagaaatctacatggtagagtctcccacacacttaggctaagtgtgttatagcctattgctcctaggctacaaacctatacgtgttgctgtactggatcctgtaggctgttgtaatacagtggtagatatttgtgtatctaaacatgtaaacagggaagatacagttaaaaatacagtattagaatctatggaaccactgtcatacgtgtggtgcctcattgaaatattctgtggagcataactgtactcgtattctgttcttccacggattggaaattatttgtgaatgttgttattttctagatggaatttccacttaaaatctataactttaacttgaaacaattattaagatcacagaattgtctatttgaaccaccttgctttgtgggtccaaaactaaggcctaaagagatatcctgagggggcaaattacatggacacatccagaggttccagtttcccaggttttatgcagcatatctacatttttttgtttatatccctttttattttttatcttccttggaattttgaccaagattctgttattataaaaactatttgaatataatacttaaatttagatgtgtatgtgtgtatatatataatgtaatgtattacatttaagtccgtatagatgagaggtcggcacactacagtccacaggacaaatgcagcctgctgcctgtttttgtcaataaaattttattgaaacacagccatgctctttcatttatgcattgtctatgctgcttttgtcctgtgacagcagagttgagtagttgtgacagagaccatttggcctatcaagcctaaaatactttttctatggtcctttatacaaaaagtttgggaactcctgctataaatgaatatccaaatccaaattatatgagtaggataagtgatgtggtgccagtattatacatttattcctatacagttaatacatttatttattttatatattatatataatattatatacagtttatgcattttttcagttattaaaaaaatgctgcctttttttttttttttttttttgagacatagccttgctctgtcacccaggctggaatgtagtggcatgatctcggctcactgcaacctctgtctcctgggttcaagctattctgcctcagcctcctgagtagctgggattacaggcacacaccaccacgcctggctaatttttgtatttttagtagagacggggtttcaccattttagtcaggctggtcttgaactcctgatgtcgtgatccgcccacctcagcttcccaaagtgctgggattacaggcgtgagccactgtgtctggccaaaaaatgcttctttaaagtctgtttaaggcctttgagaaggatatattaataaaaatgaatccaatctggttcccgcgcagaatgctgcagtccatgggtgctatgagtcctgggtgctcatagtcatgttacggaaaataagttgatacacaaataacttcacttcagggaagaaaatactgtgagataagatcaatatctttgtaaatgaaagtaagaaggatgatttccatctggggttctacattagagaaaaacctgtagaatatacaacctcctcctttctttcacacgagttttctttccaaacctatttccccatttcccttttatcagtgctgtgcctccacccagcctgactgtgcgctgctcccatgcgtggctggctctgccctcagtgctttcctcactctctctgggtgggtgtgcctggcctcccacccaccgtgtctaactgctgcctgcccttgaaggcacagttcatatgcagcctctgcggggaaagggttctagatccttctgttgagaagtaatttctttccttggactttttgtttcagtttgattggaatgtttttgtttttggaaaaatgatttgtgctttatctgatacattgtttttacttaatatccaggactaaaatgattttttgattttttttgcataactgctgtgtatttgctttagaaagtgtacaataggccaaattcccccaatgtaaaaacacaccaaactttacaagactgataattttttatgctgagtttacgcgaagtgggattggattttatacagtccctgctgtccatgacttgaaaaagatcatgtgggccgggcgcggtggctcatgcctgtaatccctgcactttgggaggctgaggtgggcagatcacttgaggtcaggaattcgagaccagcttggacaacatggcgaaaccccatctctactaaaaacataaaaattggccaggtatggtggcacgagcctttgatcccagctacgtgggtggctgaggcaggagaatcgtttgagcccgggaggtggaggttgcagtgagctgagatcacgctactgcactccagcctaggcaacagagcgagactctgtctaaaaaagaaaaaaaaaaaaagatcatgtctttttgttattgcttagatagttcatagaaaaaacaaagctacacataatcctcataaaaatagcaattttcaataattttaatgtgctgagctaacagattttatttccaagctgttttctattctgtattttccctgcaggcttcttttattatgagcattaaaggaccatccatgggagactatgaggattgttaggatgaggcaaagacatcttaacagagtttacaaagagctttgaaacgtgaaactaccttctctggaaaaatgggatgttggcttgaagatatttcttagtattctgtgttttctttctggtttttctatgttgttttaatcatattatcataccttgtcatttcaggtaacatagcataagttatagtaattagtttcaagagaaacatatgttagaatttgtgttttgtgtttggatcctatctgtgtacttgaaagatacacgtatatgtagatggatagtgagttccatcaggatgctcagcgttgaaagcataggagggaactgtgctgagcgtgtgaggtttggcgattgtgctcttttatcttctttctttcttgagtttttagcaagataagacatgtaactactgtaaaatgagaggtaatttttaaaatagccactgggttaaccaaaaaccttttaaatagctgtggcatccagtgtgggcaagggtcacatagttttgttcctggaagtgtaaattgtttcagacctcccccggcccccagaaatttgctagtatttatcaaaatttaaaacatctatatgttctttaatttaacagttccacccttaagaatctcacttacaaagatatacttgagaaaatgttcatggtaaggtgtttcataatagcaaaatttagaaagtgttcaaaagtaaaatgtggagaatggtggcttccctgcagggtcattggtcctcagttacaaggctgcagtccatgatgtgttatagtttaaagtgtgttgtaagcactttgtaactaatactaaaattctgaagttagcaagtttgccagtgactttgtttaacaatttttttgtttataaaataaagtggattaaaaatgatccatatgatactctactcattcatatttggactttttttttatttgagtaggaaaaaataggagagacttagaccttgcaagcccagggttgtttataactcttattttcactatatgggctataatctgcatagctcatggaaatacattatttttatatatcgcagcttaagaagggttgagaattgttactgtagtgtattttgtgtagacatcattttaatgacataaattttcttattaacattattatattttccattttggacacagacctttgattttagtatcttaaaatttttaatttttgagaatgtaaaatgctaagaaatttaagcacatgaaaacattgaaaattaggatttctttccatctttgaaccttcgaaacaagaccccaatttaagtctttagaggtcaccactgttaccttctggagcatgtgtgtctgtatgtgtgtgtgtgtgtgtgtgtgtgtgtgtgtctgtctgtctgcgtgtgctagaattttgctatcatttgttttgtaagatactcttagttgcttaagtaggacttactttttttatatgaaaagaagtggcatagaacttttcttatataagaaaacagtggtccctaggcttttaaaaataagtatggaatacctacctgcaggtaagttatttaatctttatgacaacttatgatgtattcttatttttattcttggttttatggaagagagaacaatctctgaaagtttaaataaatgccttgtccagtgtcacatagctggtaaatgagagagtatggatccgttgtttagtatatgttccagactgactctcagatgcattggaactgggctgggccgttagtggtatttgtttttgatcgatagctttagctggcatctgttcttgctgttggtggaggcttctctctttctgcttccttcccctcttccccattggtgtatcatcatagagatctaaaaagtagagttgtttcttttgtttttctcatcttgtaacttggatgccagtgaaggcaaatcctcacttggatttgctaacttactaagtaaggtaactgagtgagctttgctcagttaactgagtgccagagctacagcatagagatattgatgcctttaaccactcgttgatattcttaagtggaactaataaagtctccctggatttggaggagaaagttctgtgactcctttttccttttcataataattttataatatttttctagttgtgacttgtacatatgtgatgttcaaaagaattgataagaactaatgaatgcaacttcataaaacccttattatgacagaatatcttttgaaatgtttgagaacgtttcctttcctatatgttggcttaaggtcagcttttagaatatttgaagattttgaatgcgatgtggaatactaaatgctctaaagtgaatgcctgaaaaaggaaaactctccctttacagttagggagtcttttaaggatgtagataggtcagatacttttagggcttgtgggattttggggagtggtttcaataggaaaagtctgggatttgatgaggctgggatttttttccctttgcttgaggttaaaacagattgaagtgttacgttctagttttcctattacgctctctccttactgccctatgtatctattagctcattctggagtcagaatgacagctaaattctttctctgccacttagtagctgtgtgatcttggacaggttgtttaatgtcggcctctgaagattgtgttttattcttactatttgcatgatatgtatttctccatctgtgattttatgttgaaaatactgtgtgtttcttgtagccaggatgtagttgtgtcatgcttttgaaataattctgatggtctctatttttaaattgtagtgtttagactatgaagttttttcttctttagtttgccttagtgtattttcttaaatagcagctttattgagatttaattcatgtgtcatcaggctcaccctttaaaagtatacaattgagtgatttgtagtatagtcacagagttatgtaaccatcactgctatgcaatgtcagtaaaatccattaacatttaataaatgatcaaggtggttggatttatgtctagcattttattatttgttttctctcagtctcccctttttttccttctgttttccttttctgacttggattattttagtaatttttgaaattccattaaaatttatctattggatctatctatttttcagtgttttttctaggattgcaatatccatcctaacatttcatattctagttagagctaatatgataccatttcaagtaaaatgtagaaattttgccatcctccttctcttcccatcactatcctctatgttatagttgtcatatgtatttcatctgcatgtattataaattctatgtgaaaatgttataattttgttataaacatgttgaggtgagttaggacatttctttaaattgatctgtcaaatttaaaatatagagacaaatctctagattaaatattttatttgagaatcacagaattggaatttgagacatacacatggggtcttcagtatgtccaaggaacaaagagaaggttgaaggttttattagatagaaaaaaaatgttactgattattttgaaagaaagttcattggtacttgaaaagctttgggagctggcaggctcggataggagagtggcagtggtagtttaaaaactagtcttagagtgatagcaggttgtttcagcagttactaggtaaagctggtcttagggttacagcaggctgtttcagcaactgggcctctggatagttcagttcttggagcctgtgctatgtgccctgagtgcttttttcccctgactccttgactcttatgtagttgggtatacaagaatgacccaattcatgtaatcaactttcacagatccaaatatcattcagttgaaattaagactcattttattttggtccatttaaaaaatgttgtcttttaaaattacatatgtatttttattgtggtaaagcagacataacataaaatttaccctttcaccaattttaagagtgtggctcagtggctttaattttattcacaatgttttgcaatcatcagctccagaactttataatcaccccaaactgaaactgtacatattaaacactaattccccatttcccacctactcctagcccctggtaaccttccttttactttctgtctctgtgagtttacctattctaggtacctcacataagtggaatcatataagatttgttcttttatgtctggcttatttcactcagcataatattttcaaggttcatccaagttccttcctctttaagactgaataatagtctactctgtggatataccatattttgtttcttcatcacctgttgatggacatttgggctgtttgtaccttttggctgttgtgaataatgctgctatgaacactggtgtataagtatctgtttgggtccctgcttttgcttctttttagtatatagctaggagaggaattgctgggtcctatggtaattctatgtttaactttttgaggttctgccctactgttttccatagtggctgtaccatttctcattcccattgttttattgtttttaataaccaccaaatcatgcctttccttaatgcaagctctgggtaattagttgactcattggatatttgtaatgtccgctttacataagtttaagaggtttaatttgacagtatcttcctaaccaatatgtttatgcttgttagtctagtgttactgccagagacctattgcacagacttgtgggagtattaatattttttcccctcacattttctttaatgaaaaatttaagaaatacagaaaagtttgaagaattgtactactacaaatgccagtagattctataattaacattttcttatttgtttttaacatatttattcatttgtgttttcctctactcatctatcaatctcattttcattttgcacgtcaacttaagttgtagataatagtacaattcactctcctgtacacttcagcatgcagtttttaaagcagagttcaggccaggtgtggtatcttacacctataatcccatcactttgggaggccgagataggaggatcacttgaggccagaagtttgagggtgtagcgagctatgaatccagcctgggtgacagagcaagaccctgtctcaaaaaaataaataagtaaataagtacaataaaaaaataaaccagagttcattattcatttacagcttttccaagaaagccttattgaaatataattgctattcaataaagtgcacatatataagaaattaattgtacacttatatgtgtacacttatgaaatcataatcacaatcagaataaagaatgtatccttcaactccaaagacttcctggtgctccttcgctggctctttcggccacttcctagccttcctcttcccctttaggcaactactgatctgttttcttatcatagattattttgcatttactagaattttatataggtggaataacacaagttatgctgttttttggatttttttttcacccagcaaaattattttgaaattgatgcatgtaattgtgtcagtacttcattccctgttttgttttgttttgttttggagacagagtttcccctcttttgcccaggctagagtgcagtggcacaacttccgcctcctgggctcaagtaattcttgtgcctcagcttcccaagtagctgggattacaggtgtgcaccaccatgcccagctaatttttgtatttttagtagagacgggattttgtcatgttggccaggctggtttcgaactcctggcctcaagtgagctgcctgcctcagcctcccaaagtgctgggattacaggtgtgagccaccgtgcctagcctgcattcctttttattgctgcattcatttctttttattccattgtatgggtttaccaccatatttttagtagccattcatctgttggtggacatgtgagttgtttccagcttttaactacaactagaggtgctatgaacaagtagttatgtgggcatatgctttcatttttttttggtaaatgcctaggagtggaatggctagatcatttgtatgttttatcttcttagaatctgcaaactcgttggtacaattttacatttccgccaacaatgtatgagtgtactagttgctccacattcttaccaccctttaaatttaactgttatactatgtagtgatgtcttattgtggttttgatttgcatttgtctgatgattaataatgttgagctcatttgctttatatctttgtcgatgtgtttgtgaagtcttttgtccatttttaaattgagttgcttgtcttatttagacatattagggttctttattctaggaaaaatcttttgtctggtacatgtcattgcaaatattttctcccatgatgtggttctgttttcatttactcagcagtatcttttgaagagcaacagcttttagtcttgttgaagtccaggttattaatttttttttcttttatagtttgaaccttttgagtcttaaaaatatgggccaggtgcagtggctcacacctgtaattctagcactttgggagactgaggtaggtggatctcttgagtccaagagttccagactagcctgggcaacatggtgaaaccccatctctacaaaaagtaacaaaaattagatgggcttggtggcatgcagctgtagtcctagctgcttgggaggctgaggtgggaggatcacttgagccttggagtttgaggctgcagtgagctgtggagtgttactgcagtccagcctgggtgacaaaagaagaatgtgtctcaaaataatgaattatttaaaaaaatagatatatgtaatttcttgccaaactcaaggtcactgagactttcttgttttttgttttgtatttttaatgttttatagttttagatctctgatcaattttgagttaatttttatatgtggtgtgaagtagggtctaaattaatcttttttgcatgtggctattcagtttgctatacaatctcttgaagaggttatcccttcctctttgaattgccttggcacccttgcagaaaaagtaatgggacatacatgtgcgatctcggctctctgcaagctctgcctcccgggttcatgccattctcctgcctcagcctcctgagtagctgggattataggcgcccaccaccacaactggctagataatgaactcttaaaaatactttgtccacaccccctttcatttactcccatgtattactaatcctgctgaggccgtcttggtgtgacctccttcctcaccactgaccccctcttttctctctcagaacttccttactttaacaatccagttgaacacatatgccaccttattcagcagttgaatctcaacctgagagattctagtgttcattcttcagttccacacataaccatcgtgagtaagagaggctcattcccatagaaggatgaggtttaagattgctccagtcattaacagtatacaagatgtcagatagcgttttactgggtctaagataaattaggctgtaaccaagaatatttatatatcaaaccagcctctccacacatcccaattataaattctggacaaaatagaaaaagctacataatacctatgggtaccagagagcagccacaattagacagaaataggaaggcgactacccttggaaggaggaaatggcatgggggcagtttccttttttggccttttttgaacagttcctggaatgaattctggagtgttccatgtatgcatgggtcagattccaagcactccagctgaggctaaaagaaccaaagagaattattagctgttacttatgctagtattgggggaaaatattcaagttctacctaggtgactcttgaaccccttttgaaatgtgacaacgtagcagatgctgttgatgctgctgtccaccctttctgcccggttgttagcgtcaccttaggtgaccatcccttccctgtgagtctcagtggtaaattctgactagtgaaatcctgaccaggattcattctcttccttaccaatgaccagtttatgggaggctcatggtccagtttgattcctggcaagtgaggggacctttcaagaaaaggtttcttttcattgtgtgaaataagcctttttaaaattattttaagccattgtaaactgagggtttttattgttgttgggatttttgttttgttattttaattttggccaaaactaccgggttgaaagaccagtgttttacagactgacattctattgaatcttaaaatagaatatagcttctgattcttgtgttaagctttctgaagtaatttagaaacaaaaccctctatggattacatggcaaaaaaggcatgtttcaaccataaagtaaattgttttaaaaatttcccttaatttggccaggcgcagtggctcacgcttgtaatcccagcactttcggaggccgaggtgggcggatcacctgaggtcagcagtttgagaccaacctggccaacatggtgaaaccccgtctctactaataatacaaaaattagccaggttggtggcgggtgcctgtaatcccagctactcaggaagctgaggtaggagaatcgctggaacccaggaggcagaggttgcagtgagctgagatcgtgccactacactccagcctgggcgacagagcgagactgtctcaaaaaaaaaaaaaaaaatcccttgatttatgtaaggattagtcacttttgtatgcaagtagaaggctgaactcatgctttttattttttattttattattattttttgagacggagtcttgctctgttgcccaggctagggtgcagtggcacgatcttggctcactgcaatctccgtctcccaggttcaagtgattctcctgcctcaggctcctgagtagctggaactacaggtgagcgccaccatgcctggctaatttctgtattttttttttttttttgagatggagtttcgctcttgttgcccagctggagtgcaatggtgcgatctcagttcgctacagactccgcctcccaggttcaagcaattctcctgcctcagcctcctgagtagctgggattacagatgcctaccaccttgcctggctaatttttgtatttttagtagagacggagtttcaccttgttgaccaggctggtctcaaactgctgacctcaggtgatcctcccacctcagcctccggaagtgctgggattataggcatgagccaccacacccagcctgaactcatgctttttgattcttctgtatcactcaggctttctggaggtgcttattaactctttgctagattagataagttgctgaattcaaatttagaattctggaaataaatgtagaagggatgctttgagaagcatccttgtgctttcattgtgttatgctattttaaacttacggtaacttcgtgatgtcttaaaatttattttcattgatttatttgtatgtgactcctaagcttagaattcagttggaaagatttttgtttttgttctagtgaaggaagtacattgctcgaggatttttttgggttaactgaagtaatgctagttatctctgttacatgtagttaatgattcttgttgcccccagatttgttctaaacttaaacttttaaatgcatgctttctaaaacaggcaaagaagcagaaataatgaaatgatcactggggctttgtttctgtactggtccttatttaaggatattacaatgttcctaagttaccattttgactcataatatgtgatatgctaatgttccaagcacagagtattcttttctgtatgtttccacttcccaacctacctatggtgtagcgcctgtctgtaccactacgtgtgtgcatgtgtacatgttcctagctttttattcagtcctttatgtgctagttgattgttgagtgcagataaaaataatgtgttgtatttcttaaccacaatatttgatttataaggaaatattttgataacagcatttatagtaatatatgctcttactgattagaatgccacaattgatagaaaatatattggatgtaaattagttacatatttacataatctatacacaagtaacagcatattttgtcagcatagcgtacagtagccataaaataagagtgggtgatacaatagagcattggttcccagtatgttctgtggtacctggggactcttgagaccctttcagacactctgaagtaaacaattttccataatagtttttcctgctctcattctctgaggattgtgcagtagagttttccatgtaacagtagagttatatgatatatgttatcacagcagattgaatgcaggaaccagatttgagaatccagctgtcttaagccacatgttaaagagatttgtgaaaatgtaaaacatttctactctaatgaatttgtcataaaaatgttacttctaattgttaacattaaatgggctattcttttgaaatacatttttaaaaatttcttaattttaacatggtaaatattgatatatacaacatgtataagccaaagctccttgagattgtcaatatttaaaactgtaaagcccagaaaatttgataggcactgtcctgaaaggtgactgggtagcctcttgagatagggtgatgacagtcttctctgagagtgtggcctttaagctgagattctagacagaatgagcatgcctcctctgactactatgccccactccacttccacattcttttttagccttagtataattacttccatgtcaagtcaaggacttttactcattcatttctgaattcctgttgcttaccactttacttactagtcattaataattctttacggccagacgcagtggcctacgcctgtaatcctagcagttcgggaggctgaagccagaggatcacttgagtccaggagttcaagaccagcctgggcacataggaaaaccccatctctacaaataatttaaaaattagctgggtgtggctgggcgcggtggctcacgcctgtaatctcagcactttgggaagccaaggtggacagatcacgaggtcaggagatggagaccatcctggctaacacggtgaaaccctgtctctactacaagtacaaaaaattagccgggcgtggtggcaggcacctgtagtcccagctactcgggaggctgaggcaggagaatggcgtgaacacaggaggcagagcttgcagtgagcggagttctcgccactgcattccagcttgggtgacagagtgagactctgtctcaaaaaaaaaaaaaaaaaatattagctgggtgtgttggcatgcgcctctggtcccagctgcttgggaagctgaggtgggaggattgcttgagcccaggagatggaggctgcagtgagctgagattgcaccactacactccagcctgggtgacagagcaaaaccctgtctcaaaaaaaaaaaaaaaatttacctttcagtggaattatttatatacatttctacacatgagacaaacttttgaaggaagtttaatgtctttggtattcacatcaaactaatttgacatatatttttatttagttttttttaaaaacaaatattttttaggatctgttatttcctattaaattccttttacatgaaagatcataaattgatttttaaaaatgacttttaatgttaatagggctttgtcttttagacatatttgttaatgataaatttgtttctgtaatttttatgctttgtagctttaatttgggcccatacgtaaagactatgtagttttattatcattcctgccgtcatcatccttgatcataccatttaaaagcaatagaagttttaaatggagtagtagagaaagacaatcaggaattaatgagtttagataaaataagagtacaagcaaacaaagttgattgtggccatgttatgaatgcgtgagatttcaacttttaacaaattaataactttttttgaacacttagtgtgtgccaggcactattcccacccctctgcatgtactaactcatttgctcttcctagcagccctatagacaggtactattatttctgcttttcaggcgaagaagcagaagttgctcaggatcacacagctgttagtgccagggcaaggatttgaaccccgtcattaccatgctcataactaccggactatgctacctctgaagaagagattatacagcttgttgtggcacaacacaaaaccttaaaatgttttcagctcttttttttttacccatccttattttttccccatatgactattatttattcagccttttggtatctagcttgcagaatatttcagggtcccaaagggactatataaagagctgtctgtaaaagttctgctttcctcccaaaagctagcagtgggaaaaacaggcaggagagataaggtgcaaagcacagggaggaagaaagagaatagtggaagcagcagtggtgatctgtagtggtgtctacagtgtgctggttctggttgagttggtacgggcagccatgtcagcaaccaagtcttcacttgttggaggactcgctttttacatgctctggctgggatggttttagttactaggatgtaggggacaggaataacggcatttggtagagattcaaaacagcaaccagggatgacgagctgcagacattgatcgatatcaagtaaataataagagatagaagataaaacagctctcaggtgccagaaagcaacttggtaatggagaaatacatatcctagagaaaggtagacaagtgtatttatcctctcaggaaattacctggataagtgtacatttctgcaaagcaaaatagagtcaagctcctgaactcctgctgcataggctggtaggtgttaatgggtgtctgaatggagaaggatgaggacttcaggtttctagtaaacttaaatgtgatatggtttggctgtgtccccacccaaatctcatcttgaattgtagctcctctaatccccacgtgttgtgggaggaacctggtggaaggtaattgaatcatggggggcaggtttctcctgtgttgttcttgtgatagtgaatcagtttcatgaaatctgatggttttataaatggcagttcccctgcacaagctctcttgcctgctgccatgtaagacatgcctttactccgccttcacttgccaccatgattgtggggcctccccagccatgtggagctgtaagtcaattaaacctttttctttataaattacccagttgtgggtatttcttcatagcagtatgaaaatggactaatacataatgattcccttgtttggaggattgtcagatactatatgaaaagcggtttcacatgtgcttaaaaaaacctgtatatgtgccttatggtgtcattatttctaatttatagatgtagaaataataatatttagagaaataaaatgctttttctaatcacatgccagtaggagatcagcaagctgggactagaactcaggttattttgattgaaattcttttttacgaagccctgagggttctaaaaagctcgagtttcactgtgaaccattgtatggaaaacttaaatgtagccagaaaccacatagagaaaataaccaggttttaaatgttttatagtataatatttgttgtggtactcttttatgggctttaagaatctagtatgctggagggctggggtggctcacgcctgtaatcccagcactttggggaggccaaatcaggcagatcacttgaggtcaggagttcaagatcagcctggccaacatggcgaaaccccgtccctactaaaaacacaaaaattagccaggcatggtggcgcatgcctgtagtcttagctactcaggaggctgaggcaggagaattgcttggacctggaaggtggaggttgcagtgagccaagattgcaccattgcactccagcctgggcaacaaagcaagaccccatctcaaaaaaaaaaaaaagaaaaaaaaagaaagagaatttagcatgcatttaggtaaccacagagataaaatcatattcaaatgtgcttgtattatgagtattactcttctttatgagtattctttggaaaaactattgtcacacaataacatattaattatatctttattcatttaccatatttgaaattctcattaaagttttaaaatgtattttaattataaaaataatttacttaaaaagttaataaatactagatgtctgttcacacttcatttttccactgtaagttgcagattagattatgatgaacagactataatcttctaatattctgtgccctagtaaatgagtccttgcttatgtaagtcagatattttgttattttgatatctaagtaattggttattatgatttatttttttcttgacaagcttctgagctttgttcagtcttgtcaagtccctggtgagttttagatctctgagtctagagtttgttgatcgaattaatgaataaaccaatagattagtacattgttgatttttttttcccccaaaccttagatcctatttgctctcttaggaaactgtttgaaagtattgcaacttttagagaagttttgcaaatcttagccacatgtctactaatgttttgcacactatttttagttgatgaaatgtaagcaatttatatttgtcttaactttccatctataaggtagtgagagtggtgacaggctgctctgttttgcagctagcatctttaattgatgttgaattgtggctttccgtgcacacagggttaagtgaaaaggttgcagtcatctagtgagcattttcctttaatgtgctcattagtggtggcaagtccaggtttcagcacatgtcagtaatttacatttcattgtggagaggctgcccttgttcaagagttgtttctaagcctgatgaatatatattgggaataaacagagtagaagaattgaaagccaaataccctgccaggcctttcagttggttctgaagcttccagtggatctctgattagcaatgcataaagcaggatgaaaatgcaaagatgaggcctacaaaagttgtcgcaggtagcttctccccttaaatcctctttttgtgactgcttttccatttcatcttctccaaattcttttttcatggcagacttcgttaaagtgaaaatactctgtgttagacgtaagatgtgaatactacaggatctacctggttcctgtaccccttctaactatgaagccaagtctgatcgttatgcaatgagttttcagaagcaaagggcttgataggcctcggttcttagggatcagatgattgtgattggaatctttgtgatgattccttctgggactcattttttccatctttgcctgattggtaggtaccagcttgttctggcttttgaaagcttgcatagatcagtaaagaataactgtggaggctgtggtcagtgttgttggggatagagacaggactctgaaattgtggtgtttgggaaaatccagaaattttctttttgtagaaaaacttcatatattaaaatgaagcatttttggaacttgggatttgattacaagttacttcatgcatagatggtgtagctttagaaaactcaggcctagctgtttttagaagaaaatgttataattctttatacattttaagtttaattatttacatgtgtataaaaatttgggtttattgcaagaaggtacgttttgatattgctgtttctgtgtgtttgtatgatacatctacccatgtatctgtctacttatttatctttgtggtgctagtcaaaacttgcagcttaagagaatttgttcagaattggtggttagaatcaaaagtgagtgaatttatgacttacattattgaaaaacattgacaaatgtcaggactcaagtccgatttttattattttactgtaaatccagttagatgtgatttagcacttggatcatttaaatataaaggcatgttagtcacagtttaagtctttatattagtttttttaattaggtagagttttaacagaggagcaacatggaaaatgtttatgtgtatgaggataaaaatgcaagtcttgagaatattagtttagtaatgttctgattagtgtttgtagcctttgtaaaaaatgtaaatttaccttctagatgactacttgaaactgttgtttttggatgcttgccagataaaagccctgtgggattaagttctggtaaatcgcttgcaaatttgtgagggatatcagtgactttgagtgtttaactgtccaagctgtcatctacatgcgtcctatcactgcattgggtgaaaaaattaagtttctcagccagttagaattaaaggtgacatctgcttttaattggtgttttattttcttccaagtcagtaaaaattcagtaagacatgaattatcaaattttgcaatgctaagcaacttgtcaagtgacagtaagcactaccttgagcagttgtacagatgggaagtgttaaaatgttgattaatcttccagagttctgattatgagaagactaaagcttatatcatcattgccagctttctagtgtcagagtagtatttatttgttaattttgtagacctttttcaattactgacaaattgtgtcttgcataatgaaaattttactagttttaataagacttggtctattagactaagggtcatagatggcaatgtagaattcatgtttctgttgtctattatttagtaaacatattagattctttttagtaaaaaactgaaaaaaatctaaacgtgagctttaagttttattctgttatacacattcatcctgtgttgagaagggagtatctgtttgaatcttggcaaaggaagtcttgcctgggccccctgttgaaaaagaaaatggattatttctgtttttaccatttataaaacattttaagatgtaaaacataaggacgaaaaaaatcatcaccttcaagtagtccatgtaaaaataactcaagtcttcaaacattctcagaactaaaaaagaccaaagaaaatattcccatcatactgattatgtttcaattttctagttactaaaaattagaacatggcactaagtagactatataaagtatgtctttaaaaattcaactgtgaaggagatcttttttttttgataatcattaatatgaaagtgaagtttctcttttccctgttataacagttctatgtagtagtagaggtagaattctgaattgaaggtggttaggacttatagcaacatttctgggatgagtttttcagtattcccagacttcaatttaattcagggtttcttttttgctctccacttatgaatatgtgataaatattttatgtagtcgtgtacttttgctatagaaaatcagtggattatttaatttgattcaggaaatctaccctgtatggttatttcgatgttgggtagattttatttcaacttaaaacgtagaaaagatgcttaggcaaatgatctaatagttttagatacatttggtaacttgtatcttaaaccccagggccaagtttagcagtcttacacatgtttagaaaatagttgaaaaatagaaaatttaggtctttttaggtaaactatacaaaacacttttatagtcattttgatgcctgataacttcagggttcattgcccctgtacatttttcaaattatttgcttctcaatccataaggctttaatttaccccctactgacaaatcccaaatgggtttttaagaattttgagagtggtctgctgtagttgtgcttcagcactggcttcaattgctgacacagaatctcttaagatgcaccaaatttagaaggataggaggttcaggcagcatttcctctggcaaatactaagattttatttgcggagggtggggacggagatacagaattactgttttctgtaatatttttctttctttgatcctgttttaatgcctgtttattaaaaaaaaataatttagacacaagatttagccacatttttttaattaattaaaatgtgtgggccgggcgcggtggctcatgcctgtaatcccagcactttgggaggctgaggcgggcggatcacaaggtcaggagatcgagaccatcttggctaacactgtgaaaccccatctctactaaaaatacaaaatattagctgggcgtggtggcaggcgcctgtaatcccagctactcgggaggctgaggcaggagaatggcatgaacccgggaggtggagcttgcagtgagccgagatcgtgccactgcactccagcctgggtgacagagcgagactccttctcaaaaaaaaaaaaaaaatatatatatatatatatttgtgcttgtttggatgggcttttttaatcttgaattttatagaataataaagttaagtatttgtaccttgacataccctaacacaattaagtattgcttccataaataattttgatcttataataaacataccttacatactgacgaataatattaacacaaatgtatactcccttagaggtgctcaaaatgactttcatgccacccttcatgcctgctgggttttaaggcataagagaaacagatgatttctgcattttactggaaaaaaaagactaaaatgtacagctagtattgaattggggtaataatctgccacttttttgcccttcaatgctgtcgtgatcttttagggaagtgaggtcatggtagacccgcttgttaatcatttctgcgttttcagctcagtttggtcatgaatacttgacttgctacctatagtcttgcttctgtttgcctctttgcatgcagctccttaaattgtttaaattaccatgctttctttatcatgtgatcctgtcatctattgacaattgattggatcaaggattagtgcctgacccaaggcagacatctacagaagggtcatcctcttcccacaatggtttattttcctgtctgtgtgtgtgtgtgtttgtgtgtgtgtgtacgtgtgtgtgtggtggtcatgaatggtggtggtgccaagaaggttgtgacatttgactaataactgatgatgagagaagcagccagcacttggagatctagagtaagagctctccaggcagagggaatagcaggtttaaatgttctgaggctggaatgagatttgagacatagaatatagagattggatatagagaaaggaactggtgtggcaggagaatcatgaatgagaaaacacgtggtacaagatgaggttgaaagggtaggtggctcagggcagatcagttagggtcattctaagaagctgggatttaggtctgagtgcattggggagctgctggaggagttttaagcatgtggtgcacttctgtatcacttctgacctaatgtgatgcacttctgtatcactgtaacaacagtgcatatcagactgaagaactatgtgattaagaacactttgctacataggagcagaaaaatttaaagaagaaacagtgccctagaagaagttaaattctcttgggcatccacctgtagacgtcctcactccttaatttgtcctgctgttcttagcatcatagctctctgtgaaaacaaagctatcttctaatttatactttgcaaatcatttgcttttccgtaaaccccattcttgcctattggggttaatctaataccaagatccaagattcctcttcccacaatggtttattttcctcaggctggattattcagtattgaaaaacagccccataagacaacccatgggaaccattgaccattcaggtcctaagaacagttagagttagggggtaggtgtggatacagaggttgtatgtatgtggtattccagtttaaggtggccactctcttctgatttctttctcctctgattttgtctcctccgatttctttcccctggtattaattactaatacgcttctttgactttctgtctggctagtaggtgaggttacgttgcacaaatgcttaaatgaatgcatgtatattggcatccttgtatatgggcttatgtttgcacacaaatactcaaattccagtgaagtttgctttgccaacatcctttccaccacaggtgatttgtggaagccagtcaggatcattttatcttccctgacaattattgattcagggattaatcaaggcttaagccattgtgggccactgaaacatgatgaaaggctttcctgggattcctggaaaaggaacctccttattcttaagagaaagacattggaagccaggttctcttgcattctcccccacccaccaccttgtgaatgagagagcttagttgctgctggcagccatattgtgaccatgagggtagctagcctgagggtaaagctgacttacagaataaggcagatctgagagaatggcagagaaatccagaattgggagatatatttttggaagaatttctgtctaaaagtgttggtggggtatgtgttatggcaagaagagagctgggatgtttaatgggttaacagcattttgttctttatcatatatttattgaaaaattttcctatcccattgtgctaggcactgaggaaattatttaaaaaataaagtagggcacagaacttgcctttccaggaaactcatttacaggtattgggttttgattctttctttctttcttctttggaaacagggtgttgctctgccgcctagccggccaggctagagtgtggtagggtgctcatggctcactgcaccttctgcctcctgggctcaagcaatcctcccaccgtagcctcctgagtaactgggactacaggcgtgcaccaccatgcctggctaatttttgtattttttgtagagatgtggtctcgccatgttactcaggctggtctcgaactcctgggctcaagtgatccgcttgtcttgattccttgtataactgccccttgtattggatttggggactgaaagaacacttagttactaatattcttttttttgtttttctttttctttttttctttttttttttttgagatggaatctcgctctgtcgcccaggctggagtgcagtggcgtgatcttggcttactgcaacctctgcctctgtgttcaagcgattctcctgcctcagcctcctgagtagctgggattacaggcacgcgccaccacacctggctaatttttgtatttttttgtagagatggggtctcgccatgtttctcaggctggtcttgaactccagggctcaagtgatctgcttgtcttgattccttctataactgccccttgtattagatttggggactgaaagaacacttagttactaatattgtttttttctttttctttttttttttttttttgagatggagtcttgctctgttgcccaggctggagtgcagtggcttgatcttggcttactgcaacctccacctccccgttcaagcgattctcctgcctcagcctcctgagtagctggaattacaggtgtgcgccaccacacctggctcatttttgtatttttagtagagacggggtttcaccatgttggccaggctgatctcaaactcctgacctcaggtgatcctcctgcctcggcctcccaaagtgctaggattacagcactgtgcctggccagttactaatattcagttttaaattttagaaacctagtacttaaagcacattaaactttgcttactgtggaaccagtgtcagggctgtgagttgccttcagtgatgttgctgggtagccaggcttatctgtgcgttatacgtgggtgctttgaggaatccaacaatgagaagatagctagccttgaagacagcactggaagcagagagtagccagcagtcagtcagtcttctctctgagtttatgctccattctttgaggtgtttctgcaagcctctctgctttccacctctgcttgtctggcttgcggccctgttggaacatgctgacttcattgctcctaagcctacatgatatagaccagggatcctgaaaagaggaaagcctctttttctctctgtccccatgccccattcctaggaaagggaccctgataggtctagtttgggccagctgccttttgccactcccgtctgttcagagagcaagattatgccattcacaaggtctacaactgaagaggtcttttgctgagtttgggaaaagggcagttcaggaaaatcagactaactctgccaccaaatgtctcttaaaccacataattatgggacagtatgataattgcagcaatcaaaggctgttgagtgttgtgtacaggaaggtagtggttaactctggtaggttgggggttgggtacagctgaagagaagattgtcaaacttcacataaagggtctgtgtgtgtgcgtgtgggtgcatgcatgcgtgtgtacgaaggattcatgagggggagtattttatattggtgtaggtgttggtttcctccccaagaatttattcctatcataaatactctctgtgcccctgtgacagtttcataactgtggtatcattagcgttacaaagtacagaagacagaataaaatcatggactttttgagctggaaagaccttgaaacttatctaatttgtttgacatacatcttttgatgtggcagattctggtaaatataaagacaaagcaggttccctaccctgaagaagtttatagggggactacagcagggaagaaatactgggaggagtttctctgattcccaggagaggatagctggccatcgggggaagtcagatgacgaagtcatccattttgatggaggagatgtgcccagaaaggcttcatgacgaaggtggcatttgaagtaggtcttgaagataggtagtgtttaggcaggggagatgatagaggagaagaatgggacacacaggtggaggggacattccaggaaggggctgtagtgtcgggatggcagaaaaaggggtgctgcattgagccatgagctgtgacagacctttgagtgtaagagtgtaagagtaagcccggaaggcgaggggccctgggtactgggcttgaatttgtttataccattcaagctttccagaaaacccctgtgagctttgaaatgcttcaggggagcattctgtgtgaggctggctttttctgcccttttcctcaattcagcaaatggcaagaaacttggtatcatctttgcccacctttgctgttaggccgtgtgctagtctgttcttgcattgctataaagaaatgcctgagactgggtaatttataagaaaagaggtttaattggctcacgattctacaggctgtacaagaagcgtggtgtcatctgcttctgaggaggcctcaggaaacttacagtcatggtggagggcaaagaggaagcaggcacgtcttacatgaacagagcaggactaagagagagagggggaaggttataactatagtagttattgcttcctgatagataatttgtttgtttctctttctcctctgctgaaatacagcctacacaaccataggagttcctgtctcttgattgttgctgtttcctcagtacctaggacagtgtctggctcatatatatttgtttaatgaacaaatgaataagagatgggttatttagctttaggccattcatggaaagtttaataccataaattctctgttaagtaggcagatatttataaatacagaaatggcttctaaggtgtctccgtaagatagctattcaactgttgcacgagcttatgatgactggaatcgtacgccctttcatcatatagaccagcatttggcaggctttttttctgtaaagggccagataataagtgttttaggctttgtgggccatactgtcacaaccattcaactccattctaaatactcagctcttctgttgtagtgtgaaagcagccctagactataggtaaatgaatgggtatggctgtgtttcaatacaactttcattatgaatacttaaatgggaatttcatgtaattttaacatgtcacgaagtattactctgcttttgatttttttcaactatttaaaaacataaaaaacctttcttagctcatagactacaaacgtggtgggctggatttggcctgtaggctgtaattggccagtacttgttatagagctttctgtcttcctcatctttaatggttagaaaattcttcattgtattaactgaaatctatctgtttagaatatttacctattttttcagtagtgaaataggacatatataccgaaaaatgcacataatgtaaatgtacagctttacaaattattgtgggcacccacataatattacctaggtcaaaaagtaagacaaatgtctgcaccctagaagccctttgcatgttcccttcaaatgatgctccttcctcccatcccaggaacactgtcctaactattatgggaatcattttcttgcttctctttatactttcacctccttaatatgcatcctatgaccctggagtttagttttgcctatttttttgaactttctatagatagaatcatatagttaaaaaaatttgctttctgtctttgtttctttctctctttttatcttttctttctttctaatattttctttttttctttcttttgacagttttgctctgtctcccaggctggagtgcagtggtatgatcatggctcactgcagcctcaccctcttgggctcaggtgattctcccacctcagcctcccgggtagctgggaccacaggcacaagccaccgtgcctggctaattttatgttttgcagagacaaggtctcaccatgttgcccaggctggtcttgaactcctgggctcaagtaatatgcctgccttggcgcctcccaaagtgttgggattacaagttttcttaaatttctttttctttttttttttttttgtgagacggagttttgctcttgttgcccacgctggagtgcaatggtgcgatctcggctcaccgcagcctccacctccgaggttcaagtggttctcctgcctcagccgctcaagtagctgggattacaggcatgtgccaccccgcctgactaattttgtatttttagtagagatggggtttctccatgttggtgaggctcgtctcgaactcccgacctcaggcgatccacccgccttggcctcccaaagtgctgggattacaggcgtaagccactgtgcccggctaaatttctttcagtaacatttattagtttcctgcttagaagtattgtgcattttcactgtatttattattagaagtttgagtcttaaaaattattcagttttctctttgatttcagtcttaccattccatctagttaaaatagctttgaatcaatattttatcattctttttcagcattggttcatcattgaattaggcaatcagtgtctttgtgtggcgttatacaagtatttagtaaaaatatccattagggaagggccaaaagtagagtagggctttttagttagacaaaaatggactattcaatgatctggatatggcgtttgaaacaattgtgtatctgtacaaatatatttagtttaatacacacttgtctgtgttgtccataagcacacatttgaatatggccacgagaaagattttgggtgaccatgtggataaaaaaattatttggtacagttatttctgctaatggatggggaatgtatagtaatatggaaagtacaaaataggggccgggcgtggtggctcatgcctgtaatccagcactctgggaggttgaggtgggtggatcacttgaggccaggagtttgagacctccctgggcaaaatgacgaaaccctgtctctactaaaaatacaaaaatggttcaggtgtggtggcacgtgcctgtagtcccagctactcaggaggctgaggcaggagaatcacttgaacagggaggtggaggttgcagtgagccaagatcgcatcactgcactccagcctgggtgagagtgagattccatctcaaaaaaaaaacaaaaaaaaaaagaaaatacaaaatagggatagtgtagaagaaatctgagaatgttttctacaatttaatgtgtatcacctagtaactatatttaataatactagatttatattctcttaagtatatgccaattgagaattgtgcagtgagttcagggatgctgtgaaggaattattttcagaattcaaaattttcaatggataattgagaattaattgcaatgatgaaacatatgtaacatgtagtagcttatgtaaacattagtgttagattagatttgtaaaattcctagttttcccaaaatatttgaattatgctgtagaaaagtccagggactcactcctgcaaccctaaatgtagctatactgatacaggatttggcagcctaatagatgtagggttggagcacaaagaagtttaaaaatactccattccatggatgtttaatagatttatacctgttgattattaatttttgagtttgtggattaggtattatcctccatgattaaaaaaattggagaaagaggataatcactgtaagaacgaatcaagattatgactttgtatgttcagaccaacatgggaagaagaaattcttggtaatacgtcaattgggatctgcgataggctggagaggtttttgggcagatatgggaaataatgctatttttagtctgttcactttcatcaagctgaccacaaggtggggaataatacattatatgaggtctggatgacctgcgatatcatccagagttataatagagaattatattactttaaagaatgtattttttaaatttggatatttacacatgagttagagtcaaacagtgtttttatagctatatcttgactagttatgccaacaataattattttttaaaattgtttctcagtactgtaaggttcttattttattgttgaaaaaaacttattttaagttcaggggtacatgtgcaagttcgttacataggtaaatgtgtgtcatgggggtggcactctttttatttcagtaaatttttgggaaacaggtggtatttgattacatgaataagttctttagtggcgatttctgagattttggtgcaccagccacccaagcagtgtacactgtacccaaggtgtagtcttttatcccccgcccccttcccaccctttcccccaagtccccaaagtccattgtatcattcctatacctttgcctcctcgtagcttagctcctacttatgggtgagaacatacgatgtttggttttccattcctgagttacttcacttagaataatggtctccactttgggaggccgaggtgggcggatcacgaggtcaagagatcgagaccaccctggccaacatggtgaaaccccgtctctactaaaaatacaaaaaatagctggatgtggtggcacatgcctgtaatcccagctacttgggaggctgaggcaggagaatcgcttgaagccgggaggtggaggttgcagtgagccgagatcgtgccactgcactccagcctggcgacagagcaagactctgtctcaaaaaaacaaaacaaaacaaaacaaaacaaaacaaaaacacaaagaaagaaagaaagaataatgaattccatctggattgctgcaaatgccattttttcattcctttttatggctgagtggtcgtattccatggtgtagatataccagtatttatctactcgtcaattgatgggtatttgggctggctccatatttttgcaattgcaaattgtgctgctataaacatgcatatgcaagtatcttttttgtataatgatttattttcctctgggtagacacccaataatgggattgctggatcacatggtagttctacttttagttctttaaggaatctccacactgttttccatagtggttgtactagcttacattcccaatagcagtgtaaaagtgttcccttttcaccacatccacgccaacatctaatattttttgattttttgattatggccattcttgcaggagtaaggtggtatctattgtattgtggttttgaattgcatttccctgatctttagtgagcatatattgaagtttgttggccatctgtatatcttcttttgagaattgtctgtacatgtccttagcccactttttttttttaaattatactttaagttctggggtacatgtgcagaatgtgcagttttgttatataggtatacatgtgccatggtggtttgctgcacccatcaacccgtcagctacattaggtatttctcgtaatcctatccatctcctagccccccaccccctgacaggccccggtgtgtgatgttcccctccctgtgtccatgtcttctcattgttcaactcccacttatgagtgaaaacatgcggtgtttggttttctgatcttgtgatagtttgctgagaatgatggtttccagcttcatccatgtccctgcaaaggacatgaactcgtctttcttatggttgcatagtattccatggtatatgtatgtgccacattttcttaatccattctatcattgatggacatttcggttggttccatgtctttgctactgtgaatagtgccgtagtaaacatacgtgtgcatgtgtgtttatcgtagaacgatttataatcctttgagtatatgcccagtaatggaattgctgcttagcctactttttgatgggattgttcatttttttattgctgatttgtttgagttcgttgtacattctggatattagtcgtttgttggatgtttagattgcgaaggttttctcccactctgtgggttttctgtttgctgattgtttattttgctgtacagaagctttttagtttaattaagtcgcatcttttatctttgtttttgttgcattttcttttgggttcttggtcttgaagtctttgcttaagctctttgcctaagactttgtctctatatttaaaaaaatatatgttgcccaggctgctcttgaactcctgaactcaagcaatccccttgctttggcctcccaaagtgctgggattacaggcatgaggcactgtgcctggctgcattattattttaaatccataaaatcacacctttttcagcttaagatcatttctagactgtcctctcactaaaaataccctggaatcaatatacatgttgttagtttgaaaattctttgctaggttgaacagccatattggaaaagtaccaaatccctttagggttttgttattggtaatataaagaggacagagaatgtatttcaaattagttgtcatttcatgaggtgttgcccttcatttcttggcaggtcttaactagaatctagcctcctcttataatagttgaaaatgtctcatgactaattaatatgatacaatgagagcactgttttctgattaataaggtgggtggaccttatgaaatgttatctgaagatcacgcacgtaatctttgatggctgttattgcgttatattgacttgtgattcctgtgtgttcaacttctagtgtgaatagtaaggccaaaaattcaaaagggcttttgaagttgatttgtaattaaatagcattattaaaataaagagtcaaagcattgtcaagtgtgataaattcagtgtcaaaactgagcctttaaaaccaaaaagcgtggctgggcgtggtggctcacgcatgtaatcccagcattttgggaggcctgggcaggtggatcacttgaggtcaggagttcgagaccagcctggccaacatggtgaaaccctgtctctactaaaaattagccagatgtgatggcatatacctgtagtcccagctacttgggaggctgaggcgggagaactgcttgaacctgggaggtggaggctgcagtgagccgagattgtgctattgcactccagcctgggcgacagagcgagaccctgtctccaaaacaaaacaccaaaaagctcatgcctgttatgctagcactttgggaggccaaggcatgaggattgcttgagcctaggagtttgggaccagcctggacaaaataaggagaccccatcactacaaaaagtaagaaaaaggggctggtcgtggtggttcacacctgtaatcccagcactttgggaagctgagataggtggatcatgaggtcaggaattcgagaacagcctggtcccatggtgaaaccccatctctactaaaaatacaaaaaaattagccaggcatggtggtgtgcgcctgtagtcccagctactttggaggctgatgtgggaggatggcttgagccctaggtgtcaaagctgcagtgatcacactactgcactctagcctgggcaacagagagagagatcctgcttccaataaaacaaaacaaaacgccctcctcaaatcagaaagcattctcaaccatagtacttccaagcaccctatttgtgttagaagtgtttaaggcaatgataaagtcagtaaactatttcaagctgttggaagtgcatctcagcacacgacagttgtgatttcataagcttcttaaggtttcaagtgcacagcattttaccgcagaactattactgtctcaggaatgaggcccatggaacacaggaaaattctccacccagggaggaaggctgggaggcctcagcagccaatagtggtgtgactgagactctggagtcccttcacacttgtgtcgcagcttactacgggtcacctccgtcctaagtgtcttacatttattaatcatatatcctcacagatagggaaactgaggcacacagcagccaaggaactcgtccaaggccaaccaggtagtatatggtggaactggagtgaaggcaggctccacagtccctgttcttaacctttatactccactgcttctaattccttactttcttttatacaagaatataatttaaaatcctgcccaacacttgttttgtaagattctagtggcatgggaagtgaggggttacagttggtgtcagtcatatttcaaatggctgggaataggggtgataacatacacccaaggaagtcacgctggctgctacaacattgtgagaatatcattctgctgagattttacgcttgctggtagttgacataaaatgaagcttagtctattatatacaatgccagctttttccttcatcagttacaaggcttgactttaatgaaaggagaagactgcattttcaagtttgatctagaaggctatgaaggctctggttggaattattgagaaagacaaatctcaggtgatctgaacgtgttaaattgtaagagtacttaatgtgaattggaggaagcaattctctgaagcaaagggggaggaatttgtatcttggaaagaattgcctttgtcttttattatttatgcagttgataattgcaatattgccacttcacatatgaaaatatcattgtagtaaatttatgtagagttggctaacaaagttcccatccatctttgctttagttcaattgccattagtttcccagagtactttctaattcctctaccacagtactcatgctttattttgattttaattgtgttatattttctcttctagttagtcaaataagcgaggtcctggtgcacctctgtcttgtccatcattgaattcctaggcttaccacagtgcctgacgtagagttggtgttggcagctatttgtaggatgaatgaatacatgactgtgttaagcagacatcaaaggcgtataaaattgaaatctagttgttgtaagacttaaaaagagaggagatccttatagatgagtgctggttgtttgcaggatcattattattctctgatgatcaaaaaactgtttacgcatgcaccagtagtcccagctactcaggaggctgaggcgggaggatcccttgagcttgggaggcagaggttgcagtgagctgagatcacgccactgcactccatagagccagaccctgtcttaaaaagaaaagaacggtttacagatcagtgagagaggtgttttcctaaatatttaaatgtttgcttgcccatgctacttttccaaatcctaattgtccttttccccctcaaatgctccttcctttgtgaagccgtccttgattcccttgttggactctgttcaccgtgtctgatttttacctcttctagtgcactgactattcttaccgtgtattgtttttattttttggtacatgtgttgttgtttgttctactagactataaactcttgagtgtgaaaaccatgtctacttaaccagcctgcttccgagagtgaaaagggacgctaatcagataggacaccgagtaatagatgtgttcaaggctgtgcgaggcaaacctgatggctggttactctccagtaatctttagcttattgaaaaagcagaggccacttgcacctgtttacaagcaggtgagatgggcctgagaaggtgattgaattgcagattcaaaacgctggtttgtgtcttagtcttatctctgtcacttcactagtctaatgactgtgggtaatttatttcatcttgaagaccctcattttactgacatgttaagtagtgatgaccatttatttcctgctgtttcttaggccccctcctttttgtgttttgaggaagagaagatataaaaaaacgcccttgagagctgtgaagtgtcatagatactacaatatcgttttagaatcaattgaagactttctaactttgtaaacaaatttgaatctgatgactgaaatgctaatctataaaatggttttttagtaataaagtgagacttaatacagtgcttttaaatagtatgaaataagtaaataaatattgtagtttttgttagtatcattatattccttgttcttttaattcatttttaaacttagaattgtttcctacagataaacaaatgtcagcttgggtccatctactacatcttattgtcactttcacttcattgcatcattgctcttaatcagaataaagggtgaatttagcaggttgtagggtttgagtagtgctaagtattgtgaggaattgtgctcaaggtaattaattataaatcatagtccgggtgcggtggctcatgcctgtaatcccagcactttgggaggccaaggcaggcagatcatgaggtcaggagatagagaccatcctggctaatatggtgaaaccccgtctctacaaaaaaattatcctggcgtggtagcgggctcatgtagtcccagctactcgggaggctgaggcaggaaaacggcacaaacctgggaagcggagcatgcagtgagccgagattgtgccactgcactccagcctgggtgacagagcaagcctccgtctcaaaaaaaaaaaaagaaatcatgatctctgctattttaatattttgctcagtatttgaaataagctttataatgtaggctatagtaaaacacagcaattaagtgcttaaaacaagaatatcccaactgtaggtacagcatactttacctaaactatatgactcttatttctatccagcaatgggatcaaaaacttgatgcatttcagaaaacacgaggttaagcaagacgtgggaggattttgacttgtggtaaattttgaaagaaattgtaaatattttcaaagaaaatagaaaaagcacacaattcagagaatatacaaagccaattaaaaagttgtaaaattattattattattattatttttgagacggagtctccctctgtcgcccaggctggagtgcagtggtgcaacttcagctcactgcaacctccgcctcccgggttcaagcaattctcctgcctcagcctcccgagtagctgggattacaggcgtgtgccaccacacccagctaattttttttgtatttttattagagacggggtttcaccatattggccaggctggtctcgaactcctgaccttgtgatctgcccaccttggcctcccaaagtgctgggattacaggcgtgagccactgcgcccggccgtaaaattaaatttaatatctgatctgacggactaaacaaaagatctcttgcctttcaccagtttaccagctttctgttctttttcactcttagttcactaagtgtgagtggactgtgaggcatgagcaggaaggggtggcattgggcatttacagcaagagaccctcatgctaagtgaagtgttatcaaatcttcatttttttgcttatactgtaaaattgccaattatattcatagttattgtaagttatattccaaagtttaactggaaaaatattattttgcaaccaaaaaggtaccaattaatattcctgttcatgaaacaataaaaagaattgaatcagggagaaatgaaaacagctcattttaaatattcaaatttaaaatgatataaaatagggatataaaataaaagcattttatatgaggtatagaggaaagaaattacaacttcaaaacaaatccttgtgatcagcttccatgaggaggaccttagcaatgtataccaaatttaaatgtgaagcttcttaccttcttcttacctcatcttcttaaaagatacatctaaaagaaaaactaaaatttgtatcgatatgtttaattaaagcattattgttattattatgtaaagcagaaagaaacttctgaaaaatagttgagtgatacatttaagcatttcacctaaggaaatttagtgttatttaaactgattaacagtatttggcaaagtattttcattagcgttctaatattaaagctagcatttctttaaaggagggaggctaaaattcatcccaaagcttgtttttgttaactcaaattttctcagtgttattgctgaacaagttactgaattttctctgggtatcttctatattgcctttctttgattcttgtcagtgcaaccagtctaaggttttacatgataaaggaaatctgtggagctaatcctagaaacctctttctattttcttacctaacacctccaggcacagagaagacaaaatacttcatttgcattcttaaacattaggaactcagaataagtctttcaactggaaatgttattgcatctacatttcccgaagagaaaaaggttaacagcctactcaggtttatgttaactcatctctttttagtatcctgatgtgcacaaagagtgaagaatgtgaggcttacccacccaggctctttcttctttacaatcaatgagactctggaagtggtatcagtgctgattacagggaaataaaaagaaaaaatcaaatatgcacaaaagaaatggaaaacactaacatactttaatcttagtcttctaggaatagaaagaacatttccaaaattaataacgaacatagtaattcaaattttttaaaataaaaagtttcctccataaatttgaaaagcttaccaggaaagtacaaagatattgagatttatagtttgtttgttgaaatggtttttattaaagtaatcaataccaaaaaactcttgtttgttctaagtaccttggtcagaaacccgaaacatttaataaaagaaattgaacaattttttgacttaatgtttgctaaaaagtagaaatggaaatcatttaattgccagatattaaaaacagaaagttttctattgctgtaatactcactccccatcagtgtaggagaaacaaggttttatatttaactataatatattccttaaaatatacttaagtgggaaacttaacttctgccgacagttacagtggggaaagttaccactgttctctttccctaactaaataccgtacatagctatcatctggaagtaatagtattacttcagtgcattgtgccagtagacacttaatacagaatatactttagactaaatgaaatccagatcccagtaatactgaaacagaaagacacaggttcctttggttaaactaagtcatagtgtacagtgtactataaattaaatacagtttgtgagtatgtcattagattttaattgaatttgcaattagcatcccaaacatttaaaaatcgtgtgggtttataagtttttacttttgaattttaaaataatagaacctttacccccttccactacccatctcccatagcaatcacatccatttatgttcttatcctaatgaatcagctaaattgggttttaatttacaatgagctggtaagagttaaagaaaatgactcctataaatgtagtaggtgagaggctgagggcatcctcttctaggttattctgctccttcctacctttgttgatgccccacagtcaatgttggggaaaattaattaggatttatattccagtcttctctaatgtgttgtcaccattgcacagactcaggacttccagtgcagtgttgactagtaccagtgcacatccttacccaggggactggaacttacccaggatcacaaaaatgacactaggaatgtttctcccctctcagcattcaaatgttctccttatcttttatttttatatatttatttttgagacaagattttgctctgttgcccaggctggagtgcagtggtgtgaacatggctcactgcagccttgacctcctgggctcaagcagtcctcctgccctggcctcctgtgtagctgggaccatgcctggttaatttttaaatttttttttgtagaaacagggccccactgtgttgtccaggctgatcttgaactcctgggctttaccttttattattttaatttaattttattttttgagacagagtgtcgctttgtcacccaggctggagcacagtggtgtgatcttggctcactgcaacctctgtctcccaggttcaatagattctcctgcctcagctcctgagttgctaggattacaggagcatgccaccatgcccagctaatttttgtagttttagtagagatggtttcaccctgttggtcaggctgtgatccaggcaccttggcctcccaaagtgctgagattacaggcatgagccactgtgcccagccttatcttttatttttaatgattattgtttaaagtacactgagttcaggttaaaaaccaactgccaaagtaaattttaacacctaaaagctgggagaaggggccattcttcttttatgcagtaactctttggagtccagatactaacatgccccagatttcatcctggtgctaaactgacttgttttccaattaaaaaaaataaaagtctgagtaatattgcgtaggagtaccagaaatggccttgttggaaaccaaaactatttacattcgttaagaaatctgtttgcaggtgtgtctgccacatttacagcacagtgtacagctcctggcactcaatacacagtgttgcacagcttgccgcaggagcataaagtggaggtagtaaaaaggtaaggaagaaagagggaggaggatgagttgttctctattcatttgcttctcatttcatcactgatttggtggtacccagacctttacagagccggtctccataatactggtgcaggtggcctgatgcccagtttctgttgctcagataatgcagtctcatctcgtctgtgatttcagcagcactcatggcaatgggaacattctttttctttgcaacccaggagtgagattgaatctctgattaaagagcaaagcttgagtgttttggacatggtaatgctgcagaggtgagttcctgttctggctgtccatgtccaaacaagtgaaacaaatgttttcatactttgcagttgccacgttcattcattcattcattcattcattcattcattcattcatttttgagacgagtttcgctcttgttgcccaggctggaatgcaatggcatgatcttggctcactgcaacctctgcctgctggctcaagtgattctcctgcctcagccttccgagtagctgggataacaggtgcacaccaccatgcctggctattttttatatttttagtagagacggggtttcaccatgttgaccaggctggtctcaaactcctgacctcaggtaatctgcccgcctcggcctcccaaagtgctgggattacaggagtgagccaccacacccggtctgcagttgccacatttaacctttagtgctaagtaaacatttcaccatggttcactttgtacaaaatgagaatctttactgaagcatcccagccaaacataagaatgtactttacaattttttttttttttttttaagcctaaagtccctggaagaggctggcaaactggcttgagaaacacttcactgggcatagagctgctgaagctgctcctagtccgtgtgttgatttcactcctataagttggtggctactctgaaatagttttcaaaatttttattgtaaaataaaaggcagttacaggagaactatacaaaagaaacctatggcttaatgaactattatagggcgaactattttgaaatcatgaaataggtccagacgcagatgtttaccctgaatcctggaaagctgtgtgacccatctcagtgctaacctccggcctctctctaaacatacccattcctttggcttttatagtaatcatttttttttgcgtttaaaaataattttattgtccaaatgtgccaccttggacacaatatttaagtcttgtccatttatttttaaatttgataagtctttaaaatcttagtctgtaggctcctcttgcttccttttcttcatgacttatctgttgaagaacttgggtgtttgacttacagagtcttaccccagtcttgacttagctcactgcatggcgatgctatagctcagtggtttcccccattcttggtgtttcctacaaattggcacttgaattcagagatgggatcagacttggatttgatgcctttgatgaagactataggaggcacataatgtctttttagctctttttaagatataagcagactttgatgcttactgcccatatctagtaatttattggattacaaaattttggtagtttaatgctaacatttttttcattagttaattggaatatatttagaaagaaacccttcttctcatttactgttttattaccactggtacaattcatatatgagaagcaagataaatgcttaattctttacctttatttactatttctgaagtaatgattggttccttatcatccctcgaagttagccaattcttttgaagaaatcactatgaagtcatactgttgaaattactgtgaagtcaagttgttcctctttggtccgtggggcttaagttgactcacgggtctttttgacttgacctcataatcttctctagcttccttactatctgatctgacaggacattccaggctcatgttttacattttctgttccaactctttatttttatttatttatttatttatttttgagacagagtctcactctgtcacccaggctggagtgcagtggcgcaatcttggctcactgcaagctctgcctcccgggttcacaccgttctcctgcctcagcctcctgagtaggactgctggagcctgccaccatgcctggctaattttgtttttgtatttttagtatagatggggtttcaccatgttagctagaatggtctcgatttcctgacctcgtgatccacccgccttggcctcccaaagtgctgggattacaggcgtgagccacagtgcctggccttctgttcaactctaatcagccatcttttcaaaatgccttggcttcttctaatggtatttggagatcacagttggggtactaggcatggtcattgctactgattggtcattttaagcctttttagttgcaggctaggaaaaaaaatatacatatatattaacaggtttttaacatatacgttttatgttatatatgtatattgcttataatacaatatgttatcttaactatattatattaataaaatatataccatatggcaatatatttactatataaatatgtttaaatataatgccaaccctaacccaaaatagggtatgtatataaaacaaatttatattataataatcatactgtattaataaaatgcacataacatttttctcatatataatgtatataacaatatagaagtataattaaataaagtctacattttatgtgagacaaaacaactcctgtgttcatagcaatattttccattacaattcaaaattgcagaactttaacctctttgttgcctctgtgtatcttcattcttctggattcagaattctgactctcaaggataggggaaatgacagaattagagtatctcacaattgcttatttgtcttgtcctgtgctatacacagagcaatctcaggataacaatgttaataccactaccaatatgattactaaaaacattaaaaatgtatttgtacataatcttcctgtaatattaaaaaaaaagttgtactatatctatattgtcagaaaatgtggctgttatctataaggttttatatatatatctccttagctttcatttagttttagctctacaagtaaatcccgactctttttgttgatatctcttttgtcattttagtttcctgaagctcattctctagtacaggagtgggcaaaccttttctgtaaggagccagaggggaaatatttttggctttgtaggccctatgatctctgctagtactcattcttattcttatagtgagaaagcaatcacagacagtgtaaactatgagcatggtggctacgtttcagtttcatataatttttatgtgtaatgatacagtatttaaaaaaatttttgcctaacccccacccccaataattagtaaaatcttttcttagatcatggactgtacaaaaacaggcagtgaggctaggtgtggtggctgtcacctgtaatccctgcattttgagaggctgaggtgggcggatcatctgaagtaggagtttgagaccagcctgaccaacatggtgaaaccccgtccctactaaaaatacaaaattagctgggcgtggtggtgcatgcctgtaatcccagctacttgggaggctgaggcaggagaatcgcttgaacccgggagctggaggttgcagtgagctgagattgcaccattgcactccagcctgggcaacaagactgaaactgcgtctcaaaaaaaaaaaaaaaaaaaaaaaaaaaaaaccaaaagcagggagtgaatgggccagatttggcctacacactagtttgcaaacctctgttgtattggacttctcagagtttatgagttcttgcatgttgttaaattttctctgcctttcatagttgcactgacttctatggatttaaaattcttagcttgactcagcctggtggctcatgcctgcaatcccaacactttgggagactgaggcaggaggatcacttgaggccaggagtttgagaccatcataggcaacatagcaagactccatctctacccaaaaaaaaaaaaaaaaaaaactgggcacagcagtacacatctgtaggcctagctacttgggaggtcaagatgggaggatcacttgagcccaggagtttgaggctgcagtgaactataatggcacccctgcactccaggctgggtaacagagcaagaccctgttccacgaaaagaacataaaattattagctcatactttctttccttgaatttcttactcaaaagagtttattattccattttcttttggtataaaatgttgctgtcaaagtctgatgattatttaaatttctcttttgtataagttacctattcctgtttttttttttttcattttcttttacttaagtaatattgctagaatttttcttggtatgttggtcatcctggaatgaatttctcctgtagtgtggtcttttaatatgtatttttagttcaagtaaattttcttgagttgtatttttaatatttgctcttttttttgctttggttctcttcaaggattcctattattcatatgttggatgttcttttttattttcaatatttctcatcttctgtattatttattcattttttatatttaaattaaatatttttattttcaatttgtctttctcataaggcattgtctgttttccttattcactcttacattctttgtagctgttttcatttctggaatgattttctttttcatttctagttgtatcctgagttctgtcatctcatttctgagcttttctaaatctgatttatactattttatgttatgtgtcacttaaaaatgtcttttaacttgttttgaaatattagatgataggccaggtgcggtggctcacgcttgtaatcccagcactttgggaggccaaggtaggcggatcacgagatcaggagttcgataccagcttggccaacataatgaaactccgtctctactaaaaatacaaaaaaaattagccgggcgtggtggtgcgcgtctgtagtcccagctacttgggaggctgaggcaggagaattgcttgaacctgggaggtggaggttgcagtgagctgaggtcgcgccactgcactccagcctgggtgacagagtgagactccgtctcaaaaaaaaaaaaaaaaagaaatgagatgatagttttgatctattgtattggtatgtttttctcctgtgctttcctgccctacatggatgttactctggtccctttttctttgccttataaaaacattgtattggggccaggcatggtggctcacgcctttaatcccagaactttgggaggccgaggcgggtggatcacttgaggtcaggatttcgagaccagctcggccaacatggtgaaaccctgtctctactaaaaatataaaaccatattagcccggcatggtggggggtgcctgtagtcccagctacttggaggctgaggcaggagaattgcttgaacccaagaggcggagattgcaatgagccaggattgcaccgctgcactccggagtgagacttcgtatcaagacaaaaaacaaaaaaaattatgttggattttaccttgatattttatttcacttagtttaatgtgtaaaattggtttttctctacatttctttttaaagagccatgtattttaaaatcagtgactcatgtccaagaagttcaaacacgagtagagatagcaggaagtggtttattctgaggtcttgaaaagaatgaattaaccctgtaatctccccagtattctttttgatgttcctattgacatcactatattcagtgggtgctcctttctatctgctacattagtttttgaaagctttctttctgactcagtttatctcatgtgctaacttcctgaaccaatcctggaactggccttttctaccagaaacactcttttcttttatcatggaatagtattaaaaaccacaatctggatcttttggacagttcagctgtttttccgtggcttttttttttttttcgagacagggtcttgctctgtcatccaggctggagtgcagcggtgcagtctcggctcactgcagcctctacccgctgggctcaagcaatcctcctacctcagcttcctgagtagctgggaccacatgggaccacaggtatacaccaccatgcctggctaatttttatattttttgtagagaaaagtttttgccatgttgctcagcctggtttcaaactcctgagctcgtgcagctcacctgcctcggcctcccaaagtgctgagattacaggcgtgacccactgtgcccagccccatggctgtctttttcttctgaccctggttttgtagttatccaagtagcaactcttggtaagcctaaaatctatacgctttaaaatctgaattcataatatagcaatttactaacttgtggtatttctaagaatgaaatatgtatcatacattttaatttttacaatgattctttctgtccttcattcctgacataaagcctatggtaaattaaatctcatttccttaacatactgctcaaacccaaccctttcccccattcttctattaaaatttgtccagaaccatagagtcacagaatttaggaaatgagtagaattttggagcagtgatttcagcttttcataatttctttctcttcttttgtcttgctgtgttgcccatgctgaagtgtagtggctagtcataggtgccatcatagcgcacaacagctttgaacagtatctgggctcaagagatactcctggctcagccttccaagtacctgggactacaggcacacttggctcataattttttttttttaaatgaatcactttaatgatgaaaaatgcccactttttgtgatcataagacatttacttgtattcagatattatatgtatcatgcaaggtaaatttaaaaggaccttaaaaagcatatttttggaaacaaatttagttgctattgcataacaaaaaacttacagtgattaagggaaactgataattagatggataacaaaaaataccgggttaacagaagagtatcgaaggttactagtggataaaatctggccttttattctaagtcacaccgctgcctggtcaagaactgaaaacatttgaaacatgctccatcacactgcagttaccatactctcttatcctgacctcatcctttttggttacagatttatgggagccaagagcctctaatgttgctttctcattttgctttaattacttttaaaggccaatctagggagcacttccaaaacacattgataaaaaggaagttaagtctttgaaacatttgtagttatccagcatactactggctatttttcttttgtattgggtgggacaaaaaatagtcactaaatacttgatataagctttttttttttttttttttttgacaattttacatttttgggtgagtaattttcctcaaattagaatgcacaagaaaaatctggttaatcagtgttccaggtcgttgggctcctgttaatcagaagttttactgtataatcataatgtattttggatgttctcatttatgttatttcttcaattctttgtgtgggtactctgattgcttgattacatctgcctggcatagtcgtttttaaagcagcatttataataaaattttccatctttgcaagtaaaatgagaatatggaaagacaattgatggttgaagcatgattgtttcctcttgtctttacttagtgtttagtgggtttcaggttttggataaagagaaatgaatatgattattgtcctggtccgaaatgattcatgtatccacctggagacgtagagttgatagaggtgtaggcttacctctattatctcctcatacagagcagcgctacttcctacgtatgtgctttacatttttggggatttgcataagattttttttttccatgaaaataaggttctactaaaaccaaatacagaaacatttgatagagagatactttataagcacctcttagggctgaaagggtttcttgtctagcatcctgccacttgtaacaccagcaaattctaggcatttgggttcctataatattattttagagtcctgtggacctagctatcttattattctagtgtcctcttttttttctggagacagagtctcactctgttgcccaggctggagtgcagtggtgcaatcttggctcactgcaaactctacctcccaggttcaagcaattctcctgcctcaacctccagagtagttgggattacaggcgtgcaccaccatgcctagctgatttttgtatttttagtagaggccactatgttggtcaggctggtctcaaactcctgacctcaggtgatctgcctgccttggcctcccaaagtgctgggattacaggtgtgagccactgtgcccggccattctaatgtcttctttttatcaagacttctggagagtggacaaaaactaacagttgtggcactcaacttggtgctttatattattattgatggggtttaggacatgctactcccaaatttggcaccttggcatataagctgaaggatttggagaaaacagcagaagcacgaaggtctctgaccttccccttcctctcttccctgaagcaggtcctaagacctaggagggactttctgaccttctctgaaccagatcctaagaccttcatgtgagagatgcccttcctgtatctggaagagaggagcatcctcatccccatagagaaaaggacgcagagtaatctgagtagtttcccccagtttatgatacttacctcttgctctccgtgctatcatttctccataactcaccagtcctcatcaaccctgtataaaaacactcaagtttaactgtttctttggattttcatttccttatgcaggctccggtgtcacgtacaacttacaattaagtaaatgtgtatgcttgtttttttggtaaactatcttttgtaataggtgccctagccataaacttagaagggtagaaggaaaataatagttttcctcctgtacattattttatttaattctttaatcaaacttaaaagtcagatattatccacattgtcactcaaagaaatgggtgctttagactcagggtctaaaatttcccttttcttttgttttgcttttgggtaggagagaagcatacctcttgaatttaaagacattggcttttctactcattttctctgaatgatttcattcacaacttttatttttgtatttatttttttgagatggagtctcgctctgtcgccaggctggagtgtagtggctccatctcggctcactgcaacctctgactcctgggttcaagcagttctcccacctcagcctcccaagtagctgggattacaggcgcatgccaccacgcccagctaatttttggtagttttagtagagacgggctttcactgtgttggtcaggatggtctcgatctcctgacctcaagatctgccctcctcggcctcccaaagtgctgggagtacaggtatgagccaccacacccggactgccattcacagcttttaattccgtcctgtatttgatgcctttaaaaatctgtattttggccaggcgtggtggctcatgcctgtaatcctagcactttgggaggcggaggctggtggatcatgagattaagaggtcgagatcatcctggccaatatggtgaaaccccatctctactaaaaatacaaaaattagctgggcgtggtggcgcgctcctgtagtcccagctactcgggaggctgaggcaggagaatcgcttgaacccgggagacggaggttgcagtgagccaagattgtgccattgcactccagcctggtgacagagtgagactctgtctcaaaaaagaaaaaatctgtgtttcagcctggacttgtctaataacccctatacctctatatctgcctcctgaacatgaatacttgactattgcagaggcctgtcagctcagcgtgtgcaaagttggagtcatcatctcgcctcttaaatatttatctccttgtatattctttgtgtttattccttgttctacttctacttcctgctcggggtgggtttaatcctcttggtcatgatggccaggagagcagtccaagcaacaggctactcagctgccctggtcaccaggagaatgaaccttttttcccaagtcaagattctttgcaggcagcaacgctaacatggaatgaacaggtgatgtaaaagtgatatacaaatatgcagtttattgtttataccaactctgacaaggtcgtaggacaatcagcagttaggcgccttcctcgaggaaggcctgcatataggtctggtttttcccattttatatttaccttcagttctttatgtaatgacttcatcctttatctcagcaaatacccccattacttttctagaccatgccctgtggtggagctaatggcatcatattttgttctgtctctagatctatttaagtcactagcttttttttttaaattagagtggcataaacaagagaggtagatccattgtcaaggtattcagtgtggtttgtgcagagtggttttgattgaaactgaactctacccagttaaattcccactggatttttgactcatcttttatagtcacaggatgcaaacatgtactttcttttgtctatttctctgaggtgtcagtgatctgttcacgtttcctggaaattgttgatatcctgttgtcttcatccatgttatctcctgtgtttagctcagagcctggcacagaattggtattcaggaaatatggatatttgtgttatactaggcattatgctgcaggctattgagaacacagagatttataaggtgtttacgggtgaccttactggctagattaggtggtgtaggacgttatatacaaatacagtgtcatagagtgacttttccgaggcacactgtttacccagaaggagttcttcagtgcttttggttgttttcatttgactttgttgcatgcatctatccacacatgtactatatgcaatatagtattttaatgtgttggctcaaaaactgttgtttctgcaataaaaataattagaaaatacacatatgggcttttcttttataaaattgtgactccacatcatgctccgtaatgttcttgttataaattttgacttgtttttctccacaggcagcagaagatgtcgttttcattggacctgacacacatgctattcaagccatgggcgacaagattgaaagcaaattattagctaagaaagcagaggttaatacaatccctggctttgatggagtagtcaaggtgagaagctactttaacttttattgtatatgtcttcaagttaaacattttgtcaaaagtataagataaaatgtaactattgcttttttgggatatacacacacacacacacatatgcacgcacatacatacatgtatatatgtttaaaaaatcagtgtttttacatttatttatttatttatttgagatggagtcttgctcttgtcgcccaggctggagtgcaatgatgcaatctcggttcactgcaacctctgcctcctgggttcaagcgattctcctgcctcagcctcccgagtagctgggattgcaggtgcctgccaccatgcccagctaatttttgtatttttagtagagacagggtttcaccatgttggccaggctggtctcgaactcctgaccccaggtgatctgcctgcttcatcctcccaaggtgctgggattacaggcgtgagtcactgcatccggccagaaatcagtgtttttaactggattattttattatttttagagatggaggtctcactctgttgcccaggctggagtgcagtggtgcagtcatagctcactgtaaccttgaactcttaggctcaaatgatcctctcgccatgactcaagaatccctccttctttagcctcccaagtagctaggactgcagacacacaccaccacacctgactaattatttttattttgtagagatgagggtctcaccgtgttgcccaggctggtctcaaactcctgggctgaagtgattctcccgccttggccttcccaggtgttgggattacagatgtgaaccattgtgcctggccaacttggattgttttaaatagcataagttaaaaagagtgagaaactgtttgagcattgtatttaatgaatcagcagtgactcagactttcataggaaaaaatttggtgattaaaaaatgtactgtcagatctctggactgcatttaatagtggtatgtgtttcatgtgttaaacattaagagtttctctgtatatctttatcttgagcttctctccatgtgcataatatgtaagttaggatcatgtttctggtgaaagtggtatagctataggtaattgtatattgcaaacatttagcaagggccttctgcagctgaaggcttctgagggagaaatgcagaaattgaagtatgcaacttctccttttcccatgagaaattattctgtttttttctagttagaagagagtcctcatgtagagttttaaccttgcgatttgacttagcctgcaggaactcttcatttcagcatttcgtattgttacttttggcattctgtgttgggttgttcttcattgtgcaagatcatttcatgcattagaggacgattagaaaacttgccccctagttaataaatatcctcagcttcttgcccatatttacctgcatttacttttatctatgtgtatccatgttgtttcttcccacttgttacaaggaagaggtgttccacatcctctggaaagccagttcctcctcctacgctccaaatgtattctttatagccttcacaggctatggttttactgattatcttttctctcttctgtgtcttaaaattctcctcatcttttagctccttttgttatcattgctattaaaaatgctcagtgaacaaatgtgttggtcactcagttatgtgggaaggatgtggtgatgagatacacatgatctgcgtatcatagttctcacagtttagtgggaaagaaacaaacatttcttccattcgtaaagcaccatcacccctatcactctacagctagttgccaccttctttctctcttcccctttcagtgccaaagctcttagaattgtccttcctcactttcatttctgtatctttcacttaatcttttcttgccgtctagcttctttcctcattcctactgaatttctcttgcaaagctaccagcaacctcttccctttgttaaatcaatatgtaattttgaattctgatcttatatcaatctttgagcaacatttgagtctcttggtcagtccatacttctctcatgagatactcacttttggcacattactcagttctagtttttgtgttttttggcttttttgaatgccattcttagattccttcccgattgttcttcctatctttgttccttaaatgggggttttattctgggtcctgagtaggacatttcctctttttattgtgctaacttgccctgggcaatcttactttttttcatggcgtcaattgccaccttttcttttttcttttactattattattattttttgagacaaggtcttgttctatcacccaggctagagtgcagtggcatagtcatggctcactgcaacgtcaacctcgtgggctcaagtgctcctcccacgtcagcttcttgaataggtgagactataggtgtgtgccaccacagctgcctacttttttatattttgtagagacgggggtctcactattttgcctagactggtctcaaattcctgggctcaagcagtccttcccctcggcctcccaaagtgctgggattacaggcatgagccactacacttggcctattgccacttttctgaccaatctcaaatgtatgtatctgttctgaacttcaggattacatatccagttgcttcttatatagctctcactacttgatgcctctgaggcaccttgaaactaacaattaaaagctgaactcatctttctcctgaaactagagattggtactatagcccatgcacacctatttttataaataaaggtttattggagggcaaccatgttcatccctttacatattgtctgtggttgcttttccactacagtggtagagctgagtagtagactcaatatgtggagtagactcaactacatgggacacatagtagactatgtgactcacaaagcctaaaatatttacttcctgatccattaagaaaaagtttgcctatccctgctctaaaattcttatccttcattcttttccgcctaggaaggtggtggctagaaacatagagtaattcttaacaaatgcgactgtggagaattcactcagatagctttctaatccatttacttctttctttgcccgtactaaccaaccccagattccagctactatcatctagtctggattacttcatctgccttctaattagtctccttgtagtcattcttgcttccatccaattaattttttaaaaattcttcacctcaagtatttataatgtctttgtgttacaaacagtctaatatacttttagttatttaaaaatgtacaataaattattgttgactgtaatcactttgttgtgctgtcgaatactagatcttacccattctatctaactggacccatttttgtacccattaaccatccccacatcacccacccccactcctccccactacccttcccagcctctggcaatcatcattctactctctctcactgtgagttcaactatgttaatttttagctcccacagatgagtgagaacatgtcaagtttgtctttctatgtctgacttagttcatttaacataatgtcctccagttccatctatgttgttgcaagtgacaggacctcattctttttggtggctgaatagtactccattgtatatatgtaccacattttaaaaatccattcgtctgttgatggacatttaggttgcttccaaatgttggctattgtggatagtgttgtggtaaacatggtagtgtagatatctctttgatagactgctttcctttcttttgggtatatacctagcagtgggattgctggatcatatggcagctctatttttagtgttttgaggaacctctatactgttctccacagtggctttactaatttgcattccccccaacactatacaagagttcccttttctctatatcctcgccagcatttgttattgcctgtcttttggataaaagccaatttaactggggtgagatgatctctcattgtattgcatttctctgatgatcagtgatgttgagcacctttttatatgcctgtttaacatttgtatgtcttcttttgagaaatgtctattcagatcttttgcccatttaaaaaattggattattagattttttttcttgttgagttgtttgagctccttatatattctggttattaatctcttgtcagatggatagtttgcaaatattttgctcccattccatgagttgtctcttgactgttgatttccttggctgtgtggaagctttttaacttgatgtgaccccatttatttatttttgctttgcttgcctgggcttgtggggaattactcaagaaatttttgcccagaccagcatcttacagagtttttgcaatgttttcttttggtagtttcataatttgaggttttaggtttaaattttcaatccattttgatttgatttttgtatatggcaagagataagggtctagttttgttcttctgcatctggttatccggttctccgagcaccatttattgaagagaccgtcctttccctaaggtatattcttggcacctttgtcaagtgaattcactatagatatatggatttatttctgggttctctattctgttctattggtctatgccagtactatgctgttttgattgctatagctctgtagtataattttaagtcaagtagtgtgattcctccagttttgttcattttcctcaggatagctttgcctatcctgggtcttttgtggttctatataaattttaggatttttttttctatttctgtgaagattgtcattggtattttgataaggattatattgaatcggtagattgctttaggtagtatggacattttaacaatattgattcttccaacccatgaatgtagaatctctttgcatcttttgtgtccttttcaatttctcgcatcaacgttttatagttgtttttttgtgtgtgtgtgtgtgtgtttttttttttagatggaacctcgctctgttgccaggctggagtgcagtggtgcaatctcggctcactgcaacctctgcctcccgggttcaagcgattctcctgcctccggctccctggtatctgggactataggcatgcaccaccacgcccaactaatttttgctttgtttttagtagagacggggttttaccatgttggccatgatggtcttgatctcctgaccttgtgatccacccacctctgcctcccaaagtgctgggattacaggcatgagccactgaacctggcctatagttttcattgtagagacctttcacttctttggttaagtttattcctaggtattttattttattttattttattcatagctattgtaaatgggattattttcttgatatcgtcttcactgttggcatataggaattcccatccattaattaatgatacttcagtttgagtgaccaaaaatccagatttgatcgtatgcctatctttaataacttttgaatgactactcatataaatgttttaaatggttggattttgcttagctctccaaactgatactgtgccagtctatcctttgcattgtatgtatccgccatacttgacatcgttcagattcttgaaacttatgtgcttagtcatatctgcttctgtcttcattcctgattgtctcttagtcattgtttaggtcttggcttaaatgtaaattcctcacataggcattccttaactgtcttcattagattaggctctctgctgtatttttccttaggaccctacacttaactcatcacattttaaatcatttattcattcatctattcagtagatatttaccaagtgcacgcaatttgtctgacactgtttgaagtgctgttgatatagtagtgaacaaaagagactgaacatatttttatgccctcaaggagcttacactatagaaggaaacagatgataaataataaaacatatgttctatgttgaaacataagagaaaaagactgctggaaggtggggctatattcacaattttatatacaggcatgtcttcatatctacaagggattggttccaagacctaccccctcagataccaaaatttgttgatgctcaagtgccttatatgaaatggggtagtgtttgcatatatcctacgctcatccttctgtatactttattttattttttatttttatatatttatttttttgaggtggagtctcactttattgcccaggctagagtgcagtgtcatgatctcggctcactgtaacctccgtccaccctgggttcaagcaattctcccacctcagcctctcaagtagctgggattacaggcatgcaccaccatgcccagctgttttttgtatttttagtagagatgaagtttcaccacgttggccaggctggtcttgaactcctgacctcaagtgattcacctgccttggcctcccaagtgctgggattgcaggtgtgagccactgtgcgcagccctgccgtatactttaaatcatctctagattacttataataccctaaaacaatgtaaatgctatgtaaatagttgtcccactgtgttttaaaatatgcagtattttaattttcctccctttcccttccccttcccctccccttccccttcccctctccttcccctttcccttccccttcccttttttgggtttaatccatggatacagaacccaaggatatagagggccaagtgcatgtttagcagaccatctaaggaagtggcaggacaagtcatgttgctatcctggagaagagcaaagcatattaggcagaaagaataacaagcgcaagattgttggttgaggttgaagtgtacctgctactgaataaacaccgaggaagcatgtgattggaatcatcgagagagacaatttagagataaggtaaaaaaagataatggtgtagtagggagcttagatttttagggccttacaggccatttcagtattaggtaaatgtctccttcctacacggagcgtaagcttctgatggcagggatgctgctctctttattactgtatcacatgcacatggtgcctgacatattgtcagtgcttaagtcaatgctcagtcagtgctcactaggtatttgttgaatgaataatattctaggagataaattttatacatatactcattttatatacgttgccatttagtacatattgtttagtcacatctattagaggcaccaaaagaaaccaaaaaccaagagaaaaaattaaaagacaatagaaacatatccacatatgcttcagatattggaattggctgagataactacgatttatatgctaaagaaatccaaggaaaatatggagaaaatagataagtatataaagaatttcatccgggtatggtggctcatgcctgtaatcccagcactttgggaggccgaggtgggcggatcacctgaggtcaggagttcaagatcagcctgatcaacatggcgaaaccccgtctctactgaaaatacaaaaaatatttgagtgttgtggcaggtgcctgtaatcccagctactcgggaggctgaggcctgagaatcccttgaacctgggaggtggaggttgcagtgagccgagatcacgccattgcactccagcctgggcaacaagagcggaactctgtctaaaaaaaacaagaatttcacaagagaatttgaatctattttaaaaattaaatacaagactgggtgcagtggcttacgcctgtaatcccagcactttgggaggccgaggtgggtggatcatgaggtcaggagttcgagaccagcctggccagcatgatgaaaccccgtctctactaaaaatagaaaaattagctgggcgtggtggtgcgcacctgtaatcccagccactcgggaggctgagtaggagaatcgctggaccacaggaggtggagcttgcagtgagccgagatcatgccactgcaccccagcctgggtgacagagcgagactccatctcaaaaaaaaaaaaattaaatagaaattctgtaactgcaaatatatgaaaataaggactttagatagacttaacattggactcaaccaagcaaaatatagtatccatgttatagcatgtatcagtttttgtgtgtgtgtgtgtgtggctgagtgatattcagttgtatgaatatgcttcttaaaaaaatccacctgaggtcaggagttcaagaccagcctggccaacatggtgaaaccctgtctctactaaaaatacaaaaaaattagttgggcgtggtggcaggcacctgtaatgtcagctacttgggaggctgaggcaggagaatcgctagaaccctgggggcggaggttttttgtgtgtgtgtggctgagtgatattcaattgtatgaatataccacttaaaaaaatccatctgaggtcaggagttcaagaccagcctggccagcatggtgaaatcccgactctactaaaaatagaaaaaaataagctgggcgtggtggcaggccctgtaatgtcagctactcgggaggctgaggcaggagaatcactagaaccctgggggaggaggttgcagtgagctgagatggcaccactgcactccagcctgggcaacagagtaagactctgtctaaaaaaaaaaaaaaatccattcattagttgaaagacatttgggttacattttgaccattgcaattagtattgctacaaatatttgtatgcaagtatttgcttatatatttgtttgttttgagatggtatttcactcttgttgcccaggctggagtgcagtggcgtgatcttgactcactgcaacctctgctgagttcaagtgattctcctgcctcagtctcccaagtagctgggattacaggcacccaccaccatgtctggctatgggttgtttttttttttttttgtatttagcagagacgggttttcaccatgttagactggtcttgaactcctgacctcaggttatccacccgccttggcctcccaaagtgctgggattacaggcgcgtgccactgcgcccagccatatgtctgttttttaagttatttggggtatgtacccaagagtggaattcctgggtcatgtggtaattctttgttcagctttttgaggaactgtcaggcatccaaacctttatgtactcccttcctcttgtataatccactcctcttcaatttgggtagaacctgtgaattgcttctctaactaatagaatatggcaaaggtgatgtgatattactcccttaattaggttgcattatatggcaaaagtgatgggatgtcactgcattcaattacattatgtggcaaagtggttgggtgtcactcttgtgattatgtttcattatatagtacttgatcttaacagactagagaacaagattctttttgctggcttgataaagtaagcagccatattaaggaagcctacttggcagtgaatggtgggcagattctaaggatctatgtaaggacagtctctacccaagagctagcaaaaggctggggtccttcatcatgcagctacaaggacataattctgccaactacctgaaagagcttggcagcaaatttctccccatttgagtctccagtgacaatgcagcctggttcactccctgattgcagccttgcaaacccctgagcagtgtatgatgaaattattattattatttccttatgaggtcttgtcctctttacctttttgttttagacatttgtgtgaatttgggtaggggtttggatgtgtcattatgaaccttgatctactcagcctgaatatttctaccagtataattatatatttttttgatgaggaatgttgcctttttgatatcttcaatttggacttgatttattcccaagaatactgatgtgtcactgtccaaattatttctggcttgatgatgaatggtggagtcctcaagggttcaaggaagagaccatcaggagagtgtttgatctggaaattctgtttacacgggagatttttccttatgaaattagtgaatgtagtgtctcctaggaagggaatgtttcttggctaaaggtccaaaggtgaccgttgtgtgctgggacatgggaaatgtgacgggtattatccatatctgtcaactgagtagtttgttgattccgagggagagcttgtggaacaatggcaggaattaaggtaaatatactgccacccatatcaataaaatttttacttgtttctccgctaataattagtgaaaattcgtcttgtgagttgaagagtaaaaggagaaatgggtacttgatttgctgttagaacatttgcctactatcattttttcccaattctcttgaataaaacagaacaattatttttccattgtaatttcttcttacaatctctgcaggtttctttatcaaaagactggtgtttaatttttggagtgggagcatctagttttatcttcaagggtatcatcttattctgggtcttatactgcctttgttttcaggctcttttgaaatgtgtaatatggagttacattgtttgacaatgtggtgccttcccagccagtttttgcttgtttataacattttctttttctggcttaaggctgttcacaagaagtgaggaaggagctggggtcacaactacttgagggcttactcctgaatgctaactgaaggtagtaagagcccaccctggaagtctgcaaggggcttatccttcgtctgctagaacaactgaattagagttacctgttttcacaggaaagattttggtaatagccttcaaaagaccgtgtccaatatttacagtttcttttttttgtttttgttttttttgagacaagagtctctttctgtcacccaggctggagtgcagtggcgcaatcttggctaactgcaacctccacctcccgggttgaagcagttctcctgcctcagcctcccaagtagctgggaccacatgtctgagccaccatgcctgactaatttttttttttttttttttggtatttctagtagagactgggtttcaccatgttggccgggtcttgaactccttacttcaagtgatccacctgcctcggcctcccaaagtgttgggattacaggcatgtgccaccgcgccccgtcattcacagtttttctaaaccccactggctttctgtgcatttggggtctgaagtcactctcaggatatttgtttcccctttctaataggtcttcctatttccctctccttgctccccactttgtaactatccttggtgaaatgatgccatttataaagagaagaccatgaatttgcattacatatttaatgcatttaaagaaacagaagtctgactctgagagaccacagacttagtctgagccaaactcatgggagtctcctaatggcatattgaatatgttgtttgtgcacctcctgtcttgggctcacagcctaatggttggccatctctaactgcaaacctgacagtgccttgttggtttaagatttggagagactgtctctcctaggcccagacttccatggacaaagcaagtcaagacagaggaaaatactcaaggttcccaggtaaattgtgttctatttggatgatgatctgatgaaaccttctgaactcactggcttctagagtcagcatgaaaatgggcttatgaaacctatgcctgtcttctttcaggtgaactttgacttatggacttagaataaaaaatgttgaggacagtatattagtaatatgggaggtttcttccaatattaaacattttcaaatgtgataagaaattcagtgggtctttattcctacagttgttgaaaaggaaattggacctctacccagtgtgactcatctcaccattgtggttggggagacccctgagggggtcgctcagtgggcctcagagaagcatgcagatgccagatctaagatcttgaactgtggcttttagtgggcttcgaacatgtgtctgtgggtaatacacttggttttgcttgttcaacaggttattttggttatcttcttaggaggctgcatctgaatttgcagcctctgttctagtaaatttggaaaatatggaaaggtagacaggagaaaagaaatctcatcttttcagtttttttccttgtatgcattagatgatttgtaacatcctattacactctcaaatgattgattctcattatctgcactaacgactatttctgaatttgtgacgccacagctgaacctgcaggttatagttttcagataagcatttacaaataatttttaaggaatgtccttttgtttccctgggaaattttttttttttttttttttttgagacggagtctcaccctggagtgcagtggtgcgatctcagctcactgcaacctctgcatcccgggttcaagcaattctcctgcctcagcctcccgagtaattgggattacagacatgaaccaccatgtccagctaattttgcatttttagtagagacagggtttcgccatattggccaggctggtctcaaactcctgacctcaagtgatccacctgccttggctccccaaagtgctaggattataggtgtccaggtgtgagccactgcgcctggtggaaataattttttttgagacagagtctcactctgttgcccagactggagtacagtggcacaatctggactcactccatccccgccccctgggttcaagcgattctcctgcctcagcctccggagtagctgggattacagatatgcgccaccatgcctggctaatttttgtatttttagtaattagtaattttttagtaatttttgtatttttagtagagatgaggtttcaccatgttggccaggctggttttgaactcctgagcttgggtgatccgccctcctcagcctcccaaagtgttgggattagaggtgtgagccaccgtgcctgactggaaataatttttaatactagttttatttttagtttgtttttatttctgatacaagaggctgtacatatttttcttttaaatttggctattaatttaggtttctggtatagtgactccacattcacttggagctacaccattcacatttactagtttagatatattgagtataagattacttttgagagtatctatgcagatagaagtttgctgatggaaataaatagtaccgaattttggaatatcttgggtttttagcaacagtttttcattggcagagtgcatatgccaattacaggtaattctgtcttttaaaaaatgtttagtgttctttaaaattagtctacagtgtttttaagactaaagtcttttccttgataactatattctattttttttccccaagtagtttccaccagttatgatacaattttagtttgttacatttctccttcaaacatttgttcctttcttatttgaatatgtaggatgttacatggagacagtttacccatacccctttaaagcattgtgtgcagtacttcagtggtcttctgcaactcttctttttaatggcttattaatctgtccttgaatcatccttttccttagagagaaactaatgttttaaaatgtaattatcaagtaatcgtttggtatcaagtatttgcctttaacaaatttaattttattcaacatttcattaccttgatctcaggaactggagagcagagtgaaaggcatgcacattaagatattggagacaggaattgggatcacagcttttttttttttaaatcaatgaataacatgccacagatcctgctttcaaagagcttaaagccttctgtgtccagaattggtgggttcttggtctcactgacttcaagaatgaagccgcggaccctcgcggtgagtgttacagctcttaaggtggcgcgtctggagtttgttccttctgatgttgggatgtgttcggagtttcttccttctggtgggttcgtggtcttgctggctcaggagtgaagctgcagacctttgcagtgagcattacagctcttaaggtggcacgtctggagttgttcgttcctcccggtgggcttgtggtctcgctggcttcagcagtgaagctccagaccttcgcggtgagcgttatagctcataaaggcagagtggacccaaagagtgagcagcagcaagatttattgcaaagaactaaagaacaaagcttccacagtgtggaaggggacccgagcgtgttgccactgctggctcgggcagcctgcttttattctcttatccggccccacccacatcctgctgattggtagagcctggtggtctgttttgacagggcactgattggtgcgtttataatccctgagctagacacaaaggttctccacatccccaccagattagctagatacagagtgtcaacacaaaggttctccaagtccccaccagagtagctagatacagagtgtcgattggtgcattcacaaaccctgagctagacacagggtgctgattggtgtatttacaatccctgagctagacataaaggttctccatgtcctcaccagactcaggagcccagctggcttcacccagtggatcccgcaccggggctgcaggtggagctgcctgccagtcccgcgccgtgcgcccgcactcctcagcccttgggtggtcgatgggactgggcaccgtggagcagggggcggcgcacatcagggaggctctggccccacaggagcccagggagggggtgggaggctcaggcatggcgggctgcaggtcccgagccctgcccggcgggaaggcagctaaggctgggcgagaaatcgagcgcagtgctggtgggctggcactgctgggtaacccagtacaccctctgcagctgctggccagggtgctaagtccctcattgcccggggccggcagggccagccggctgctccgagtgcggggcctgccaagcccacgcccacccggaactccagctggcccgcaagcgcagctagcagccctggttcccgctggcgcctctccctccacacctccgtggaagctgagggagctggctctggccttggccagcccagaaaggggctcccacagtgcaggggtgggctgatcaggtccctcaagtgctgccaaagtgggagcgccaagagcgagcgagggctgtgaggactgccagcacgctgtcacctctcacttcttcaggaggactgcaagtattcaggcaattgactacattttgataatgctaagctcaaggcgcaggggcctatgcatataggatgggcatgtaacctagttttaggtatcattgcagattttccaatggaaatgatagctaagtgaaacctcaagtctgagtggtagtgagttagctgaaaagtgagattgatgatggacacagctctaatgtcagtgaaaacatcttattgcaaaagcctggaggtgagagacagtgagaactctggaaaactgcagatttgtagtatgaggggctgcagttagaaagggagctagagagaaaattaggatccagatatgtatgggctggaatgtgatgtaacttattttgaaggctattcttgtggtttggggagcctctgaataatttcatgcagaagagttaacatgacagaattgtggcattagaaaactcattttggtttgttgtgtggaaagtaaattggagcatggcaaaacttgaagttggtagacaaattaggatcctcttctaatccaggatagaaacggtagacccctaaaataaagtattgtatgcaacaaagtagatggtgttgagaaagatagtggaagtggaatccatgggattatgtgatctgttcaatgtcaggtgtgaagtggagggaaggatcattgatgattattttactgcatttggttgtaatacctattaacacaccagtttcagaagaaatttatttaatgtcctttagttctaattgttcgttaagaggaaatagtaatacccgtttacaccacagaacagagtatggccgtgtatttgaatgagttttgtaaattaggcagtgtagatttaaagtagtaattgtttttatcacctaattggccagactttaaaaactgtactcttgctttagcagaaggaggcaaataactaagaaagctagtgtgaaggaaatcatttaaaaaagaccctaaaaacaaaaaccaaaaaattggagacaagctgtgtctcagcaattagaaagtataacattaaacattagtgtatttgtccctgctaaaccaagaataatcagttttcctgatgaagcctcaaaggttttatattttggaaaaaaagactcaattatttttactatgctgtttttacaatgatagaaaagtgtactaaattttagaaagcttttttttttctttgagacgaagagtgtcgctcagtcacccaggctggagtgcagtggcgcgatcttggctcactgaaaagcaccaccttccggtttcaagtgattcttgtgcctcagcctctcaagtagctgagtttacaggtgtgggctgccacacctggctaacttttgtgtttttagtagagatagggttttgccatgttgcccaggcttgtctggaactcctggtctcaagtgatccaccttcacgacctcccaaagtgctggaattgcaggcatgagccactgtgcccggccgaaagatttggaagtatattaaaacagaaagaatcttctgcctgactttgagttaactggattatgtggaagctagaaagccattcctgagcccaggattgtttaaaagtttctgctttactttatatatgaatgcagaatagtttgaggacagcttttagggtacagatataactcttacctgtagtgtcttgaaacaaattattatttttttttaataaacagtcactgattcccttctagaaccagctgtaaactcctaagtggctttcatatgaatgggtagcaggattctcatccacagaatagaaaattaaggattggtaagtaggcagtagcaagtgagaaggatgtctgaatcatgaatggtggtcggcgttgacactaataccactatcaaaatgtatgggtgtttagcatctgggaagaatgattcgaatgtgcctgtctttgttgtagtgttttctgcgcttccttgtgttttgccctgttcaccagcaataccgagttcgtagatcgtctgatccagtgcattataagagaggaagtacatgttttttccagtattgtagcgccagggttagttctatgttatctaggttcagaagatgagtaatgacacaggatataacaagtaaggccaggcagggaaggtaccaacatggtagtttggggtggcgggctgcccattttctcataattactaaccttaattgagtacctactgtgggccaggtgctgttctaatgtgtttcagccttgactaatttcatcttcttaataaccctatgagatagatactgttattatgtccattttacagatgaggaaaccgaataccagagaggcactctagtaactcagtcacagtcacagaagcagtattggagcccaagccttctggcatagcgcctgtgttctttttttctttgagacgaagtcttgctctgtcgcccatactggagtgcagtggcactatcttggctcactgcaacctccgcctcctgagtagctgggattgcaggcatgcgccaccacgcccggctaatttttttgttttttttttggtagagacggggtttcaccatattggccaggctggtcttgaattcctgacctcaggtgatccgcctgcctctgcctcccaaagtgctgggattacaggcaggagccgttgtgcccagcccacacctgagctcttaactgcaaggcttggttaccccacaggccatgttctaggtattaacaaataaatgacatttgcagaaaaggcaccagatttttgttaactcttttcacgttttttctggttagtttttactaccatttagttagtttttgtagcatcatccaccactcccatcatattcacagttaaatagtactttttactgttactattcttgggttgggtgatagagcccacttaatgtgagttgttttgtaatagaggaataagaggaataaaagaaatgggtactggtttgcttggtttctttcccttttctccgtttcttaagctactcttttggcattgtattcttagtactttcctgtaactctttccccatcggtgctcaaaagagttaaatagcttcagaacctgagtgtgccttccctcaggacaagctgggattacagaaagaatggaccaccaggtagtttatcacttagaagaatagaataaaatgatatcattggactcttttttccctacctcctgattggaaaccatcaggaataccatcatctgagcattgttgctgacacatttttaatttttttgtgtactttttgttttctcaattgtattacttgtgatatgaaaataaaactattctaaagacttcaaatgaaaaatttttaagggaaaatgaatagcatcaaatttgttttaacaattctgctgaaatttttatatttgactttttcttttttttttccagacagggtcttgctctttcacccaggctggagtgcagtggtgccatctcggctcactgcaacttctgcctcccgggttcaatcaattcccctgcctcagcccccggagtagctgggattaaaggcgcatgccaccacgcccagctgatttttgtatttttagtaaatatgggatttcaccatgtcggccaggctggtctcgaactcctgacctcagatgatccgcctgcctcagcctcccagagtgctgggattacaggcgtgagccaccatgcctggcatatttgacttttcttccactttggggaggattattatgtaatgtgtcagaaattttcttttaataaattataggatattattgaacattatgttaacagagtttattgttctaagccctttcatattttcatgtattgtgtgtcatgtaatcatagatgtgagagctgtcttaagaatattttaaagagtgttaagaataatcagctccactttttcttcaaatattgccaagctgtatttgtgaagagataatgttgttttgtttaaaatatatttattttatataaataaagaacaaaggctgggcgcggtggctcactcctgtaatcctagcactttgggaggctgaggtgggaggatcacttgaggtcaggagttcgaaaccagcctgccaagatggtgaaaccccatctctactaaaaatacaaaaaaaattagtcatacgtggtggtgtgtgcctataatcccagctacttgggaggctgaggcaggagaatcgtttgaacctgggaggtggaggttgcaatgagcggggatcgctccattgcactccagcctgggtaacacagtgagactctttctcaaaaaaaaaaaaaaaaaagcacaaagtatatttagtaaaataaagtttaaccttttacatttttatgaaataaagtttgatatctatacattgaaatgagctgctttcttttgttttgtattataacttaaacttgtggcttttcaatttgaaaacttattgccatgtagaatttgattttttttttttcctaatgcaacactttacttaaaaattatggagtagaactatattttttagaagagcaggttttacaaaacctaaaattcaaactctggaagttgcatgatgtggtggaagaagtgctggactgagaatcccaaaaatattgggcttggttttgcccaatgccaacagtatttcactgagtgcaccttgttttaaactgaagcaaaactgaagtgtaaaaagtaaagtagaggttcctcttcaaagactttcctccccatctaattaggaataaatagtaacttctcttagaagcaaaatttattctaagacctgtgctaacattcttaaatatctgctagctgtaataaagaaatcaatgtactttatgttctcagctcccacaatttagcctaaatatttgccctggcatgcttatactggtccaagcaagcattaagtcatagcctgttcctcttccttatttgaaggtgtttttacctttctcagtattccacaagttacttcctccttcctttgttctcctctgccgttgcctcttttaaaaagttctatgttgttagccaattgggacaaatacaaaatgtgaggtcctgttccagccaatggaaaccggacacagcagtagggtgggcgcctcaggttataaatgaccctgtctcctttgttcaatgtactctcgtggcaaaactgctggcgaatgtaccctttctgcagaaagtaaacatggccttgctgaggaaattaaatttatgttccagtgctgtttctttacggcactggggaacaagcatttctaacagaagcctgtctggttctgagtccctgccctgaacccctgcctttggatgtcagttaactcacttataaaaccgctgctctggagatgaatagttctgttggcatttgtgagattgtgtcttatcctaacagactaatttttatggaagctgatgcggatagttgtttattcatggaagaaataatgtgttgattgcgttaatttgctaaactctggggatttagtagagagtaagacagctagttgttgccctcatgaaggttaagtgtgaaaagggctgcataattgcagggcgtggtgtatgtgttcatgtggcaatgatacctagccaggtgtgggaggactggaaaggcactctaaagaaagtggcaggctgggcgcggtggctcatgcctgtaatcccagcactttgggaagccgaggtgggcggatcacctgaggtcaggagttagagatcagcctggccaaaaatggtgaaaccctgtctctacttagaatacaaaaattagccgggtgtggtggtgtttgcctgtagtcccagctactcaggaggctaaggcaagagaactacttgaacccaggaggcaaaggttgcagtgagccgaggtcgtgccactgcactccagcctgagtgacagactcccatctcaaaaaaaaaaaaaaagaaagaacgtggcattagctgaaactggaagcatgccaccctggactctgggaggaaatggtcattttcctgtcacccagactactgcctcccagcctgactcttcagatccctcttgcctctcaaagtgttcatttgtttgttcattcattcatttattcttccaacaactgttggttgaataacaactgtgccaggcgtgtgctcgggatttgaaatacctaacttgaaccagctggacaagggtttctgtccttatggagcttacattttaatgggctagggaggtgcagagggtggacagtgcacatcataagtaagcagatgctatgccagaattctccagcctgcaaccagagctagcccttcatttccttgctctgaggctacagttcagtttctctcatgtggctgtgaggcccagccttcccctcgcctctctcttcaggtcccagacactgtttttcactacgcttctatttctaaggtgtcttttcagttaccacgcctgagaaagttttcaggaatctatttttggattagagatcccctgttgtcacatgccctctttaaaacttgtacataacatgcaccacataatcattccttagctgctgtgtggctgtatttaaggtttgtcttttccaccagcctgtaaattacctgttggccaagatgatgtctttcttgttccgtcccgtgtcttcagggcccagaattgggcctattgtaataaaagctggtttggtaaaaggggagagagttactggctgaggctggctgaactgagaaggctgtgcaaggctggggagcctgcctgggccttgggctgcagggtaagatgcaagatgaacaggggtggggctgagactcatgcttaggcggacaggatcaagtattgaaaccagcctagggagttcaaacttggttttgaggcaatgggatgtcatgaaaagcttaagtgattttggggactcctagtttgttttgataacatttaatattctcaaaatcattaataatttgataacttcaggcatggctgatttaatttttaaactatgaaaatatgaagtatgaaattatgattcttatggtaaaaaagttcaacgtgtacctaagagcatacaattttaatttcccttttcctacaacttttaatcctaccttttacatttatttatttatttattcttaaatatagacaaggtcttgcgatgttgcttaagtcagtacagaactcctgggctcaagtggtcttcctgcctgggcctcctgagtagctgggattataggcctgagttaccatgcccggctgtctgtcctacttttgagcagtaaattggtttctgtagctgtctaatgcttaaactttcctgtgcgttcaaatgtgtatttctgtcttaatgtaggtaaggtcatacgctatgtactccaacttgctacccccgcccccagtatatactttattttgcttatttttacagtgtaagagttactctcttaaagcttaattgtcatttgtcattgccttgtatagaaccaaggcatcttggactgtgtaccaaatcccataagatctggccagaacagggccacgccgtccatacctccttatcttgtgctttgctgccacttccttactgtgtttcagctttagctgcctgatattctttccctattaaattgcttcctcatctaggatttttatatgtgtggttccctctgtctaatgttctttctccctgatctttccatggtagctagctgtttatgtttatgtgtgtgtgtgtatgcgtgtgtgtgtgtgtgtgtgtgtgtgtgtgtgtgtgtgtgtggttttagagacggagtctcactttatttcccaggcaggagtgcagtggcgccatcatggctcactgcagctctgacctcctgggctcatgcaatcctcctgcctcagcctcccaagtagctgggactacaggtcccaccaccacacccagtaatttttgtatttttttgtagagatagagatcttgccatgttgcccaggctagtctcaaactcctaccctcaagtgatcctcccatcttggcctcccaaagtgctgggattacaggtgtgagccactgtgcttggcctggctagatgtctttatccttaggtttaaaattttactccagaagggccctttctgagcagcctgtctgaaacaagttctccctagtattcttgcctgagtactctgtttctatgtaacatttattttagttatcaattgatttgtttattttctgtttctctcattagtttgtaataagctccatgaaggcagaagatgtatttcatgtagtgttgctgggcagatagttattgaattaatgtataagtggttgaataagaacatatagatcaactgcattctttttaaaggctaatatttcattttatggatgtaccagtcctttgttgaaggcttactaaattgtttttcagaatttttttcttattaaaacaccaccaacgaattcaaaataatgaatttctttgtatgtctctctgtgttcactcatgtgggtatatctgtaggatgacttcccaggagtaaaatttcagaacaaaagataacgtgtcctcaaacttttggtagatactgacaatttctttttaaaaagattatcccattttctatgacaccagtaatatgagaagtatttaactttgtcatcctggccattatcagattttaatttgctagaggaaaagtgagatctcattgttttaatttgtatttctgtaattaggagcaaggctgagcacagatattgtgcttctggaactgtttttctgtgagcttttaatttaatcttttgtgatgattgttggtcctttttttagttgattcagagtttgattaaagttttttaaacttatgatgttataggcaacctttacagtgtgatgtcacttagtgccattgaatttggagctatatagggctttttatctcttcaaaagtaattttgtagagcctgataataaaacttcatgttctcaaagaccatattggggctgagtgtataatatttagtagtttattattgaaacagtaatagagattttaatgtccagtgcataataggtcctcagtaaagtatttttggatgaatgagtgacaagtgaaaagttaatttttaaggcagcttgattttatttgaaagttcatttagaagaatctaattttcatagtaagaagacttagcatgctgttaagttgaaagataagcttgctttgtggcatgctatagaagtgttggatttgtggcagtggaatttttaatttgctgtgtcagatatagatatggctttatgtatccatacacacccagctataacatgtatattcaaataagtgacaaaatatgtctaatgaatttttgaattaccttttaaaacttgcctgttagttctctcaagtgatgaactttttacaatagcagtttattttctctcatcacgttggaaagaaatgttaaaagttttcttctaggtttattataatccagtcttcatcagccatcactcttcctgtattttgttcaagaggcactaattgttcgcatttggcaggtttaacacttcctgacagagaggctattaaggggaagtattctccaataactgtcactggctggaacaaagaaccttccaactcaatgtgtggaaaccactaacattcttaaatgacccttttcatggattttcatccctttaagctaaagtttggagaatgtagggtcagcgaaaacagcaacgtgtaataaagcagtaaaccttgattttggaaggcatagggtgggagatatagatttatctctgacttgaaaacaattgttatttggaaaatctcattagcagatgtgactgcttggagtaaaaaaaaaaaaaacaacttaaaactgatgtcgctttcaggacccctttgaacttaacaagcacctatttgtggagcagactggctaatgaaaggaaattaaatttttctgacaacttcccctgccaacctccttattcaggggatgttattaggtactgaagaactttaaggaagattttttttattagacataagtgaaccagttataaacatccccccccgcccccttctcggaggattctgacatggttgctctacattttaaacgtattagcttaaaagcttaaaaaacactgggcttcacttcagcattttagtcattttctaaaaattcagtcacacttaccagctgtggtttcaaaacaatattgtcagtctttgtggtagtttagtttgtgtcactgaattacacaaacacacacacacacacacacaccccacacatacccacacacacgaaggaggcttagatttcaacattatctttattgttatttggggaaatgattcagcagtgtcctgtgttggatgtgttaggtgagggttaatgatcagtgaaattacttagattcaagggaagtttttgtcttttcatcttcttagaggtagaagtggcattggttaatatttagcaataactaatccttaaatggataaacttttaccccttactgtttaggaaggtattttctttcttttgctttttggagttttttcctccagtagttggttcgttgaaattaaagtttttttttaatttatgtaacaagatacaattgtagagataaaatatgtacctgaaaaaaaaaaaaaagaaagaaacaatagaaaagaaaaggtaatgcagattaccaaaaggattttttggaacaattcgtaattcctgtaggtactggaaattaacttttatatttctgcaaaatcgatcaactactcccaaacaatagagaatcaactccccctgctgacagaatctaggaaaacatgacacataatattggacagaaacaagctggctgcggacaagctttaatgacctgatttatgattcagtattgattgtaaacatctaaattctgccattaaattccggcaactgcaccaaatcattggcaattctggtagtgcttcctgccagctcatttcaactgctttgagtttcttaatataataatgatgaggtagaatttacattccacttatggtattaattttacatttctctgaatgaaaagggttagaaggtagtaaaattgaacattaaatgaatcggaggagacagtagtgcaatatatgactgccctaaagacattgtgcaatgcctcatgggattaatgttgagtctcatttcctgcttttacaggatgcagaagaagctgtcagaattgcaagggaaattggtaagtccttaaattaactttggtaggatttctgtgtctttcagcagatacggttgagtcaacaggtaataagtaattcccatagagcaaataatactttaatagttttagattttgattacttgttgctctggaagaatgtatcagttgaattgccaaattctattattaaaggagactgtaaagagtaatttgaccttaactatacataactcttttgtaagatgagatcacaggctaattcaaagaaggaattgtcttaagaattctaaagattggatataagtttaatgtcaatttatatgtacatagttgaatgtggtttgttaaaattaagaacatttggattaaaatgaagataccatatgtgacatagttctttaagtttttgccttttgctaagatgttaggtatcaacttaatcttgttagatgggaaagataaaatagatgtgggaaattagaactgaatgatctaaattggaataaaaggtagactggaggagtttttaatggctgttttacatgtacttgtatttgggcagtgtttcccaactttttaatttcttttctttttcttttctttccttttttttttttaagatggagttttgctgtcattgcccaggctggagtgcaatggcacgatctccgctcactgcaacctctgccttccaggttcaagcgattctcctgcctcagcctccctagtagctgggattacaggtgcctgccatcacgcccagctaattttttgtatttttagtagagatggagtttcactatgttggccaggctggtctcgaactcctgacctcaggtgatccacccgcctcagcctcccaaagtgctgggattacaggcgtgagccaccgcccctggctcgcaactttttaattttaaaaatattcttggcggtcatgagaactatttttggtatctgctaattgagaaaatgtgtaagggcatgctattatatggattaacaatattgttaaataactttgcaggtttaataatcaaatcagtaattgtatacatttgacagaaatttgtacagatgagagaaattaggcaatgcttgtagggatcccagcgtcttctcagcattcctgtacgcctcagtccaagcatctcatcgtgccacacgaacatttctgtaggcctgttttctcactaagattatttagatctattttctgcctctagagagcatttgatttggcaaagctcatatagttgtgatatgtagaaatatcttattggtctggaagtgatcacttgtactagtaagcgtgttctttgcaaatgggacagtctaacttagcaggtctttagtgacctgaaaagcagtttggcttattgcacccttgtttgtagttggtactgtctaaattatttgggctttgcccatcattaagtgtgttttgttgtttgctttgcaaaaatctatcttattgatataggtcctggatttaagaccagaccatagaaaatcttattttatctgactacctcatctcttcattttttttttcagaatcattaacatttcaaaaagcctatcagtacttcataggaacatttgctcgactgctaaataaactggactatatagaactgattctgtggtttctttatggagaaaaatcaaaagtttctgttcatggtttgaaatcactggtattcctcattgcctaagaggcatataatatacctactggcttttgaggatagttttctaaaatagtttaattccatcctgtcagacatctttacatttaaaaagctctttttctagttctaggttagatattattatcaacctcattggatataataatactgttattattattattacagtatctacataaaggacaatatttagagaaatttagggaaataaagggattagaagaaaatttacagttacactgcagtgccacattttgaatggtgaattttggacttgcgagcattccctttgtgtaaatagcaggccgtg

SEQ ID NO: 14712 - DNA, 64190 bp, Human
gtcaatactaaaatacaaaaaatcagctgggcgtggtggcatgcgcctgtagtcccagttactggggaggctgagacaggagaattgcttgaacccggagaccaaggttgcagtgagctgagatctcgccattgcactccagcctgggcgacagagcaagactccatttctaaaaaaaaaaaaaaaaaaaaaaaagagaatatgaattgatgaagagtgaacagtaggtattccagatgaggggaatagggaataatactcacaaaactgtagaagagtcaacatgttacatgagaatattggcttgattagtactcagttccatcatggattagtagtggaaactattggatgagtagtagaatgagggtaatttagggaagcagtacttttctctcgaagacaacaaattacaaagatttttgagccgaagtgagcctttcaagagaatacttacttcacagtttctagttacccacacacagtgtagagagaaaagaaaatgaggaatatgggcaggctttattcttagcagcaaaaggcaaccgtgccacctccaggtgttttgtttgaaatacacctgccacctttctactagattacttcattccttgctcacaaaacgtctcatgcactctactgcttaaagagtaaagtccaaactcctcagccttacactcgagattctccgaaattcttccctgacacacctctccaaagaagcttactttaaggaaactcatactctggctaaatggtctttaaattctcaagaagtcactgtgtcttccatctaccttccctcacatctaccttccctcgctgatgtgttctttattcttggaatcccttagttcttgtttactcctgtaagtactacctaggttgtaaggtctagtgcaaaccctatatcctctacgaagagttttcataccaccgtagaccatattgacttcatttcttaattgctttttgtgaactatgcttggacaagttgcttcaactcttttttttttttttttgagacgcagtctcgctctgtcgcccagactggagtgcagtggtatgatctcggctcactgcaagctccgcctcccaggttcacgccattctcctgcctcagcctcccaagtagctggaactacaggcgcccaccgccacgtccggctaatttttttttttttttttttttgtatttttagtagagacagggtttcaccatgttagccaggatggtctcgatctcctgacctcgtgatctgcccgccctggcctcccaaagtgctggcattacaggcgtgagccaccgcgccgggcccagaaggctaattcttactgtctctaacacaggtccggtacataacacttattttggcggaagttactgggtttttttaaggagttatgtatctctcaagcagaaacctgctagttcataaattcttagcatccccaaccactcttggcacgctgccttgtatattattaggctcaacagcagttagtaatgatgaacactccttaattcgaaagcgttcactgaatctaccccaacgatagcttctcattagcttctccactccagctgctattggccaagccctggatgcccgaagcacacaggtttagggcttctggccctgacacgtaatagggaaaggggattgtttcaatccaaatgattatctataaagtcactcacaatgtaagtaataatatgcgaaattttaatttgtgatgactaaaagcactaaagtggtgactctttgggtagaacgtaaaaacgaacggtccttaacggccacaaggcgccccttctaggagtggtacctcccaggataacggaaaacagccccagccccatcaggagcgagcttgggggcgggctttaatctcccggcccactgtttggctatctgcaggggctggcctccaatgattggtcgctgccgcgagggccgccgggactcgcactcggcggttgttccagaagaaagagacagcgatggcggcagaggcttcgaagactgggccttctaggtcttcctaccagcgaatggggaggaagagtcagccctggggtgccgctgaaatccagtgcaccaggtgtggaaggagggtatccagatcatccggtgaggagcccaagggcccacctagcggggaggcagcctggagggagcgctgggggccaggtgagctggtgggcgcgtgaggcttggtcagctgcatccaatcctggtgtcaccggaaactgcgtcacaggcctcccgcgagctgcacccgacctctaagagggcagtgcttgggttggttaagggcagcacctgcgcctgtcacggctttctccaattacccatccaggcctcaccgaccctccagccgggaggatgggggcccgggtggctttaatctactcctcacaaggcaggttagcgggtgcatgcaaaagtagacataaaatgtagcccattgttttgtcatcaagaaggaacgaaacttgattttctcctgtagtttttgttgtaggagtaacaagtagaccattgtgaaatggttttggattttgttgttgttgttagcattttgttgtttctgtgggggtttttttgtttgttttttacattatggctcacactggcctaaaacactgtttggaaaatgatagtttcttttgtgcaccttgtggggtgtgtgtgtgtgtgtgtgtgtgtgtgtgtgtgtgttggtctttatacgtgaggggaaaaatacactgcactattattggtctgttcacctacaatctactcaagtgatcacaggttcaagttatttattattatttttttctttgagttggagtctcgctctgtagcccaggctggagtgcagtggcgcgatctcggctcactgcaagctccgcctcccaggttcacgccattctcctgtctcagcctctggagtagctgggactacaggcgcccgccaccacgcccggctaattttttgtatatttagtagagacagggtttcaccgtgttagccaggatggtctcgatctcctgacctcgtgatccgcccgtcttggcctcccaaagtgctgggattacaggcgtgagccaccgcgcccggccggttcaagttattttaatgtaacttaaaataccttagtgtgctcttaatacagctgagttgttgaatctcaattcctggagctactgaaaattcgtattacctggcgtaactgtttaatgtttatactttcaaagttaaggtcattcgatcagttttctcagtcttggcaagatggactctgtgagatgtgagcctctgcagaaaaagttgtgatttcagtggagaaccaagtttctcctacttggggtttagatcactgctaccgttacgtagaaaatttccatttttgaatgaaattaaaattacggaataaagttctagaacacaaccttttaaaatgagtacttcttccatacattagtattataatgcttagaaaaactaaactggagaagtagtggttatgtatatagaatcctgaaagtgctttttaagctgtaattcaccacaagttattttgagttattcagtatcagaaattttataatagttaagtgtttttatttctttggcaatattatccctggaagttaaatagggttttaaaatttagcatggttgtaagcaagtttcaggtatttcagttggataggaaacttgtaaagtttttaaaaaatacaattaatgcaaggccgggcacagtggctcacgcctatagtcccagcactttgggaggccgaggtgggcggatcacttgaggtcgggagatcaagaccagcctaggcaacatggtgaaatcccatctctactaaaaatacaaaaaaattagctaggcgtgctgacgcacacctgtaatctcagctactccggaggccgaggcaggagaatagcatgaactcaggaggcagagttggcagtgaaccgagatcgtggtccgtctcagaatgagtgaatgaatggatgaataaataaataaataaaattaatgcgattataattcagcaagaactctataattattttgctagtaaaagatgactgatttttatctagtttttttcccttttcagttttcttgcaaaactttaaaaatgacaaccttttgaaattatatagctaaaacaaatgttatttattataaacttcaaattcttagagcatttaatcatgatgttaggttttcaatcaagttacgatatttcctttcataaatgctaagtttgtgaaaatgtgagttgtagatatgtgataatagtagcatctggcttctggccttgccagtgtcttaaataattctaacagcacggtcttgccagtgtctcattttggcccttcctgacctcttcacaggatgggaaatataaagtagtagagggcagtatgatcaatcagaaagaatgttagacttggaaacagagctagataggagtctggattataccatttagttaaccaaatctccaaaatgctatttcatctccagcccacttaactgtgatatttacaaataacaaataaaatgtgtcagagcactttgtgtaagatatggcagattcaaagtattctaggtacaaaatagccatctgaattaatgcaaatgctattacatagctcttcttggtttttcttcttgatttttctccctcctgacctgaatagttggttactcctgatttatattcaataagtcaaccatttcaaactgtagtaggtatcttttcctgtacagtaggatcctctttgaatttcccttgtatcagtattgcccattcaacattaacacactgtgggcagtttaatcacaatagaatttcttcagtaaaattagccgggtgtgttgggacacacctatagtcccagctacttgggaggctgaggtaggaggatcacttgagcccaagaggtggaggctgcagtgagctggtgccactacactccagcttgggcaacagagcaagaccctgtctcaataatcatcatcatcatcaaaataataattaagaatttcatcaataggtcaccattgtgaacttcaatgtggacatgctttttgtgaactatgcttgttaatgactgaagaatgcaccacaattatatgccctgattgtgaggtaagtgttataatttttcagatgaaacatatcacaacctaatgttaatggtaaaaatactacagtagtaaaacgtacttctagttagaaactaaaaagttggccgggcgtggtggctgacgcctgtaatcccagcacttttggaggctgaggcgggcagatcacgagatcaagagatcaagaccaccttggccaacatggggaaaccccgtctctactaaaaatacaaaaatttgctggacctagtggtgcacacctgtagtcccagctgctcggtagcctgaagcaggagaatcgcttgaacctgggaggtggaggctgcagtgagccaagattgcaccactgcactccagtctggcgacagagcaagactccatctcaaaaaaaaaaaaaaaaccctaaaatcttgcatttttgctgctgaatctttaagcaaagaaacctaacaaaagataaaactttttctatccattttataattgtgtaaagtgatcaggaaaaataaaaggcgctaaagtcatacacttatcggcctacatattttgattctttggtgacttctgtggaaaattatgtcttttgtttattttaatggtgtatattcctttaaaaaccctagcccctgttttacccaccaatccatgcaaccacattttgaactccccccctgcccctcaacctttgtgtgtcatcaaatgtacatttgggagatgccattctacaacaaggtagagaagcaaaactactgcctaaaatttttacttcagaagccattaagactgaaatctttccataagaatgagaacaaattaaggatgtaaaataaaatttacttgatatcctattcatttaatacaaatataagtgtagttcagcttatataatattgttcctggaaagttgactcaagctgtaaattcctttttttttttttttgagacggagtctcactctgtcccccaggctggagtgcagtgactcaatctcagctcactgcaacctccgcctcccaggtccaagtgattttcctgcctcagcctcccaagtagctgggactgtaggtctgtgccaccacgcccgactaattttttgtatttttaatagagagggggtttcaccgtattagccaggatggtctcgatctcctcacctcgtgatccgcccacctcggcctcccaaagtgctgggattacaggcatgagccaccgcgcctggccaagctgtaaattcttgatgttttactggataaatcagatgataaggctttgtatcatttgttttctgtggaagtgtggcaaaccctatggaggcatgagatctagaatgcagttctcattctgtcagtctagcctgggtttcctcatttgtgagatggatataatacctgctttgtcttatctcctaggattgctaagaatcaaatctgaattatgtaacagttctccgtaagcttccagactactaaaataacccttcattatttaggtttgaatgaactgccttgcaagttaaatatggttaaaaaaaacccaaaccatatattgtaattaatgaaagtttaaattataacaaaaaattacatattagtagctgcctattttgtgggaaattcctaacctcttccctttttttttttttttttgatatggagctccttagacgtggctggctatgtgggtaagacgaagtgagccctcctcatgtggttgtggtagtagatccctgatggattcagtcttgtgggtgaagattaagtgaagggaaaggaaaggagcaggcagctggaactgtctgtgtccatatccgtcctgttctaatattaaaaaaaaaaaagacttggcaaatgatttcacatttaatgttcttaaatcattatacttgtactatttttgggattttggataatgtgtaggagtgtttataatgtgtttacaaatactaattttgattttaaggttgtgataaatctattttgtatcattgactagttttgctctaacttttagagataagtgacctgtcccatcctccgttcctattcccccatccccacacccacctactgttagccgaggtaattgacaagtgactatattcacattcttcagacgcactggtgagctgggccctattaaaggaagtcattcaagaaaccttcctgaaattgttatcactctttttaaactttagatttgtattattacctaatatttatttggaataagatatacagagaatggaagaatctagtttaaatttagtgaagtctgaatttatggaatatttgaggaatgtagtttattacatttcaacaaggtatctactctaaaaagtaagatttagattcctgtattcacgttagacttataatttatctttaacttcagaggcctaggtaatgctgtttacttcaaatgtaagcctaaaatccattcaagattaataggtatccttttgttcttatttctgagtttgggtgaatgtgcatttatttgacagtctttatttttgatagttgaatggtttttgataacatccctgctctgctattgattgatgttaatggttaatctttctgtaattttgcacagcaaaatgacagattttattcaacgataggattatacctaggtgctatattagaaatactggcattttattaacttttggacctgagtctaaaatacattgggccatgaagaaaggataaatcatccaatcaatagataattcatatatactaaaatcccatgattggaaatattaatatataaaaattagaaatgtaaactagacagaaatacagataattgtataatcttggataggaaagcattgataagcatatcaaatagaaatcagaaactacagaataaatgcttgttaaatttgaccacagtttttcatttacaagcaacaaaagcaggcaaaacaccatcataaataaaatttaaatgacaagctatagggggtaaaagaaaacctttattatatatgttacaagttaagagtctttctgcagtttttacttaaaatcttttaaattagttgtatttaatactttcttaaactatctggaagaaatgtcctgcatcaaatctgctgataatagcattaacctcttatgaaatgctaagccaaagtgtgatgaactaggaggtatatagaaataaagtttttaaaccccaattttggggaaaagggacttaaaataccattcagctcagtgagatttgttaaaagtaacctaactaaactaataatacatggctacaagtacatggttttaagtacataatacttgaaaccttgaaagaacattctcttccccaccaaagatgtatatttcacaaaaatgggagactataacaattagtaatctgctttgtttcttttagcaaccttcatctattctcatgaaaataagcactataattttcttaactaatttctttattgataaacatttagttttaaaatttttttcactataattgtgtacaattcctcaacctcacctccatcagtaggttctgtaatttctaactccaaaagaaattcatattttgagcttgttatatttgttttagtgttttggcaatttgatgtaaaaaatggctgtttccttgttgtaaattgtaattccctcatgatcagtgaagttgagcaacttttcatatgtttgacttatcagtgcctcttctgtgtggatctttaacagctcttttcagatcctttggatcttttccttttgaattgtctttttcctaacttgttgtttgttgttgtttgctttttctggagacagggtcttgctctgttcccccagactggagtgcagtgatgtgatcacagctcactgcaacctcagcctctccagctgaagcaatcctcctacctcatccagtccagtagtagctgggactaaaggggagtaccactgcacacagataatcttttttttttttttttttttttttttttgaaagaggtgaatccttgctatgtggctaggctaggtccttgctatgttgcccaggctggtcacgccttagccttccaaagtgctgagattacaggtgttagccactgtatccagcctgtcttttttcctaagttgtaagagtactttatgtgatagcaatattaacatttcatcctgtgtaactgttttctcccagcctctcacttttgattttattgcatttagccattcagaagtgtttcttaactagtcatttttacccctgcttcatgaattctaggtagggcttttttttttttttctgactaggcagaccttcctaactcaaagttatatatatatatcttcaatacttacgtttttttaaagaagtatatgttggctgagctcacgcctgtaatcccagcactttgggaggctgaggtgggtggatcacatgaggtcgggagtcgagaccagtctgaccaacatggagaaacccaatctctactaaaaataccaaattagccaggcatggtggcgcatgcctgtaatcccagatactcgggaggctgaggcagaagaatcacttgaacccaggaggcggaggttgcagtgagccgagatcgcactattgcactccagcctgggcaacaagagcgaaactccatctgaagacaaaaaagtgggggcggtatatgtttaattattttatgtgttatgtgatgtaaggtgcaggtatacctttattcttaagaatgattggctgattttgtcataccttttattgagtaatccttccatttaattgaaatcccacttgtattctatattaagttctcatagagagttgggtctgtttcaaggctttgttctactgatttattatgctagcacatagtgttttaattattacagtagtgttataatagtcttattaattggtggaataaatttatgctgaattcgatgttaaagtttttgcagttcttatacaatatatttttccatacgtattttagaattgtattaatttcatattagatgatgttaggacattcagtctttctctccaggaacctggtttgagtctccatttttttttttttttttttttgttcttgttttatgacctctagccaggtgcgattttttaaaaagttttctttacttacagcttatagttttcttgttaaattttcctaaataacttcaatcagcaggaaaagaaacagataactccattaaaaagtgggcaaaggacatgaacagacacttctttttttttttttcttttgagacaagagtttcgctctgtcacccaggctagagtgcagtggcgccatctcagctcactgcaagctcctcctcccaggttcacgccattctcctgcctcagcctctcgagcagctgggactacaggcgtccaccaccacgcccagctaattttttgtatttttagtagagacggggtttcaccatgttaggcaggatggtcttgatctcctgacctcatgatccgcccgcctcagcctcccaaaagtgctgggattacaggcgtgagccaccgcccctggtcgtgaacagacacttcttaaaagacatacaaccagccaataaacatgaaaaaatgctcacatcacttaccagagaaatgcaaatcaaaacccacaatgagataccatctcacatcagaatgtctattattaaaaagtcaaaaactaacagatgttgtcaaggttgtggagaaaagagaatgcttatagactgttggtggaaatgcaaattaggccctgtggaaagcagtttggcgatttctgaaagaactaataatagaacaaccatttgactcagcacttccattactgggtatatacccaaaggaaaataaattattctgccaaaaagatacctgtactcatatggttatcacagtatcattcacaatagcaaatacatggaatcaacctatgcgtcccatcattggtgggttgaataaagaaaatgttgtacgtatacaccacagaatactatgcagccattaaaaagaatgaaataatgttgtttgcagcaacatggatgcagctgaaggccattatcctaagcaaattaatgcagaaacagaaaaccaagtaccacattttcacttcaagtgggagctaaacattggccacacgtggacataaacgtggaaacagtagacactggggactgctagagagaggaggggaggcaagggcagaagaactttctgttgggttctgtgctcactgtttgggtcatgggatcaacagaagcccagacctcagcatcatgccctacacccttgccacaaacctgtacacgtaccccttgaatctaaaattttaaagaaaaagataatttcagtttcacatcctggcttatcctttaattgactgagtgaagttagaggacatacttcagctttacttcagtttccttttctttcttttttgtattgtattgtgaggtttcaatgagatagtttgccaagtttgtaggacctaggcacccagagaatgatgttgcatttccttctgccttcttcatttttctttcaggtatcagttcatgatctgagtggcttttaaaatatgtggaaaaaaatcagagaccgcagggcctcaaataaatgaacataagaaaactgttctcagaaaaaagtcaaccatcaactatccaactttcttctatttctaactgcattttacttgaacactgtctcgagcagggatttttcttcatctagtgtctgtgggccacagtggactttaggaattctattgaaccacatgattttaaaaagttttaaattaaatattttagagttttgaacatatgttactattttttttttcactttttttgaaatagagtctggctctttcacccaggctggagtgcagtgatgcaatcttggctcactgcaacctccacgctctgcctcgccaggttcaagcaattctcctgcctcagcctccctagtagctgggattacaggcgcctgccaccatgcctggctaatttttgtatttttagtagagatggggttttgccatgttggccaggctggtgttgaactcctgacctcaggtgatccactcgccttggcctcccaaagtgctaggattacgggcgtgagccctcattcctggcctaacatttttaaagtaaaattgaaagtattgctagtatttcctttacagttatggtagaatgaagtgttttggttaattaactaaaaattaattaatagttgccaaattcgtgattgcttccaaaaattaaagtgggtcaaaaactcatataagcacggttttctccttgatttacaggggatttcaggatctttaaggttatcattaactttatgaatagcacacttaaatagttgtttaggttctggataggcataatttattgggtgactttgtttttttaaaccttattttgtcctaaggttgctacagctgtaaatactagacaacgctactacccaatggctggatatattaaggaagactccataatggaaaaactgcagcctaagacgtatgttccatgtgtacttatttgagtatttaaagtcaatgtgttactgaaatagttttagaattattgataaaatgtcatccttaagtctgcatttctaacctactgtttatggaatgctctttaagttcatacttcatcttagctgtcagtggaatggagacttcagctctttaaagaagcagcgtttgtttgtccttatttaaagaaagaaaaaatgttaaggattaccacatcaagaaaggctgagagtacactggctaaagttactcgtgctggatggaaggaagttatagagaaaaaaagtaacttagttctctcttgattctttttaaaaatttttaaaattctaagtttttttaaagacagggtctcactctgtcacccaggcttgagtgcagtggttttgatcatggctcactgccgcctcagactcctggtctcaagctagcctctcacctcagcctttggagtatctaggactacaggcatgcaccaccatgcacagctaatttttaaatttttttgtaggcatggagtctcattgtgttgcccaagctggtctcaaactcctggctttaagtgatccttctgcctcagcctctcaaagtgctggaattacagccgtgagccactgcacccagcttctcttgattcttaaaagtagtgcaagtatagtacaatggaagactttgtgaagagttggtttgagaagtgatttataaaaggaaaaataatacctttggggttcttttattcatttttccattgttgtataagactttatacatgtatgcattaatagattctctttttgaattagtaatatctttttaaatacacccagccagagatgagtatctatgttactgactatttcacttaattactaatgcttctgtatgtcttttcctgctagtctgtaagcccctttaagggaatggaccacattttattcccctttatatctctggtttgggacacagagtaaacatgtaatgtttattacagtacatgtttgatttttgcagctttttaagtgttaaaggatcttctgatcaatttcctggaactgtactcagatggtaatttgtatataactaaactttctaagcatatttaatatggtaagtagactatgcaagaaataaaaaataggattctttcaaggaaaaatctcatgtggaactttccaattttgttaatggcaccaagtatttataaatcactctagttccttctattacattcattttacctcctgcagattctgacttctatagtatctcctatgtccataacctatcttcatttctactgccttatttaattctcatgttattttgtgtagctccttgtcagactcttccttaatgctatagttgttcattaagtattcaattaaaactcaaaattattcagtgtagaattcctggcacttcacattaccaccgtagcttctctttgcagacctaaatgagtacttataaaaaaacaaaagaatggttttagccatttgcttgggtagtaaaaccacttagctaaagtctgacagctggttattcacagaaccagaatgtaaacctaggtttattgaataccagtactgctcccaactcctataccactggtcacttcctccatgagatatgtgtagagttattaggatagatcttttagaatcattctggctcatcgtgagtccccatggagtagccatttttatcaaatttagggctcccaaatttgaacacctacacgaattaagcagttaacttactgggtgaggtcgactgagtttaaacaatgagtggtgaggtttgcggtagatgacgagggctcaccccctccgaaggaggcagttcctactcagctgtagccagttattagtatgtattaagacaaacccaatgttgccacatcttttttttctcaagacaaactcgagatctgtacttgtgtgtgaaattttctgacacatgatgccagtcaaaccaggatgtactcttatctatatatgtataatgtctgttagagttgcaaagtgaaattttactttcagaggtatatgaatccatcctaaccagaaagtacccaaatttgttccaaataaccattttaaaaattaaatttatgtcaattatatctattttagaaactgctattctctaaggtacagtttggttttaaaatggttgtatatttttaaattatagtaatccttgactcatttactgatttgtctttaatattttgaaacaggaattcagtaatggaatcctcagggctaatgcactcatgtttttaagaacatgaatattcacttttcaaagaatagaatgtttaaaaattatttggtgtagtattttttctctgtaacatttaaacatcatattttccccataagctgtaagctgatgattaactcagcaaacactagttactgtgtgctagccaatatggtgatacaaagataaaaatagctgggcatgatggctcatgcctttaattccagcactttgggtggctgaggtgggaggatcacttgagtccaggagttcgagaccagcctgggcaacacagtgagaccccatctctaaaacagataataaataaaactctggcttctatagactagagaatgcaactaactttttctttgcaattaacttgcttagttaaattcattacctttttttaattctccagacttgttaagtaccttctttttaatagctggcatttgtatatataaacacttacttaattggtgagcttatcacatttcattgattatcaacatctgtaccaaaaaataccacgtaaggaccagtaattaagaaattaaaacacaatatataagccattatttttggaatttttttaaattaaaatttgtatgaaagcatatttcctcatggtttctctcttcccacttatggttaattgataattcactgtacatgttcttataagtcattatatgaattattttttatggtaaaatctgaatagaagattaaaaccattacattgattgatgaggtaatattggtatttaaaataatgtacgtgggccaggcacagtggctcacacctataatcccagcactttggggggccgaggtgggtagatcacttgagcttaggattttgagaccagcctggacagcattttgaaatctcatctctacaaaaaatacaaaaattagccgagtgtggtggcacatgcctatggtcccagctacttgggaggctgaggtgggatgatcgctggagcctgggaagtcgaggctgccatgagccatgatggtgccactgcactctggcctgggtgacagagaaagatcctgtcacaaaaaataaaataatatacttgatacttttcaggataaagaattgttctcaggactttaagaagactgctgatcagctaactactggtttagaacgttcagcctccacagacaagacacttttgaactcatcagctgtaatgttggtatgaaacatattggtcatgaagtacgatgaaggcaaacgtttgactttgtctctagtagctcaactttcttctcctataattatagattcttttggaagtttatacgtaacaagttaacccaccctcttacttgaatctcttttgttctatgcttagacagttctcttttcttccaaggcagcctgttctacctttgactgactctgtttcaaagttcttgatatttacctgtgtgtagcttcttccctttgaaactagttattgaatccaggttctgtgaaacatgtaaagcatgagtttttaaattttaaatgtgatttttcacttattttaatggcaaccaaaaggcctaattatgtttgttgttgttaatgttattgctgaagatagagttttaccttttatctactcctgataactttaaataatgtattaagattagaaatagaacaaactccaaaatgatattaagtttttgtgttaagatcattaatggaggccacgtgcagtggctcctgcctataatcccagcactttgggagaccaagacgggtagatcacttgaggccaggaattcaagaccagcctggccaacatggcgaaaccccatctctactaaaagtacaaaaattagctgggtgtggtgctgtggtcgtgcacacctgtaattccagttactcgcaaggctgaggcatgagaatctcttaaacctgggaggcagaagttgcagtgagcagagatagcatcactgcactccagcctgtgcaacagtgagactctgtctcaaaaaaaaaataaaaagaaaaaaaaatcattaatgggctggggaaggggagaaagcacttaatcttgctgacttttccttcaagtgtaaatcttaatggagtcaaattataatctttttttccttaagaactgtttataatttttatatgtatacatgtattgccatgataaattgttcaaggtagttttaagttgaaaaggtaattacagggcattatcccatttaaaaaaatatctttatgaaaaaaatctggaatggtctaactaaagctctaaaatatgaatggtttttatctccaggttagcaggattgaatgttatttttgttgcttgttttcacttttctgtagtgagtctatgttgcttttgtaaccaaaacggtagcctgaattttttgcaactataatatatatatgtctaggcatctgttttttagttttatatttgtatgtgatttccctcccttcttaggacactaatactgcagaagaaattgatgaagcattgaatacagcacaccatagtttcgaacagttaagcattgctggaaaagtaagcactttgcaggattaaattctatcatgaagtgaagcatgtcctctttaagtgtgtacatttggagatgttaccactgaggttagagcttagcactgagttattaagcatgataatctaaaaaagaatggaaaacttttcccatagcctgccaagattggtcttgtaacattgttgtgctaggaacttaataaaattccagctttaataaggaaccatgacttctccttgctatgagctgaattttgtctcagaagcattgcagattatcttttcaacatttgctgattgtttggctgtatcccccttagtgagtctctttctctcttcctactccaccttccaaaagagactctctcatttggtgacacaaaacaagttcttcagcacctagcaacaaaatttacaattaaggagttcaaaaggttatagctgattatgttgtggctgcttttttgcatagaaggacatgacatttttgattggctaagggtcactatcaaaagtcatttctcaagaggaatgagaaatacgataaaagtaatagaagagttatgagagaaaaaaacaacattgagagaaaaggggaaaaaataatgtcacctgtgataagcaatacttagtaccagatatagtggagaagagcaaatcagtggtaaattaactggaggttaggacttcagtatctgaatttgggatagtggggacacaatccaactaaaaacagagtgttctctagccctcagtattcatgtccttctccatgcaagatacattcaccccatcctgacacccccaaaagtttaacccattccagcatcaattgtaaatataaaaatctcaccttctgggcaggctcacttggtcatgcctgtgatcccagcactttgggaggccagggcaggtggatcacttgaggtcaggagttcaaaaccagccttgtcaacatggctaaaccccatctctattaaaaattcaaaagttagccgggcatggtggcacccacctgtagttccagttgctggggaggctgaggcatgagaatcgcttgaacccgggagacggaggttgcagtgagccaagatcgtgccactgtacttcagcctggttgatggagtaaaactccgtttccaaaaaaaaaaattaaaaattaataaaaattaaaatctcaccttctaagttaggtatgggtgaagactcgatatacgattcatcctagggcaaaattcatttccactatgagcctgtgaaacgagacaagaacttagttgcttctaaaatacattggtgaaacaggaataagatagacattccacattcccattctaaattggaagaatcagaaggaaagaaggggtcatggatctaagcaacaatacttaaaacttcaaaaatactaagattgtgtaatacttaacattttaattcaagtatggtttctacggttttttttttaatccacggggtcctatcaaagagaaattcagctacttaaaatgacttgtttcctgtaatgatgaaaagaaaaaaatttagtacactcatcagtggattttttttaggtcttgttgccacattatcagtagaaaatgccagtaaggccaggtgtggtggctcacacctgtaatcccagtgctttgggaggccaaggcaggaggatcacttgaggctaggagtttgagaccagccggggcaacataatgagactttgttcctccccaccaccaaaaaaaaaattagttggacatggggctacgtgcctgtggtcattgctactcaggaggccaaggcaggaggatcccttgagcccaggagttcaaggttacagtgagctatgctcagcctactgcactccagcctgggtaaccaagtgagacctggtctcagtaaaacaaacaaaaagatatggtcttgctcacaaatagtaaaacttaaagttgaaccttgtgacttattctatttatattattatctctttacctcttgtgttattttgaagagtctagaaagtaccttttactttcaaaattctacaacttctacaaaataaaaattcccaaattaagtttttgtcttgtttttttttttccaggcacttgaacacatgcagaagcaaacgatagaggaaagagaaagagttatagaagttgtggagaaacagtttgaccaacttttggctttttttgattccaggttagtaacttaaaaatatggactcaatgaaactgaagtttctaacactaacttgtcattgtattcctttgtttagaatggtaatgggtaacttttaaacaagtttgtaatgggtaactttcaaacaagtttggaagttggtagtccctacagactgatctttagaactgcaaaatgaaaaataatgtgtaagcttttaaaaattttgcctatttaccttctggtgctgaagctaatggtggtttgtttgagacagggtcttgctctgttgcccaggctggggtgcaatggtgtgataatagctcactgcagcctcaaactcctgggcttaagtgatcctgccacctcagccttcaaagtagctggaactacaagcccacaccactacatccagctaattttgtgttttttttttgttgttgttgttttgttttccgagacaagggtctcactacattgtccatgcttttcccaaactcctggcctcaagaaatcatcctgcctcagcctcctaaagtgctgggattacaggtgtacataacggtgcccagctgaagctgttaactgttaaagtaaacaagcttgagccaggtgtggtggcttacacctgtaggattacatggtgatcatcctgtctaagctcactttgggaggctgagatgggggggggatctttgagctcaggagtttgagaccagtctgggcaacacagcgagactccatctgtacaaaacaaaaaaaaatcaaccaggcattgtgtgcatttctgtagtcccagctgcatgggaagctgaggtgggaggattgcttgagcccaattgttgctattgggttatagcaattctttgtatattttgaatatgaaatttttgtctatatgacttacaatattttctcccatttgtaagttgtcttttcactctctcgataatgtcctttgatccacaaaagtttttaattttatgaagtccagtttattgtttcttttgtttcttgtgcttttggtgtcatattcaagatatcactgccaaatctaacatcatgatgccttttccctgtgttttcttttaagagttttatagttctcacatttagatctttgatccatctttagttaatttttgtgtatggcataaggtaaggatccaacttcatccttttgagttggatatccagttttcccagcactatttgttgaaaagattgtcctttcccccactgaatgttcttggcacccttgtcaaaaatgagctcaccatatatgtgaaggattatttctgggatttctgttttattccgttgttctgtatgtctttccttatgctagtaccatgctgttttgactactgttgttttgtagtaagttttaaaatcagaatgtgtgagtcctacaactttgttccttttcaagattgtttctcagggtctcttaagatttcataggacttttaagatggacttttcaattttcacaaaacaatgtcattgagattttgttagggattgcattgaattgtagatcactttgtgcagtattgacatattaatgatattaagtgttccaatctatgcacatgggatgtcttctcatttatttgtgtcttaatttctttcagcaatttcatatacaagtctttcacctcctttgtttattcttaagtattttctttcttttgatgctattgtaaaagggattatttccttaattttcttttgggattattcattgttactgtgtagaaacacaccttatttttatattgatttttgtgtcctacttttttgctgaatgcatttattagctttagtattattttatggcatctttagggttttctgcatgtatgatcatgtcatctgcaaataaaatattttacttcctacaaaaagatgattttacttcttcctttccaattcgaaaaccttatttcttgtctaattgctttggctagaactttcattactgtgttgcacagaagtagcaaaagcaggtacgtcttgtgcctaatgttataagaaaagctttcagtcttcaccattgaatatcatgttcactatgggtttttccatatagggtctttattatagtgaggtagtcatcttctagtttgagtggttttatcatgaaattgtgttgaattatgtcaggtcctttttctgcatcaattgagaaaccacttgggctttttgcttttttcttttaatgtggtatgttacatcaatcacatgttaatgtttgtatgttgaactatccttgctttccaggaataaatcccacttggtcatggtgtataattctcttactatgctgttgaatttggtttgctagtttgtctgaggactttctatcaatagttataaatgatactgctctacagttttctttatgtggttttgggtagttttggcctcatagagtgagttagggaacgtttctgcccttcaagtattttggaagagtttgaggaggattggtgttgattattacatgtttggttcaatttaccagtaaagctgtctggtctaaggctaaactttgttgggaggttttttgattactcattctatctccttagtcatgtctgtacagattttttaatacttttatgagtcagttgtgataggttatgtgttcctggaaatttgtctgtttcacctagttatataatttgtgtacagttgttcataatagccttttaatcctttttatttgtgtaaaattgatagtaatgtacccagtttatttctgattatagtaatttgattctttttccttttttttgatggattctcgctctgtcacccaggctggagtgcagtggcgcgacctcggctcaccagaacctctgtatcccgggttcaagtgattctcctgcctcagcctcctgagtagctgggactacaggcacctgccacccgcccagctaattttttttgtatttttagtagagatggggtttcactgtgttagccaggatggtctcgatctcctgaccttgtgatccatctgcctcggcctcccaaagtgctgggattacaggtgtgagccatcacgcctggcctgattctcttttcttagtgtgactataggtttaattctaatcttgaagtcaaacttttgctttcatttttctttgttgtgtatttatctcttctcttctcctttatttccttccttctgctttgagtttagtttggtctttttctagttacttatggtatatcgttaggttgttcatttgcgagctcctttttaaatgtgagtatttacagctataaatttccctcagcattgctttcattgcatcccataaattttgtgttcttgcttcatttgccccagataatttcctaatttcccttgtgatttattctttgacccattgggatttaggagcatattgttttatttttacatgtttatgaatcttccggggtttttttcctgttatttctaggtcattccattgtagtcagaaaagataccttgtaggatttcaatctttaagtttattaagacttactaataaatgttaatgaacattaaacattagtcagcatggtcttaacatatgttctgtctcaaaatgttacatgcacacttgagaaaaatgtttatcctcatgttgttgggtatagtgttctaaatatgtctgttgggtccaatcagtctatagtgttgtccaagtaatttattgctttattgattctacactggttgttttatccattattggaagggagatattgaagtctctaatgattattgtagacatgtctatttttccctttaattctgcaaatgtttgctttatatgttttggggttctaatattggtgcatatatgcttataattgttacattaaagtctattttgcctaaaatttgtggagccaccccagctttttaaattatcggcatgtattatctttttccatcctttcattttcaacctctatatgtctttagacctaaagtgaaatttttgtggcagcatatagttgggtcatattttttatccattcttcagatttgtgcctttggattagagagtttaatttatttacacttaaaatactgataaggaagtatttttgccatttggtttgttttctgtatgttttatggcttatttgttgttgcttatttcctccattactgcctttctttgtgtttacttgatttttttcttttgtagtcacaaattttgattcctttctcatttctttttgtgcatagtctgtaaatagtttttatggttacccataaggattacatataacatcctgaagttataacaatctgttttgagtagtagacagcttaactttagttgcatataaaacctctactgctttacaaatctgcccccctttattttttcgatgtcacaaattacattcctctatattgtatacctgttaagatagattgatattttacgtatttgtcctttaaattctgtagaaaataaaaagtagaattataaattaaaattacactaatattggtttttatgtttgcccatgtatttacctttaccagagatatttttatcattgtatggctttgagttactgcatagccttctttcacattaacgtgaagcactttcattagcatttcttatagggaaagtctactggtaatgaactccctcagcttttgtttatctggggatattttaatttctccttcacttttgaagaatactttgacagctttttttcttttggtgctgtaaatatacattgtcttcgggcctccaaggtttctgctgagaaatttgcagataatattattgaggatcccttgtacttgacaaattgcatttttcttgcagctttcaggattctctgtgtccttcagcagttggagttccttgagctcttagatttatagattcatgtctcatcaaattttggaaggttttttgccattatttcttcaaataatttctgtctctttgtctctctcttctcctgtgattcctataatgcatacattagtctgcttgatagtgactcacaagtaccttagactctgtttacttctcttcattgttgtttttatttttttcaggcttcattattttaattgtcctatattcaagttggctcgttctttccttctgcctgtccaaatctgcagtagaacctttggtggattttttaaaattacaattactgtatttttcaatacaatctatggaatttctgtttggttattttatataatttctctatgttgatattatcattttgtcccctagatcatttttctgattattctctagttctttgtccatatttttcttgagctgtttaagcatatttaagacagttgttttaagcctattgagtccaacgcctgtgcttctttgagaactgtttttaccattctgttttcttcctttgaatgggtcatgtttttctgttccttggtgtgccttgtggtatttttgttgaaattgggcatttgagaaaatagctgccttcccttgtctttgcagactggctcttgatgtaacagtccttcactgagtggttgtgtgtgccctgagccttgagatcagcctgaggtcaggcttaagatcttctcagatgttttctgagcatgcatcttgcctgggcctcagtgtggctttttcaattcccctgtatatataactgcttttatatgccttaatgtcctaaagagtctgagctcagattctcctccaggccttagatggtctattgtatgtctctacttataatctcctgccttccacaaaatttgcttttctctaattatgtatacatagcttttaactataatacatttcagttcaatttaatgcctcatttaccatgttatatgttaattttatcaacaagtgaaagtaccctttcagatacagttcagttactgtttgcctcatttaaccatattatgtaaaattcatcaactactgaacttactcttcaagatactatagatcgactttttctataaatatttatgaaatactgcaaaataactttggaatcttaaatgaaggaaaaagaacctgtgtgaagaatttgcaagaactactgatgattatctatcaaatttaataaaggctaaaagctacattgaagagaaaaaaaataatttgaatgcagctatgaacatagcaagagcattacaattatcgccttctctaagaacatactgtgacctgaatcaggtaatttaatagttcacaatgtgagttatttctgtggtagcttattttacatgctttggaatatatttaagacaagaatttgtttttcagattatcctaacctatattattatttagaattctaaattgatgacaatataggttaggatagtctaagttataataaaataatgtatgaaatctaagacaaacattgtaaaatttatatgaccttttgttttttttgaccagttagggaaatggtgcaattaagtctttgtaacacttgatctgagagcaagtaaggtgacattgaggtgaaagtttaggtttctaggacacccgattaaaaaaatgaggacaaataagggtagcaaactgaataggactctattttgttcacataaacaatttaggtgtggctgtcaactcttaacgttaaaatttaattcaaaatcctagtcaagtttttctcttccaattccattccaaattgtgcaagtcaagagacagcttcagccatctcctatcatctaatcatgtgcctgaggggtagaattgggcaaaaaaacaaaagtttcttatactttgacaggacaagattaatcacagatctttgctgacttctgcctcactccctaagggtataggttttgctttagtcatctttgaatcttcaggatctcacttcccgtggataatcaggtgtatagaagagaagccattagtttacctgcctccaaagtctctaacgttaaatgaaaggacaatttgccatgaccctacttggctaggtgtcccaggctttagttctaaaacaataatagttgtttcctgtgtattacacgtgcaacactaggtgatgaaaaaaatgataaaatttggtctttatcctagttaatctagctaagaaaatagggcagaaagggagaaaactcttgaagatagcagcacagttgcaaaatgaatctgatcgagttttctctgatcatgtagctctatcctatttcttagtgtctattgttaccttttatacatatctccaaaagtcataaacacttatttgtatccctttgagtgccccaaattgagcctgaatgcaataattaatgaaatacctaaaagatacagttttctttctaaaatcttactgttcagcaatatttgtgacaagattcacacatgaatgattttttttttaaattctagattatccggactttgcagttaacttcagatagtgaattagcacaagttagttctccacaactaaggaaccctcccaggtaagtaagtcatagttcaggagaccataacaagtataaagatgtgctggaacttaaatgtattaaaatagcaagtaataataaattgaaattttgggtcacaaatgtttactaagttagtaaccaaattaagataagtgtaatttgtgctaacttagaaagttatttaaatgtttccttttcaattcattaatgtcagcaattgatttttgtttagagaacatgatacatttgtattagaacatttatgtatatgttaatgttttattataggttgagtgtgaattgcagtgagatcatctgtatgttcaacaatatgggaaagattgaatttagggactcaacaaagtaagtatttataagcatggtaacatgccattagtgtctgacagtacttacattatctaagagacagaagaattgatgtttagtgtaattcaaaagctgaaaaataaagggcaaaatagtttctatagttaaattctacatataatgttttttaaaaggcctagaagggatcagtattcagcaatatacatgtcgaagttatctttgagattgattcagtcagcaagcattgaacactgctaggcactaacaccctagatattgagataaatgtccgagaaattacaataagtagaggaagaaggacatgcaaacaataaaatgcataattgctagggtaatgtatgcagaatttacttgaggtgccaagcaagggaatgatcagttcttactggggtaacaggacttggaaagatattttcttttcccttatctattaaaattaagtagcaagtagaaaggaggagaaaaaggaagtatgcatcttataggcagtgaatatatgggcagtgaaatagcatgctaggttcagggaatggtgtatataattccattctctatgtccccaaggatacatagatgctaagtcttaaagactttgtatgctgtctgatgatgtttgaaccttatgatccatgctgtccagtatagtagccactaatcacatgtagctatttaaatttaaacataaattaattaaaactaaatagaattaaaatccagttcctcagttccattagcccacatttcaagttctcagtagccacatgtcgttagtgactacctgtcttattctatttgtgctgctataacaaagtttaaaaagaacagatgttgtttattcttctgtaactcataaagaacaggtgtttatttgcttgcagttctggcggctgagaagcccaagatcataatgctggcagatttggtttctggtgagggccctgatctctgctttaagatagcactttgaatgctgtgtcctcacatggcagaaagcatggaagagcataaaagggacaaataactatcttcacaaggtggaagagcagaagagcaaaaaagggcataagctagttccctccagacttgttgtaaggcacaaatccattcatgagggcagagccctcattgcttgatcattaatttccccaaaggccccacctcttaatgtcaccacaatgggaattaagtttcaacatgaattttgaaacatttagaccaaagcactgctatattagacaatgcggcatatttctattatcaccaaaagttctgttgtacagtatagttctagggagtagaaagccactaaaaggttttaagcatgaaagtaaaaattattagattacattttttagggataattttgatggccatttgggggattatttggcgtaagaggatgacagtgaaggctgaaggatcacttaggccatcatatcagtagactcagcaactcatgagaactaaaacttaactaatagcactggatagggactgagaatagatatgacaaatgcaaaatagggaaaattaataaaactcagtaatgcttgaacgtgaggcatgaggaaaagggaagcatcatcaatggtttgttacgctttggtgactaagtcgatggattgtggtattcatcaagattaggaatacaggaagcaaagtaagttgggagggggaagatagtatgttgagtacttactgtttaccagctttctggagagaaatgtgtacagcttaattggatatgaatgctgaaacttaagagatcttggtcttgattctgggtttaggagtaatcagaatatagatgtagaaaccaccaaaagagaaataagttctttcattgtaggtggattgtctccaatggaaatggtcccctgagaaaagcaacgcatttgttaccttagggaacaaattagtctggctcacagtattaccatttcagaagcacataggatgatgtatactctaagccaggtaaattcatataaaccaaggtcacaaaactgatgtgtagtcaaaatgccagtttgttaacttaatggataaatataattgtgaacagggactagaactgaggagctaacttgtcagaagttacttttttggtaatcttttttgaataaagggaataaaattaatcagataggttaacagaattaggctaagatagctgattagattcctctccatcagagggaagaccttgccagaggaagtggaataccagtccttcggctcagtcatctttctccatgcttgggagagccctgccccatatttactgctgtgacttgactttatgcttacatggataatcaacaacctttgcaatcaatatgttctttttgacattttcacaacttgaatatggttactatccgcatttctaagacactaaaaactattctgcctctttaagcatctgtactgatcttctactttaaatttaactctgagagctgccttttaaattttttcctagtttttagggaaagtattagtataacctgcatgtactgattacaaatggtagttaaaccatgggtttgcacagtaagagcaggtattcaaacaggtcaaggacaataccctggaaggatactaaaatttaaagcagagaaagggtaatctgtaaaaaaaaaacttgagaaggagcagacagaagttgaaggagaacagaagtggtgttgtataagtcaaagcagaggtttatgacaccggagctgattaataatgttgcatgtctcaggtctaataagaattgttatgaaaagagacatttagattgcaaggtcgtgtacatatatatgactctcagttgtttggacttcaacatatatcaattttacttagttaaatgtatgtcctctgttggaagaggcagataaacatgcatcattgctaaatccagttggctttgttgatcgttatttccacagtggcttcttaaacactgatctgtgaagaagctaaatccatcatggaataactaaaatataaacttcatgaaacccaatcttatctcattgtaaaatttctatacttgtagatttgatagcctaaaaactgtctggatatgtggagaaaatagaaaaatatggagtagaatggataaataactggcagtgggtcagtggctattgaataatcatgcccaaaagattcagattaatgtccatggtgggagtttctagtgacttattcatggttgtaccatatacctctgtattcatagcttatatctctgtatttttaaacagatgttatccccaagaaaatgaaattagacagaatgttcaaaagaaatataataacaaaaaggaactttcttgttacgatacatacccaccgctagaaaagaaaaaggttgacatgtctgtcctaaccagtgaagcaccaccacctcctttgcaacctgagacaaatgatgtacatttagaagcaaaaaacttccagccacagaaagacgttgcaacagcatcccctaaaaccattgctgtgttacctcagatgggatctagccctgatgtgataattgaagaaattattgaagacaacgtggaaagtaagttaaaatgtaaaagcagaggggaaagatcttgtatctgtaattagacacagttggtacctttttcgtccatgcatttaacagaaatataattgctgttataatcttattcctcattatgagttaaaacctgttcattccatgcccctactctcacattttccagagttaggataatttttatttttaatgcagtaatatagctaacctctgaggtataaattaatatctggtttaattagggtattttgagattttttagtgttctcacatataagccttgtataaaagatataaatagagagatgtgatttgtggacatagttttattactttctttgaattaagaacatctcttcaatctttgttgtgagatttaatataaactatcatgattacaatgttatctattttatgacatttaaatgtatcacagttgtatttgattagattttcaatgtcagtattctttccattaacatggagtgagatactacactatgtagttttatactaatagtctcctttaagaccatttttcaagatcagcttttattttcccctacccgttgtctattttattggttgactctccagaattgcattttagaaaaggacacacttctttccactgtattatcattgatgtctcaattacttaagatacctgtaataactttattcattgatacaagggatgttgccattccagtgttttgccaatttcagtacagctttttaaaaactagcatgtcattgttaacatagttagtacaagttgtctttatttcttattttgatgaagcatgcggcacagatgatcttggggagacacctagatatccaaaaaagcctcttcagaaaaactcatctgttccttttggatcaaaagcagatactgtaacaactgtctgagcttgatgtagtggagtttactgtatgtgtagtaagtagctcttacctagtgtgaggtagtaagtaaagtgaatttcactgataactaaaacatattactttctaatgttaaaagttttaattccggggccagacaccatggctcacacctgtaatcccagcactttgtgaggccgaggcacatggatgatttgagctcaggagttcgaaaccagcctgggcaacatggtgaaaccctgtctctacaaaaagtacaaaaacataagtgagtgtggtggtgcacaactgtggtctcagctattcaggaggctgaggtgggaggatcacttgagcctgggaggcggaggtagcaatgagctgagatcccaccactgcactccaccctgggtaacagtgagacctcatctcaaataaatgaatgaatgagtgttttgactctggcagaaatattccccccaataaaaaaaatattttttgagacagagtcttactgtgttgcccaggctggaatgcagtggcgcgatcctggctcactgcaacctcctcaggctcaaatgattcttgtgcctcagcctccggagtagctgggattataggcacatgccacaatcctcagctaatttttgtatttttagtagagatgaggtttcaccatgtcagctaggctgatctcaaaactcctgtcctcaagcgatcctccctccttggcctcccaaagtgccgggattataggcgtgagccatcgtgcgcagccaggaatatttccaaaatttatacttctctcagatgtcaccccagttgtatgtgtttatctttttaccccaccctaaatatgggcattattctttatattttctattggatagttaaaatgacccatttgttcagtttctgtcatctatctatacttgactatattcatttccactcctcctagtctttgttttttaaacaattttaccatgtaaacatttacctcattcagaaattaaatatatattaaaatattatgtgaaacttccccccatcctattcccattctattcagtgtctccatctcttccacattttctttatgcatttataaataaacacacacaaattatttttccaaacttctctctccctctctctctctatgtgtgtgtggcgggggtgtctttttttttttttttacacaaaacgtagcataccactgttttgtttttgcattccttccttaacattgtactttggagatcttttcatattagtgaagacacttggcttaagaaaattttctgactgtctttacctctactcaccccaccaaaaagcacacgcattcccctaaatgctgctcagtactttggctttgcctagacattttttcacatctgatttataagactaacctgatttataagacttgggagtcagagtggctatgagctgtattggttctataggtagagtatagatggaactggcttttgtaggttatcctagaaacctaatcattatcagtaggggttctgagttccaaatatgttcataaagaaactgaacttttgtaatacagtagagttacagcatatacgttgactttagaatcttaactatcacatagactatgatttcatttatttagcgtattttgcaagtattatgaagtatttgcagttcaggttactaaagaattcattgttgaaagtgatccatttgttttatcaatcatttagggcttgcactacttcctggggccgacgtgcgatattcccagagttcacaatgccataagacactcttttagaggctattatggttgttcagctttcatgaattattttctaactcatggtttattaatgtgacttaaacatttttatccaggttctgcagagctagtttttgtaagccatgtaatagatccttgccatttctacattcggaagtattcacaaataaaagacgccaaagtactggagaagaaggtgaatgaattttgcaataggagttcacaccttgatccttcagacattttggaactaggtaatgaaatattagtccaagttaaaatatcaaatttatttaaataatataataacttggccaacccacataagacttgttataatatagatttttgctctaagttcatttgtagtaagcataaaagttttaggattatttaacataaattatttaggcaaattagctaaggattaagatggaatgttggcacattttttagagtgagatatgtacagaaactccattatgtagtagggcgaatttcttttaaaactacaaaacccatgacagattatatagcctgtccccttgtctccatgaagaactgtgcctgtaagatgattcttgtgtaactccagtctcttgctcgccatgtgtgagtgttggggctagcattgagcacctgagattcaggaggcctgtggcacccattcccagcgccctacagaggataattgtaaattcagtcagtcttttaattgtgaggatatgtgaatttgccatgcttcgggcttttgttacgagtatttttcttataacgttgactgaatttgattgtaccttgtaatatgaggaagctatgattcatttgtattaatagagtatttttctcattatgttagtagcaatcaatacctatatataactaatacagaaagtgtttatctgtctagtcttgattgtcatttaaaagtatgattaactctcagctcatctgtgtaacttttcagaatatcagaagagtaggatcatcatatactttgacaaaaatgaatagtaattctaaaacttaaaaaataacatttatgctatgtgagctgggaacattaggttgttagtatctaagaggagggaagtgtagtactgaattcagtttttgtggttgcaaataatgtgtctaaaatgtaatacattccaaaaatagcttattttcagaaaatgttctaagacagccagaaagttgtgctttaagttgttaatgataattatgttggcaaagtaaatacagctgattaaaacactcatttatattttgagaaattagtgataagggaagacatgtgaattgttgatttagcagaggagagtatcctcttgttcccttttcctgcctctgtacttcatcatgaagaacagtaaatggcttcagcagacttttatccattgaaagaaagaatagttttatagaatatatacagcaggtcttcaaataacattatctcattataattttgatgagaaaaaaatcaattcctggtttgggcaaatgtctgtgttgagtttgcacattctccccgtgtctgtgtgggttttttcaggtactctggtttcctcgcacatcctaaagatgcacacgttaggttaattggtgtgtctacattgtcccagtctgagtggcagggagagagagagagagagagacaaagagtgtgtgtgtgtgtgtgtgtgtgtgtgtgtgtgtgtatgtgtgtgtgtttaccctgcaatggaatggtgttctgaccaggattgtttcctgccttgtgccctgagctgcctggatgggcttcagccaccctcgactctagaataagcgggttggagaatgaataaataaatatatattatcataaaattcataaagtatttgataactatacaaatacatgacaataaatgatgcagtacaaaagcgctctgtgaatccaccttatttatgattgtttttgaactgtggtgccaggaggtactccttacaattctcactttgcaagctgtaattctttgagttaacccactaccactatgactgccgtcactcactgattcaccaaaaattgagtaaatatcttacttgttcatctttcttaaatgtacatttagctcacacttgtttcagtatttaatattagaagtgtttggggtctttataagtttgatgatgtttttgtgaccagaaatacacgtagaaacttaactcttgtttatatcaattagcctatgtggtaagattggttttgttacgccattttgcttaaagtcacagtttctaagaatgtatcaatgacattaagtggggatttactatattttaaaactaagaatgttggtacagtagtgtagcaaaataagagaagggtcactgacaaactgaagatcaaacgttttggtaggacttaaaaggctgcctataatgtgcttttcaactatcctgttgttattagcatatacagaggagattacacagcatctctctgtatataatcagtgatcagaatttaccagattcatttccaaaatatgtagtttaaatgggctctaagactacctgagttctcctgctacttcttctaagtagccatgtgagttgggctagattaggttttctacctagttttcctcacctatgataggaacagtaccttcgtagggttgttgtggggagtaagtgaattcaaacaaaacacagaacatttctgagctcatagtaagcattcacctgtgggcctttttttttgtttgtttgatcttcttttttcctggttgttaatttgtaatccaactggtccctacaaaggtcttcctctacagctaagtctttagttcatcttccctcttctctgaaaaccactgggtgccaataattttggcatttcacaggctacctttcattgttttactctcactcccctttacaaagagaagataattgtttcttctctcattacaaactttaatatgtgtatgtcagtgtacatgtgtacatcacaaagacagatggtcttgcttgtaagtacagtgtaattatggtaattaatttgcctgtctctcttcctttcttgagcttcttgatggcaagacagtctcattcatctttgttcttattgctcataagctggttgtcattaagtgactgctaacttagtattctttaggtgtttatctccctatttagcttgtttctgtataacaaactatcataatatgctgtattatatctttcttatagcacttgaacacagtgctatatcatcattaaataaacgaattaagactttttcgtggtagaactaacgtgtctgtaaacttatgaagtggcttttattgataaatgtttataacgatttgtttccctcattatttaggtgcaagaatatttgtcagcagtattaaaaatggaatgtggtgtcgaggaactatcacagaattaattccaatagagggtagaaataccagaaaaccttgtagtccaaccagattatttgtccatgaagttgcactaatacaaatattcatggtagattttggaaattctgaagtcctgattgtcactgggtatgatattttataatatgtatccttggcctgcttagaaacattttggagggaggtggagttaaagaataaaggaaattagaggtagagaggagtaatttgtcattcttaacttccaagacatacgttttattattttgctctactgttgtcttgataagtaaaactttatcatttaccagtattactagatggagagcttagaaaaggaactccaaacttaagtactcttcttatgtcactttaaagcagggaataatacacaaactaattcttttaaatgttacagttagcaacagatgattgagttaaatttttaatcagacttctgtaatttcattaatgtttttcaaagtgtcatactgtctaactcactgtaggtattttaaatggttttctctgtcttctaggaaaataatacaaactgatatgtttctgtagtaaggaccagtattaaccatagcatgatcacttaatggttatagctttatgaataagtagatttatatggggggaagtgtcattatctcctttaagttcaaactgcatgagtatgtgaaagtgcaaatgtagctgagatttctttctgtggaggaaaactgtctctgcttataaaagctaaactaagtctatatagtaagaaagtattaatttggactataactttctaaaaggtgtaacttaagaaaaattatacttagaaatgcataccttctgtgggggaaaacaaatttaagtttgaagcattattttcaataaatattacttgaatttctcctagagttgttgatacccatgtgagaccagaacactctgctaagcaacatattgcactaaatgatttatgtctggttctaaggaaatctgaaccatatactgaagggctgctaaaagacatccagccattagcacaaccatgctcattgaaagacattgttccacagaattcagtaagtgagactttaattattttttccttcagaggttattacaattttagctatgtattgccagttagattgctaagtataggctcagggaaccagtaatcttgataaatacatagtgcatattaaactgttagttctaatagaaaaggaaatgaacttcggcttccacaattgaaaacatttttaatgggaaatggagttgaataagcatatattaacataatgattggttaagtatctgagtaaagcagtaattttggagtcaactatacagagaaataagtttatgatgtgtgtgtttctctacagtattttcttatttccattgccctttattattctatttaatggccatattgcattctgcgttttgtattatttatgaaaatctattctccagcaagattgtaaactcttaagagacagaaattgtaacaatacatgttaagcagttgtattcttacaaggtctatgagagcagaggagtctgtctttgctcatcgttgtattcccagcatttagcagatcacatgccacatagaaggcattcaacacatacttgaaataacaaataagttaatttaaaaaaaaggaaacacaaaaatagcagcactggtgttttctttaaaatgatgagtgttttgtttttaattttctcttttttaacttttcacatttttacactgagtagattttacatttataatcataaaaacttcagaaagctattctctttttttgtttttaaggaatttctggttttgatcctgaaatttactttcaatatgttacgtaaatgttcaaagatcaacataaaaagttttttggctggttttggtggcccaaggctgtaattccagcactttgggaggccgagatgggaggaccgcttcggctcaggagtttgagaccagcctgggcaacatggtgagaccctgtctaccaaaaatacaaaaattagccaggtgtggtagtgcaccatgaaggctgaggtggaaggatctcttgagcttgggaggcggagattgcatgagctgagattatgccactgcacaccagtctgggtgacagagtaagaccctgtctcaaaagaaaaaattgtttgcccagtgggtggatttttttttaaatcacttaagtagcataaatcttatgcattgctagtaatggaagctagattaactgatgattgtaaatttttagattttattttaggcatacctatactttcagaattaccttttgaattttcatctaagtggaaaattgaatacttatttctttcattttgagatctttctttataaccttcatattaatattcaaaagtgaaactaaattctaaagtaaaaccttgagaatatatttataaagtgaaggtatatgcacgttgtacattcataaagactgcccctaagtttgtggccctggctgtttctatttttctttcttttctttcttcttttttttgagatggagtcttgttctgtcgcccaggctggagtgcagtggcatgatctcggctcactgcaacctctgcctcccgggttcaagcagtcccctgcctcagcctcccgagtagctgggattaaaggcacctgccaccacgccccgctaatttttgtattttttgtagagacagggtttcaccatcttggccaggctggtcttgaactcctgaccttgtgagtcaccacgcccggctgccctggctgtttcctaatgtctgcggttggttcagtttgttcgcagttgcgtctgtggttggtacaaacctaaatccagaacattgtaacattagcgatacttacaattaattactatggaattttactttcttgcacagaatgaaggctgggaagaggaagctaaagtggaatttttgaaaatggtaaataacaaggctgtttcaatgaaagtttttagagaagaagatggtgtgcttattgtagatctgcaaaaaccaccaccgaataaaataagcagtgatatgcctgtgtctcttagagatgcgctagtttttatggaactagcaaagtaagtaacttattaaaacttaaatattctttgagattatagctataaatgagagtagcagattttgcctttaaaaaccatgtctgtaaagtaaaccttaacatacctgaagaagtgaaaaatattgctcttagacttttctgagtacagttgttgtctgtgaaaactggattcagataattggatttaagaaaataggctgggcagggcgtctcacaactgtaattctagcactgtgggaggccgaggagggaggattccttggggtcatgagtttgagaccaggctgggcaacatagctagacctcgtctctacaacgaaatacaaaaagaaattaaccaggcgtggtggcatgcatctgtagttccagcttctcaggtcaggagctgaggtgggaggtttgcttgagcccaggagttcgagctatgctcttgccactgtactccaggttgggtgacagagtgagacaccctgtctgtaaagaaaaacgaaaattagaaaaattagagaaattaaggtagctcaaaatataaagtatgtataaatacctaacatcttttggactcttgataactttattagcagctgtatgaggatttcaataattatagtttaactgttcctaaattttcctcaattttgtagcctttggaatgagttcatgatcactaccctatattcaatgtatgaatctagaatagatgtttaaagtttctttgtccatcatttcttttttgtttgtttgagacagagtcttcatcccatcacccaggctagagtgcagtagcacagcctcagctcattgaaacctctgcctccccaggttctggtgattctcatgtctcagccttcccagtagctggaattgcaggcacacgccaccactcccggctaatttttgtatttttagcagagacagggtttcaccttgttggccaggctggtcttgaactcctgcccaccttggccttccaaagtgctgggattacaggcgtgagccacagtgcctaggctgtccatcatttctgatgacttaagtaaccatagaggtagtcaaagattctaatttttaccttgggtgattgggaatggaacccaagcaggttccattctagaaaaatacaagtagtcttggatctggaaggagccacagagacccttcagctgacacagaccacagatatcaatgtaacacaaaaaatagaagcagctttgaatctaagtacgacatgaaagcctagctctaaagttttgagacttgatatcttatttaacctggtttgataattgaagacaataccaagaaatgttagaagaaagaaattggaagatgagcgcttttggtaaataagtcagtacatgtacaagtccttcctttagatcaagtcactgagagaaaagagactaagaaaatggcttggccaggtatggtggcttacacttgtatcccagcactttgggaggccaaggcagtagggtcgcctgagcccaggagttcagggtcaacctgggcaatgtagggagaccctgtctctacaaaaattagccaggtgtgatggcatgcccctgtggtcccagctacttgggaggctgaggtgggaggattgcttgagcccagaagggtagaggctgcagtgagccatgatagcaccactgcactccagcctgggtgacagggtgagaccctgcttacgcttttcattatgcttttaattaggtttaagtcacaatcactaagaagtcactttgaaaaaaatactactttacactatcatccacctattttgcctaaagaaatgacagatgtttcagtaacggtttgtcatataaatagtcctggagatttctatcttcagttggtaagtatataatgtgtttttgaaatgaagtttttaaaaaaattttaattagacatgtataacaagaatgagtatctaccgtcaattttagtcagagcaaacgtaccactgttaaccttctatacgtttaaatttcttagtagttgcaacttcaaacaagtttatatgatttatcacaaattgaaagaacaatgaaggataattaatgtataaatgtttcttgctaccttctgaaatctggagactaggaaagcatatagagttagcaaatagaaatataatgataaaataaatttttttctaacctgtacctctgaaaatttaccgattattattaggtgttttctgaatttgaacaccaaaatagacacagattaaaggcatttcgtattgaactttggatgtgtgactgatgtgtttagatagtaacaataatagttcatccttattgatttctgggtgctttatatgatttaactcatcataaggcccttaagactttaagggaattaactcattaatctttgcaacaatcctgtgagaaagacactgttgtctccatttgaatgtggagaccctaaccacagagatgaagcatcttgcccaagatcacacagctctgaaagggtagaaccaggattgaccaagcttcagaacttgtcgtctcaagcactgcatcacactgtagtggctcctcaaatgagttgtggaagctccttatctaagttaggatttgcgtttatttcttttgttgattttttacagcgtcttttatggtaaaatatacataatataattttatagtttttaataattgttcagtgtaccattcagtgccattaaggccattaagtgttgtgcatccatttccagagctttttatttatctcaaacaaaagccctgtacctattaaacaatcacataccatttcttctcccctagtccctgataaacttctgttctactttctgtctctatgaaattgcctattctaggtacctcttaagtgaaatcatatacaatgtttccttttgtatctggcttctttcacttcaacttaatgttttcaaggttcctattatgtaggatgtatcagaatttcattcctttatatggctgaataatattccatgtatggatatactacattttgtttatccattcatctattgatggccatttggattgtttccaccttttggcctatgtgaataatgctgctatggacactggcatgaaagtatccatttgggtctctgctttcagttcctctggtatgtataatacctaggaatgattgctggattatatggtaattttatgtttaactttttgggggaactgccgaactgttttctacagcagctgcagttttacattcttaccagcaatccacaaggttccaatttctccacaccctcatgaacacttggttttttttttcttttttaaataacattcttttttttattattatactttaagttctgggatacatgtgcagaacatgcaggtttgttacataggtatacatgtgccatggtggtttgctgcacccatccccatcatctacattaggtatttctcctaatgctatccctcctcttgtccccaccccacaacaggccccagtgtgtgatattcccctccctgtgtctgtgtgttctcattgtttaactcccacttatgactgagaacatgcagtgtttggttttctgttcctgtgttagtttgctgagaatgtccctgcaaaggatgtgactcattcttttttatgtctgcatagtattccatggtgtatatgtgccatattttctttatccagtctatcattgatgggcatttgggttggttccaactctttgctattgtgaatagtgctgcaataaacatacgtgtgtaagtgtctttatagtagaatgatttctaatcctttgggtatatacccagtaatgggattgctgggtcaaatggatttctggttctagatccttgaggaattgccacaccggttgaactaatttacactcccaccaacaatgtaaaagcattcctatttctccacatcctctccagcatctgatcgcctttctgactggtgtgagatggtatctcattgtggttttgatttgcatttctctaatgaccagtgatgatgagcatgtttttcatatgtttgttggtcacagcaatgtcttcttttgaataatagcgttctttttttattattattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccccaaaacagtccccagagtgtgatgttccccttcctgtgtccatgtgttctcattgttcaattcccacctatgagtaagaatatgcggtgtttggttttttgttcttgcgatagtttactgagaatgatgatttccagtttcatccatgtccctacaaaggacatgaactcatcattttttatggctgcatagtattccatggtgtatgtgtgccacattttcttaatccagtctatcattgttggacatttggcttggttccaagtctttgctatcatgaataactgccacaataaacatacgtgtgcatgtgtctttatagcagcatgatttatagtcctttgggtatatatccagtaatgggatggctgggtcaaatggtatttctagttctagatccctgaggaatcgccacactgacttccataatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctgcataaatgtcttcttttgagaagtgtctgttcatagccttcgcccactttttgatggggttgtttttttcttgtaaatttgtttgagttcattgtagtttttggatactagccctttgtcagatgagtaggttgcgaaaattttctcccattttgtaggttgtctgttcattctgatggtagtttcttttgctgtgcagaagctctttagtttaattagatcccatttgtcaattttgtcttttgttgccattgcttttggtgttttagacatgaagtccttgcccatgcctatgtcctgaatgttaatgcctaggttttcttctagggtttttatggttttaggtctaacgtttaagtctttaatccatcttgaattgatttttgtgtaaggtgtaaggaagggatccagtttcagctttctacatatggctagccagttttcccagcaccatttattaaatagggaatcctttccccattgcttgtttttctcaggtttgtcaaagatcagatatttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttggttccatatgaactttaaagtagttttttccaattctgtgaagaaagtcattggtagcttgatggggatggcattgaatctgtaaattaccttgggcagtgtggccattttcaggatattgattcttcctgcccatgagcatggaatgttcttccatttgtttgtatcctcttttatttccttgagcagtggtttgtagttctccttagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcatatcagcttaaggagattttgggctgagacaatgggattttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattgatttgcatatattgaaccagccttgcatcccagggatgaagcccacttaatcatggtgggtaagctttttgatgtgctgctggattcggtttgccagtattttattgaggatttttgcatcaatgttcatcaaggatatcggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtgtcgaggaatttatccatttcttctagattttctagtttatttgcatagaggtgtttgtagtattctctgatggtagtttgtatttctgtgggatcggtggtgatatcccctttatcatttttattgcgtctatttgattcttctctctttttttctttgttagtcttgctagcggtctatcaattttgttgatcctttcaaaaaaccagctcctggattcattaattttttgaagggttttttgtgtctctatttccttcagttctgctctgattttagttatttcttgccttctgctagctttcgaatgtgtttgctcttgcttttctagttgtttaaattgtgatgttagggtgtcaattttggatctttcctgctatctcttgtgggcatttagtgctataaatttccctctacacactgctttgaatgtgtcccagagattctggtatgttgtgtctttgttctcgttggtttcaaagaacatatttatttctgccttcatttcgttatgtacccagtagtcattcaggagcaggttgttcagtttccatgtagttgagcggttttgagtgagattcttaatcctgagttctagtttgattgcactgtcatctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattagatccgcttggtgcagagctgagttcaattcctgggtatccttgttgactttctgtctcgttgatctgtctaatgttgacagtggggtgttaaagtctcccactattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgagtttcctgaatacagcacactgatgggtcttgactctttatccagtttgccagtctgtgtcttttaattggagcacttagtccatttacatttaaagttaatattgttatgtgtgaatttgatcctgtcattatgatgttagctggttattttgctcgttagttgatgcagtttcttcctagtctcgatggtctttacattttggcatgattttgcagcagctggtaccggttgttcctttccatgtttagcgcttccttcaggagctcttttagggcaggcctggtggtgacaaaatctctcagcatttgcttgtctggaaagtattttatttctccttcacttatgaagcttagtttggctggatatgaaattctgggttgaaaattcttttctttaagaatgttgaatattggcccccactctcttctggcttgtagagtttctgccgagagatccactgttagtctgaggggcttccctttgagggtaacccgacctttctctctggctgctcttaacattttttccttcatttccactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacatagatttggtcttttcacatagtcccatatttcttggaggctttgttcatttctttttattcttttttctctaaacttcccttctcgcttcatttcattcatttcatcttccatcgctgataccctttcttccagttgatcgcatcggctgctgaggcttctgtattcttcacgtagttcttgagccttggttttcagctccatcagctcctttaagcacttctctgtattggttattctagttatacattcttctaaatttttttcaaagttttcaacttctttgcctttggtttgaatgtcctcccgtagctcggagtaatttgatcgtctgaagccttcttctctcaggtcgtcaaagtcattctccgtcccgctttgttctgttgctggtgaggaactctactcctttggaggaggagaggcgctctgctttttagagtttccagtttttctgctctgttttttccccatctttgtggttttatctacttttggtctttgatgatggtgatgtacagatgggtttttggtgtggatgtcctttctgtttgttagttttccttcatacagacaggaccctcagctgcaggtctgttggagtacccggccgtgtgaggtgtcagtctacccctgctggggggtgcctcccagttaggctgctcgggggtcaggggtcagggacccacttgaggaggcagtctgcccattctcagatctccagctgcgtgctgggagaaccactgctctcttcaaagctgtcagacagggacgtttaagtctgcagaggttactgctgtctttttgtttgtctgtgccctgcccccagaggtggagcctatagaggcaggcacgtctccttgagctgtggtgggctccacccagttcgagcttcctggctgctttgtttacctaagcaagcctgggcaatggcgggcgcccctcccccagcctcgctgccgccttgcagtttgatctcagactgctgtgctagcagtcagcgagactccgtgggcgtaggacactctgagccatgtgcgggatataatctcctggcgcgccattttttaagccggtcggaaaagtgcagtattcgggtgggagtgacccaattttccaggtgccgtctgtcacccctttctttgactaggaaagggaactccctgaccccttgcgcttcccgagtgaggcaatgcctcgccctgcttcggctcacgcatggtgcatgcacccactgacctgcgcccactgtctggcactccctagtgagatgaacccggtacctcagatggaaatgcagaaatcacctgtcttctgcgttgttgacactgggagctgtagaccggagctgttcctattcagccatcttggctcctcccctccccgccccaccccctttttttttttttttgagacgcagtctcgctctgtcgcccaggctggagtgtagtggcaggatcttggctcactgcaagctctgcctcctgggttcacgccattctcatgcctcagcctcccaagtagctgggactacgggtgcctgccaccacgcctggctaattttttgtattttttagcagggacagggtttcactgtgttagccaggatggtcttgatctcctgactttgtgatccacccgcctcgacctccctaagtgctgggattacaggcgtgagccaccgcgcccggccaatagcattcttaataagtgtgaaatggtatcactttgtgattttgatctgcatttccctaatggccagtgatactgaacatctttacatgtccttatttattggccatttgtatatctttgaagaaatagccattccagtcatccatttatttttttaaatgtttaaaactttttatttgttttttattttttaaacacagggcttcactctgttgcccaggctagaatgcagtggcatgattgtaagctcactgcagcctcaatctcctaggctcaagggatcctctagcctcagcctcccatattgctagtactacaggcacataccaccacacctgtctaattattattttgtagacacagggtcttgctaggtaatccaggctggccttgaactcctgggctagagtgatcctcccaccttggcctcccaaagtgctggtattacaagcatgattcaccatgcccaaacctttgtccatttttgtaattgggttgtttattttgttgttggattgtaggagttttcatgtattctagatactaaattcttatgagatatatgacttacaaatgcagttgatcgttgaacaagtggtagtggtggataccaacccccgtgtagtcaaatatttgcgtgtaactacttttttttttcttttcttgagacaaggtccagcactgttgcttaggctggagtgcagtggcaagatcatagcttactgcagcctggaactcctggactgaagtggtttcctgtctcagcctcccaagtagctagaactgcaggcatgcagcacagctcgctaatttttttttttttttttttttttttttttttttttttttttttttttttttagagacaggttcttgctgtgttgcccaggttggttttgaactcctggtcccaaacagtcctcctgcctcagcctcccaaagtgctgaaattacaggcatgagcctcgacactcagtctgcgtttatcttttgatttccacaaaacttaactactaatagcctactgttgattagaagccttaataatatataaacagctaacatatattttgtatatgtattcaatactgcattcttaaagtaagctagagaaaaagtgttattaaaaatcataaagagaaaatatatttactattcattaactgaacgtggatcattatacaagtcttcatgcccatcaccttcatgttgaataggctgaggaagagcagaagttggtcttgctgtctcaggtctggcagaggtggaaaaaaatttgcacataattggaactgcgtagttcaaaggcgtgttccaaggctggctgtattttctcccattttgtgggttgtcttttcactttcttgatagtgtcctttgttccacaaaagtttttaattttatgaaggccaatttaattattgtttcttttgttgcttgtgcttttggtgtcatatccaagataacattatcaaatctgacatcatgatgcttcttccctatgctttcttctaagagttttataggtttagatctttgattcattttgagttaattttgtacaaagtataaggtaagggcccagcttcattattttgaattggatattcagtttttccagcactatttgttgaaaacactgtcttttcccccattgaatggtcttggcacccttgttaaaagtgaaagtttatttctggactttctattttgttccatttgtctgtgtatctgtccttatgtcagtaccacactgttttgattactgtagttgtgttgtaacttttgaaatcaaaacgtgtgagtcttccaactttgttctttttcaagattgttttggttattcagtgtctcttaagattccatgtgacttttaggatgggtttttctgtttccccaagaaatatagtatgatattgagtatgatattatcatttgctaatgtattgaaactcaactgatttttacatgtgaattttgtgtctagcagctttgctgaattaatttgttttaacaagtgagagagagagaaggtgtgtgtatgtaatttgggggcattttctcatgtataagatcatgtcatctatgaacagagaaatgtcattgggattttaacagggattacattgaattgtaaatcactttggatagcattgacatcttaacaattttaagtcatcttatccatgaacaccggatttttttcatttagttagatcttatttaatatctttcaacagttttgtgtggttttcagcataacaatttttggcccatttgctcaagtttattcttaattcttttagatgttgttgtaaacggaattgcttttttaaatttcctcttcaatttgctcatttactaatgtattaaaacacaactgatttttacatgtgaattttgtgtctagcaactttgctgaattaatttggtagccctaacggggtgtgtgtgtgtgtgtgtgtgtgtgtgtgtgtgtgtgtgtgtgtgtataatttggggggattttcttacatagaagatcatgtcatccatgaacagagatatttatactttttcctttctgatttggatgccttttgtctttttacctaatgcctctggctaggatttccaatatcatgttgaatacaagatgaagaagcaggcttccttgtcttattcctgtcttaagggaaaagcgtttgtctttgaccattgagtatgatattatctgtgagtttttcccaaatgacctttaccatgttgagtaagtttccttctgtctcttgtttattgagtgtttttgtcaagaaagggtgttcaatttttcaaattcttttttgcaacaattgagatgatcatgttttggtcttttctccttcatcctgtcaatgtggtgtattacattgattttggattttgttttgtttccttgttggtttgtttggagacagggtctccctcagttgcccaggctggaatgcagtagcatgatctcagctcacggcaacatttgcctcccagactcaagcagtcctcccgcctcagccttctgagttgctgggaccaaaggtgcacaccaccacaccaggctaatttttacaatttttttattttagaaatgaggtctcactatgttacacaggctggtctcaaactcctgagctgaagtgatcctttcaccttaccctcccaaagtgctgggagtacagccgtgggccactgcgcctgctgcattgattttcatatgtcattatccttgcattttaaaaataaatcccactagataaaggtgtataatctttttatcataaatttgtttaacatcattgttgccttggcatccatttttaggcctaacataagttgtttaaaactgagttataccacctcatctttggcctagttaaaactttccctccccatgtggctgtttgcagtgtgggtcacttgttctacatctcactgacccaacatatcccacagctgcttaccacaataaaaccagaatcaacaccagagtcatgcaaataatttcccccctttacacatattttctttaaattagccagttcacaacccctgctggaaagccttaagaggtaatgcctgtggaccttaataaaggcagagttccacagattcactcttatctgtgattaacaaaatgctgcttttatttcatgtgttttgttttgctgcctctgtgtctcacctgactgacatacacatacctaactttcctcccagtcagcactcctggagagtggctatcttggcaggaataaactggacacaggtcggacaagaaccacgagggcatctgctagtataaacaagtttcctgtgagacatacacttggccacaggtcaggcaagaaggcattgtcccattcaccaagataaagaagtatcctcttttgatttactgtaaacatcagtgaccacctcctctagagccttgtcggggcagagctagagttcctggccactctccagagagagacccgaagaccaagttagaagaaaacaaaatcttttaatatgctgaatttggtttattagtatttcattgaggatatttgcatcagtattgcaagggatattgatctgtaattttcttatagtgtcttcatatagctttgttatcagggtaatgcagcctcttagagttagtattcctccatctttttgttttttggaagaatttgagatggaatggtgttaattcttctttaaatgtttggtagaattcagcagtgaatctatctggtccagggcttttcatgtgtaggaggtttttgaatcctgtttgaacctctttactagttataagtctactcggattttctgattcatgagtcagtcttggaaggttgtgtgtttctaggaatttgtccatttcatgtaggttatccagtttgttggcatacaattgtcttcaataatctcttacaattttttacttcttggccgggcatggtggctcacacctgttatctcagtactttggaaggccgagccaggtggatcacttgaggtcaggagtttgagaccagcctggccaacatgtcaaaaccccatctgtactaaaaatacaaaaattagccagctgtggtggtgggcacctgtagtcccagctactcgggaggctgaggcaggagaattgcttgaacccaggaggcagaagttgcagtgagctgagagtgtgccactgcattccagcctgggtgacagcaagacttcatctcaaaaaaaaaaaaaattttttttttcttaaaattggtagtattgtctgcacttttatttctgattttattaacttcagacttctctttcttttctagttattctagctaaagatttgtcaattttgctgatcttttcaaataatcaacttttggctttattgatgttctgtttctttatcctgtctcatttatttttgctctaatctttattatttcttctgctacttttgggtaattttctctttttctgttgtcttatggtatatagttaggttcttaatttgcaatattttaaaattgtgtatatagctataaatttccctcttagcactgttttattgcatctcatgagtttggtatgttttgttttcatattcctttgtcttgaagcattttctaatttctcttaggatttcttctttgacctgttggtagtttgtggtgtttagtttctacatatttgaattttgcagtttttctcgtttttgatttccagtttcctttcattgtcatagagacaaatacattttatgatttcaattttttgaaatgtattaagacattttgcagcctaacatatggtctattctgagaatgttctaagtggccttgtaggaaaaaaaaagaaaaggtatattttactattggctagagtgttttgtgtatgtctgttaggacctgttggtttacagtgttattcaagtcttctgtttccttattgatactctgtctggatgttttatgcactattgaaagtggaatattaaagccttctatttttattattgaactgtctattttttccttcaattctgtcaatgtttgcttcatatatttgggtctttgatgtgtactgcataattgcttataattgttatatcttactggtgaattggcctttttatcaatttataatgtcctttctctcttgtaagaattttttatttaaagtctgttttgcctgataccaccagtaaagccatctcagatctctcttgattactatttgcatggagtattttcttccatcctttgactttcaacctgtgtatagcataaggtataaagtgtatctcttgtggacagcatatagttggatcatgtttttttttaattaattctgccaatctttgtcttttaattggagagtttaatacatttacatttaaagtaattactgataaggaaagacttctgccatttgctgttttctgtatcttatcacacttttattccttctttcctccattagagccctcttttgtgtttagttgcttttttctttttagtatgatgtattttttaaaatctcttttgtaattgtgttaaaaaacacacagaatttattatcttaaccattttttagtgtaacttcagtagtgttaaccatattcgtattaccatgcaatagatttctagaacattttcatcttgcaaactgaaactatactcgttaaacaacagcacatttctccctgcttccaacctctggccagcacaatattacttctgcatttttatgaattttactatgttagataccttgtataagtggtctcagacagaatttgtctttctgtgactggcttattttacttataataatgtcctaaagattcatccatgttgtaagcattgataggatttcctattttaaggctgaataatacttctttgtatgtatatactgcattttaaaaatcccttcatttgtcagtggacatttggattgtctgctgtaatgaacatggaaatgcaaatattatagtatcaggttttgcttcccttcttgtttcctttttgtgtttatcttgtagattattttttatcattaccatggagattacatataacatcctaaagttataacaatccaatatgagttaataccaacataattttaacttcacaaaaaactacttctctgcagctctctttttccagtatttttgatgtcacaaattaatctctatactgtgtgctcaataacatagatttgtaattatttatgcatttgtcttttaaatcctgtagaaaataaaaaagtagaattataaaccaaaattgcaataatactgactttcccatttacccatgtatttaccttcaccagagatcttaatatcctcatgtgactttgaggtactgtctagtgtcctctcattgcaacctgaaggacttccattagcatttcttacagggcagatctagtggtaatagagtccctcagcccttgtttacctaggactgtcttaatttttctcacgtttttgaaggttagttttgccaaatgtataattttcagttgacaggttgtgtttttctttagtacatcatatatatctctgtcttcccatttccttctggcttccaaaatttctttcttgtctcttttttcttttttcttttttttttttttttttgagacaagagtcttgctctcttgcccaggctggaggcagtggcacgatctctgctcactgcagtctctgcctcctgggttcaagcgattgtcctgccccagcctccctagtagctgggatttcaggtgtgcaccacgatgcctggctaatttttatatttttagtagagatggggtttcaccatgttggccaggctggtctagaactcctgacctcagatgatctgcctgccttggcctcccaaagtgctgggattacaggcatgagccaccgcacctggcctttttgttttgttttgttttgtttttatttttgagatggagttttgctctgtcacccaggttggagtacagtggtgcgatcttggctcacggcaacctctgcctcccgggttcaagcaattcttctgcgtcagcctcttgagtagctgggactacaggtgcccaccaccacgcccggctaatttttgtatttttagtagagatagcttttggctatgttggccaggctgatctcaagctcctgacctcaagtgatcaccccccttggcctccccaaagtgctgggattacagtcgtaggccaccacgcccagcctggcctccaagatttctaatatgagaaactgacttataatcttcttgagtctctttgtatatgacatgttgcatctcttttgctgcttcccagattttctctttggctttgcctttttagagtttgattatgtgtcttggtgtatgattctttgggtttatcctatttggagtctaatagtgtcttagttccctggagctggtgtaacaaattactgttaattgggcagcttaaacaacagaatttattgtcaacagttttggagtctagaagtatgagatcagtttgtcagaagagttgatttcttctgaggggtttgagggaaaatccatttcacctctctgctttagattttggtggcttgctggcaatcttttgtgcacctttgcctttgctgcatcaccctgatctctcccttcatcttcacatggagttctccttgtatatttgtctgtacccaaattttgccgtttttataaagacattgatcatactgaattagggcccatcctaatgacctcattttaacatgattataaagaacctgtatcgaaattaggtcatatttgagatactggagattatagctctccaacatatctttgggggaagatacaaatcaactcctaacattagacttcttggatttgtaggttcatgtctttctttaaattggggacttctaccatttttaaaaataattttttgcctctttgtctctctcttccttctatgactttcataatgtctctgttggttcacttgagccccttaggctctgtttacttctctccattcttttttctttctgcttctcagactcgatatttaaattttcctatcttcaagttcactgattatttttcttctttccactcaatgctgcttttgaacccctctattgaattttttctccttagttattatacttttgagctccagaatttcctttttataatttgtatcacttgctgatattcccattttattcatacatcattttccgaattttctttagttctttgttttcccttaacccttttaacatatttaagacagttgagtatttttgatttgcattttttttctggttgcacatgtctgcataattattaaaataatttcagaaaataatgaagccgtttctttgtcatctcgcacgaagaaagttaaggacacggacacacatgaggagtttaggagtggcggtttaatatgcagaagaaagagaaaggagaacagctctgtctctagtgagagaaaggggcttctgaaagggaaagactggctggaggtggatgtgccggattttgtaggcaggtttaaggaggtggtgtctgattacatagggcccacagattggttcagtcaggtttgatgtttacatagcacgccagaaaggctggccaccccaccctaatcttattatgcaaatgggctttctacttgactggcaccatcctgtgtgcttcttactgtacatgtggctggcaaggcgagaagggaggatggagccgccattttgaacaggattggcgcaactgccggcatctgtgtctgcagctcaattttataggctactctttgttagaaaatgatttgggggctgcttttcactgaaaaggaaaaccttgccgaggactccttcctgtattctcactctctgcctaagtaatttcttttttttgtttttgttttttttttgagatggagtctcactgtgtgcccctggctagagtgcagtggcatgatcttggctgactgcaacgtgcacctcccaggttcaagcaattcttctggctcagcctcccaagtagctgggattacatgcatgcaccaccacacctgactaatgttgtatttttagtagagatggggtttcgccatgttggcctggctggtctcgaacttctgacctcaggtgatccacccgcttggcctcccaaagtgctgggattttaggcatcagccactgcacccagtctcagtaatttctttttaactcctgtgtcaatatgaaacgaaacctaaagggtcgtgaatataaaatgaaatgacagaggtccctgatgctgtgacacagaaacttctgatatcagtcagtacctgcaagccctattcagtcccttttcaggattactgcttacttctggttttcagtgaggtcaggaattcttgacactttgtgtcatatctttacagttagtttcatactttcgtatgttttcatgttaatgtcctttcatttcaactttaagaactcatagaatttcttgtaaggcaggtatagtggtgatgaactcccatagctcttgtttgggattaagagagttgtgttctttttttaaaagaaaaaaaaacggagtctggctctgtcacccacactggagtgcaatggcatgatgtcagctccctgcaacctccacctcccaggttcaagcaattctcctgcctcagcctcctgaatagctgggattacaggcgcctgccaccacacctgagtaatttttgtatttttagtaaagacagagtctcaccatgttggccaggctggtcttgaactcctgacctcatgatctgcccgcctcagcttcccaaagtgctgggattacaggtgtgagccaccacgcccggccaagagagttgttttaaaagctgtagtagttcatttgttttggtacttttccaaactgtttcaaagaccattccttgtcatgtatgatcactgaagtctgttgtttctttggcttgtactcagctaatgattgacagagttccttgaatgtcaggagctgaaacaaagaagagacagagaaagaggaaggcgccatctttcctagactttgtggactagctctttggtgggcacttcttcaccatttagagaggctgagcctaggaatcagcctgaggtcatagttaaagtctttttatttcttttctgggcatgcatcttgtcagggcagacatgtggctttgtaaactctaccatatatatgactgcttttgaatgtcctaatttcgtaaagattctcaccccagattctcctcctggccttagatggtctattgtatgtttctactcataaactcttccttccaagcagctgtgcttggtactcccctttgccacgtttacaagtggtccctgcagttcttcctgcctgtgttccaagttatatgaaacaaaaactagctctttgcatcagtcttgcaggtatctcccggacttaggatacatatacacagtaatttgcatataagttctggtctgttccctctggttcaggggagggaactgagaactggactgccactgcttaagaccaagaccattgtcattctgggaagagggtagggtgaggcaagtaaaaataccacaaaactttcctaccatttagaaaattgcttttacttcattaggcttcttggttactgtaaactttggattgctttgtagagatctgatctaataaagttggttgagacactttctcattttttcaatgtttctgtattggaagaagaacttaaagcttcctaatctattttgttggcgtcattcctctgctgaatttttaaatgttcactctggcttacctgttaatggaagaatttgcataatatctacttagaaaggtaagttaaaagtagttttaaagtaatttaaatgaaataacaagataaggattcagaaaattttcacttgcatcattatactcacaagaaaaaaattcattttttccattgaaatagatttcaaaatattttttaacattaagaattggtatttggagaaataaacttataatccttgatttttttggtagtataggaaactttagaaacttttttgattataatagatagcaccatttaataagagaaaagtctgtattactaaagaatgcaatcattccacaaaccttactgaatcattgatttaaggaagaattatcaattcacattaagatggatggttgataagatactggatattcatataatgccaaagtagcaccacataaattcttaagacttcgttattacaagggcataaacagaactatacacattgagaggggtcaggatcatcactgcaatcgataaatgaatcttagcatattagtagtcattaagtattaggccttgatgtgttgcaacttgagtatgaaaaagccacctatgacacagtctagccaaaaagatttgccttggatccatcaaacccttaggagtaactttcagcctttggaaaattcagcagatagaccttactctatggaagaataagctaaatagcagcatgaggatataaccacataaatccataaggtatggggcattctgcagaaaaataagctggctgtcttcaacaagacatgttcattaaaagcagaggactgtactagattataaaagtgttatggagataacaatcagaagcagtatataatcttggtttgtaatgggtttggatcagttaaggaaaactaaatgtgagctagaaatactagtaggaacagttactgaaatagaacaagtgagaaatgatagaaaaatgtaagtgattgtatgtgtggtaaagtctagttttggtaaaaacatatacagtgagtgtgtgtatgtatggaaaaatatcttgaagaatatatacactaagttgtctagcagaatgtgactttatttttatgtctatactaattttctatactggttctgcaataaaattttgtaaaataaattacgtaacacaattgatagatttacattcaattcaagttttaatgtttcataatttcaatgacagtgcttgtaattcattcaacacttacattttaagtttctgtgaaatgacagtgctttatccctttatttgctagatagagggcctggatattttatttctattaaagacaatcgaggaattctataaaagtgaagatggagaaaatctggaaatcctctgtccagttcaagatcaagcctgtgtagctaaatttgaagatggaatttggtaccgagcaaaagttatcggtaggagaatgcatgctgtttctacagggagatgtcatacttcaaaactaatatcatttgagttggtaccaattcaatcttggaagtaatgttatttgatcttatcatttgctctgccatctgtctttagaaaagctagtgataatgttgaaaggtgaatctatcttctgatattttgtttgacttgactagaacttaaccattgggaatcttgctggaaaagttgtatagatagaacaaagcaacagaaattaattattcaaaaaccggtgaactctagtttgatgttgactgtttgtctgtcccatgctattttgattgtcaaggtacaaattaaaggtgagtcctttgtgtcctctctgcttcccttcaattttaatatattcttctttcctgggaattattgactgaactgctagttttctcgatatattttttctactttttctacatcctccttaagtaattgattcaacttatgaaataatgggaagaataaaaagtgggattgaagacagaagatttatgaaaatggaggtattagcaacaaaaataataaagtttattattccccagcattgactaagacagaacattacagactaa

SEQ ID NO: 14713 - DNA, 64190 bp, Human; identical to SEQ ID NO: 14712

SEQ ID NO: 14714 - DNA, 5750 bp, Human
ccaatctcccaggctctgctatgtgccctgggaggctgatctgtttggaagacagcaacatcctttgacttaccattgagtttacccaatagggaaccctagcaagagatgtggaaggaggaaggcagggagggaaggggagaggagtgacagatggaaaggcgagaggaagaaaagtaacatctcagtattagtcccttagatccttccaagcagttatcatgggtagactgtgtccaatccgtaagccaaatgtcttagctcctataaacagccttctccaaatagccacccctgtctgtcactcaggcaatcactgtctcctcttatcacctatctccaaagttagtaagagaatattgccattatactttcccaaggtatggcatgaactcttgtagttgcactacaccttaccaaagctttgtaaatagtccctactaaactctccacatgttataatttgactgtgacctctattccttgctagaattcaagttagtaaggttgacacagcctgaatttgtaacaccatgtacttctatccatgcacatgcccttaagttccagaagagtacaggagtgataggattctcagttgtaaggaatgtgggaattctctcaatgagtaattaagcaacagtattcaaggaactagggtgtcgctgtgcagacttagaagccttgcttttgtgaagcccttagccaaatacaattgtctagatcatgctgctgaacaagcacaggaattttataaatactgacagagtttttttcctgtaaattttgctaactgtggtttgtgtgctattaacataagaatctaaatactctgtcaattctcaccatgttccttctgcttgatatttcagatacagtttcttagaaagaaagttcaaagaaaaaagaaataggatagaaataaggataactaaactctattaaatacaccacgttttttatctctctagggtatggggcaatttgctatgtacctaggttcctaccttcaggcatcccttagcgcagtggagtagacagattgttatatggtataaaagagagaaaattgtattttcctttgagtagtaaaagtagtcttaatggcttgacagagagagaaaggcaaatctgaaaggatcaaatcaggtgtattaagaaaagaataggaattacagaaagaataacagtgtcaaggataaggaggcattaaaaaaaataaaacagggccaggcgcggtggctcatgcctgtaattccagcactttgggaggccgaggcgggcagatcacctgagatccggagttcaggaccagcctgaccaacatagagaaaccccatctctactaaaaatacaaaaaacttagctgggcatggtggagcatgcctgtaacctcagctactcaggagactgaggcaggagaatcacttgaacctggaaggcggaggttgcggtgagccaagatcgcaccattgcactccagcctgggcaactcggtcccaaaaaataaataaataaaaataaataaataaataaataaaacaattggaatgtaaaagaaatctgtaatcccagcactttgacaggctgagacaggatgatcacttgaggccagaagttcaatttctgcctgggcaacatagcaagactccacttctttaaaaaaagaaaaaaaagaaagaaaatatattatttgtggtccttatatgctcgtttcaaaaaagggcatattaggaccacaaaaacatgagaaacctaattaaacagacatgtaggcccagaccaagttaaagtcaaaaacaacttttttgaaaggactagataaattagtaaaactcgacaaggctgaacaatgggaaataaaagaaagcagaaattggaaaaaggggacagaagacaaaatagggacagaaataaaatttttctataggcattaaaaagataaaaaaactattaaaaattgtatctaataaattatgtaatttatgtgaaatgaacaagttagctttttcacaacgggtttgctgccagaacacaggtgtcgtgaaaactacccctaaaagccaaaatgggaaaagaaaagactcatatcaacattgtcgtcattggacacgtagattcgggcaagtccaccacttctggccatctgatctacaaatgcggtggcatcgacaaaagaacaattgaaaaattgcagaaagaggctgctgagatgggaaagggctccttcaagtatgcctgagtcttggataaactgaaagctgagcgtgaacgtggtatcaccattgatatctccttgtggaaatttgagaccagcaagtactatgtgactatcattgatgccccaggacacagagacttcatcaaaaacatgattacagggacatctcaggctggttgtgctgtcctaattgttgctgctggtgttggtgaatttgaagctggtatctccaagaatgggcagacccgagagcatgcccttctggcatatacactgggtgtgaaacaactaattgttgatgttaacaaaatggattccactgagccaccctacagccagaagagatatgaggaaattgttaaggaaatcagcacttacattaagaaaattggctacaaccccaacacagtagcatttgtgccaatttctggttagaatggtgacaacatgctggagccaagtgctaacatgccttggttcaagggatggaaagtcacccataaggatggcaatgccagtggaaccatgctgcttgaggctctggactgcatcctaccaccaactcgtccaactgacaagcccttgcgcctgcctctccaggatgtctacaaaattggtggtattggtactgttcttgttggccgagtggagactggtattctcaaacctggtatggtggtcacctttgctccagtcagcgttacaacagaagtaaaatctgtcgaaatgcaccatgaagctttgaatgaagctcttcctggggacaatatgggcttcaatgtcaagaatgtgtctgtcaaggatgttcatcgtggcaacgttgctggtgacagcaaaaatgacccaccaatggaagcagctggcttcactgctcaggtgattatcctgaaccatccgggccaaataagctctggctatgcacctgtattggattgccacacagctcacattgcatgcaagtttgctgagctgaaggaaaagattgatcgccgttctggtaaaaagctggaagatggccctaaattcttgaagtctggtgatgctgccattgctgatatggttcctggcaagcccatgtgtgttgagagcttctcagactatccacctttgggtcgctttactgttcgtgatatgagacagacacttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataataatgcaacataaaaccttcagaaggaaaggagaatgttttgtggaccactttggttttctttttcgcatgcagcagttttaagttattagtttttaaaatcagtactttttaaatggaaacaacttgaccaaaaatttgtcacagaattttgagacccattaaaaaagtttaatgagaaaaaaaaaaaagaaatgaacaagttacttgaaaatataatttataaaaatgatacaaaaataagtagaacacctgaattgtctaattctatttaagaaatttattttatactggaaaaatcttcccgcagggaaatctccaagccaagagagatttactggggatatttctagacagttaaagaagaaataacactaactttacacaaattcctcaagaaatatttttaaaagaagggtaccgtttccaacttattttataagttcctcatagctttgataacagaactgaacaaagatatgacaaaaaaggaaactgacaggccaatagctctcataaagaaagatacacaatcttaaaattatcaaagtaaaaccagtgatctaaaagataatatatcatatccaagtggtttcatttgaaaaatgaagtttgtttacaaatactcaaaaatcaattaatttaaatttctataataaaacaaaaaggaacaaaattacatgataatttcattagattcaggaaaagcatttgatgaaatgcaacacatatttatgctttaaaaaataacttttaggaaataagaaatgcaaaggaactttcttactctgacaaaatctatgtctaaaaagacttaaacaaatattctacttaatggtaaaagactgaaagcaattaccttgagatactgaatgagtcaaggatacaatgtctaaatgtaagtgcaatgagagatgaaaaaaataagagcttaaagataagtaaaaaatctttcattcagaagttacacaatattgaacatagaaattcaaaaataatcttcataagtaaactattagacatattaggtaaaattagtagagtaaatatataaacactatatttctgcatactagctaaaaaagaaaataaattttaatggtactattaataatagtatcagaaacacaatatttataaaaataaattcaactaaattatgtaagacctctacacataaaattacaaagcattgttgggagaaattttaaaagcccgaaataaataaagggatataccatggtcattgattagaagtttcagtgtcgtagagatgttagtccttcctagattgattcagttcaatcctaatcaaattttcagcatgtttttgtgttagaatgtaggaaaattcaacatattaattcttaaatatatatgaaacttcaaaggactaagaaaatcaagacaattttgtttgtttgttttgaggcagggtctcactctgtcgccaaggctggagtgcaatggcgtggtcacggctgaccgtaaccctgacctcccatgctcaggtgatccttttacctcagtctcccaggtggctgggactacaggggcatgctactgtgcctgatttatttttgtattttttgtagagacagggttttactatgttggagaccacactggtctccaactcttgggctcaagcagtctgcctgccttggtctaccaaattgccaagtgtgagccacagtgcccagccccaggacaattttgaagcaaaaaaagatttattataatgttacaacaattaagataatatgatgtataaacacgataatcaattaatccagtgaaacagtactgagtcccaaaaggaatcacatgtttgcagttcactgaaagctggcaaagctgatactacaacccagtaaataaggaacactcttcccaggcacggtggctcatgtctgtaatcacagcactttgggaggccaacgcaggtggatcacctgaagtcaggtgtttgagaccagcctggccaacatggcgaaatcctgtccctactaaaaatacaaaaattagctggccgtggtggtgctgcctgtaatcccagctactcagccagctgaggcaggagaatcacttgaacccagaaggcagaggttgcagtgagctgagatcatgccactgcactccagcctgggcgacagagtgagactccacctcaaaaaaa

SEQ ID NO: 14715 - DNA, 5750 bp, Human; identical to SEQ ID NO: 14714

SEQ ID NO: 14716 - DNA, 20060 bp, Human
tctcttaaatgtttcaaaacaaaataattaagatgaatctcagtaaacaaccatgaaattcagtgaggtatttcctttattttttaatggttacagactcagggtctgtcatggaaatagctgcatagttttgactctgccaaatcactcactgaaattacatcacaggagggctgccagtgccctgtgggggctctgaatagcatctacccctttggccatttgggacctgcctgctgagctgtgaagtggcaggttttttccagcgtacagactcttcctaattatatagcatcatgacaatttgtccagcctaattaggggaggttatccaaccctgattgaggacactcaataaacaataatggaaaagacagctttaattgtcctgaggcttgaaatttctcccatggaaaatatcaggggcagtggctagattactggatttctaagaaaagggtaattctctataccagggaagggagtaaatcttgaaagcagccatgaaaataaacatcaaaaacctcccagccctcaaatgttatttggtctctttccctccagaagacattcaggtagtaaagggaatgaaatcaacactccttagttgcctgatacaaatactaagtcattccaatcaggaagatagttgtaattaagactactacactagttgacttccaggtgatggtggtgtatttgtttctcagtataaaatggcatgggaatacttttcaacaataaaaagaaaggaagtactgttctataatgcctcatggatgaacctcaaaaacattctgtgcagtgaaggaagccgcacaatgtataatcccatctataagaaacgaccactaagaaaaatctatagagacaggaaataggttagtgattgcctaggactaggagtgggagaagagactgactgacaatggcgaggagatcattttggggaggatgaacctgttctgaaattggcttgtggtgatggttgtacagctctgaaaatttactaaacatcattgaactgtacactcaaaacggatggattttatggcatgtaaattgtaactaaataaggctatttgaaaaagtttatattgtaccagaaaggttagcgtctgggcctgggtctggttcttccgctgccatgcaggtcgcctgtcactaacactcctcaagaattctgctccttctccatttccatttgtaaaacgttagcaggatggtgcggggagaaggagaacacattatcaaatctgagattctgtgcagtcacaagacaccaagtctgggaatttcgaaaggcaatcaggcataaattcttcctgaggtgagaaagaagcaaaggtaccggctgctggggtcagggccgtctcacacgcgtggctctaggcaggagcacaaatggaaccactggggaaagtaggactccagcagaaacgaaggcgcaaggccgaatccctaaggtccaacgagctagcagtcagttgacagggtttctaacaaaaacgcggcatgcgtttaccaaacctagggtggttttatttcagaagtaggaactctttccacgagagcaccaagttgagaagttcggttctcaggccgcgtggacctgacagctctcagaagctccaggcctcgctgggtggggcgggtagcggccgccgctgcctcagcagccctggtcccggcagagcagggctggcgaggccgctgctgccgccgtcggggccgccggccctccacactcgttgagacgccggcacggggaccttcgtgcccctctagggactggcgccgcgtccaggtggccgagcctgcgctgctggaggaggcgcctccgcgccggcctcaccccggggccggcagggggcgaaggcggagctggaagtcgccgccgggccccgggggaccggctcccgcgcttcctcccgcgccccccgcacagtgctcatgcgcacggcccagcctttatagcggccgcgggggccttgccttccgcactcgggcgcagccgggtggatctcgagcaggtgcggagccccgggcggcgggcgcgggtgcgagggatccctgacgcctctgtccctgtttctttgtcgctcccagcctgtctgtcgtcgttttggcgcccccgcctccccgcggtgcggggttgcacaccgatcctgggcttcgctcgatttgccgccgaggcgcctcccagacctagaggggcgctggcctggagcagcgggtcgtctgtgtcctctctcctctgcgccgcgcccggggatccgaagggtgcggggctctgaggaggtgacgcgcggggcctcccgcaccctggccttgcccgcattctccctctctcccaggtgtgagcagcctatcagtcaccatgtccgcagcctggatcccggctctcggcctcggtgggtgcgcgcccctcacgaccccggccccttgctccgctgggtggaggctggagccagccctcacgcttctctcttcgcaggtgtgtgtctgctgctgctgccggggcccgcgggcagcgagggagccggtgagtgggggagctggggtgcgtccaggcggtcgcaggggctgagcaccagcgggtacaagcgggactcagatccagccccttgggcttcagcccgaccgcctgaggaggaaggcgcgaaggttgagccgccgcgtggcgcgcccgcgttaacccctgcagccgatctgctcctgctcacctgtttctcccatggtagggggcccctggggtccagtggggggacgttctccaagagcactaggaagaaggcctcctccaggcccacccacagccccagaccccgggcccgctgagcgccggcagcaggaggtcgaggaaggaggactccttgagcctcaccgaggagcgcaccagtcctgggctctgctgcgtttgggggtggaggagaagccgcccagacccgacttcaggttgccgtagccgagagagagggaggcgaacgtcgctgtcccaccttgtttgactcgctagctatgtttctaggtgtaacccctataatcagaagcactcgcggtctcactctacacgctagagagtttaaaaagtttgtaccacgtgtagaggtccgggtatgggtgtgtggtttggtgtattttccagtgtaaaaggcaacgctttcctaagagctaccgtttgttttccttgaaagtaggaatgagggttaagtatccctcatggctgtatttctcccgctctacttaacaaaagtcagtgttcgcaactaaaggcggtcggtcttggcaccggattccgatgccgcccccatctcagcggaaaatgggaggaaggattaaggctgtttgatgataggtatgaggctgtttaggggtaaggattttaacctctcagctctctagactgcttcagagctaagaaatgggcattgcgcctgcatccttccttctcttccatggaatgtaaggtacctgtcaccacaaagggcacagaggagggtgcttgtcacaggcaaggtactcagttggacagtatggccagaaagtattcctctgccttggaaaaaaaaggtttttaaaattaatatatgttttaaaaaggtttggataactacaacttcccatgtttgaaaaatagcatttaataacattaatctcaatttagtatcgacagtaaattcacaaattaacatgttgtattatgttatcttgttacttgttgccaagagcttgtctcttcctagcatcatttatagtaaaaactgattctttgttaggttgacagtgtaaaacttgagaatattaacagtgctttctaaaaatgcatccgctgcttgataaatctcactggacagatctggagcagaaataatcaggttcaattaagataaaaatgctgtattctgaagggattcacttttctgttttctgtccttcgggagttgtagaatgttgtttgggcaaattaaccccacggctttaattttctcatctataaaatgaacaatcaagttagataactttctgtgaatctaagcatctttttgttggcttccttaatgtgtgagtttaaggatctgcatttgtaggctaactaggataaatggtcctatgaaggaaaggatggctttgatttgtgcacatgtctatgaaaatgttccacaaaggctcaatccagatttactatctttacctcaagcaactgtgtacatagcgtcatcaaagttgagatttaaaaatttttttttttcttctggagacaagatcttattctgtaacccaggatggagtgcagtgatgcaatcatagctcattgcaagcttgaactcccgggctcaagcaatcctcccacctcagcctctccagtggcggagagtacaggcatgcaccaccacgtgtggccatttaaaaaaaattttttttttttagaagagatgaggtcttgctatgttgtccagactggtcttgacctcctggactcaagcaaatcctcttgtcttggcctgctaaagtgctgggattataggcatgagtcaccacgcccagccaagattttttatatttctataattaatattaaatgacttttattttctagttcagatatagttccaattatgtatttccaacctggttaagaactgagaagccaggcacagtggcacacctgtaatcccagctactagggagttggaggtggatcacttgagctcgggaatttgagcctagcttgggcaacttggcgagtccccatttcaaaaacaaaaacgaaataaaaacccagaactttcacattagagttttatagtggctggggactatattaaattggaaaacaaccttgtggcttgccaaaatctggaatggtatggaagggtatataagtcaatagtcataactagaagtgtagaaattagggaagtaaaacttaaatctcacactgtagtctccccaccactatgccccaagaagtcctaagaatgcttacaatattatctcctttttcttcagctcccattgctatcacatgttttaccagaggcttggacatcaggaaagagaaagcagatgtcctctgcccagggggctgccctcttgaggaattctctgtgtatgggaacatagtatatgcttctgtatcgagcatatgtggggctgctgtccacaggtaagcccaaacacaccagggtgggagagaaatgcagacgtgattatttcctttcctgctttacccatctggatccctttcctccctgcattctttcttttgttgccattgtggccacagaaaatggatatattttcacggttctcctggatatacttgaaacaccaaatacacatggaaagctttctgacaaaaggcaaatagcattacctcttgatggctagattgctatgattccaaaacattcctaatcatgtgatatattactgagttattactatgtgccacctattgttttaacttccaccacaactctacaaggtaggtagaattttactccagttacagatgaagaaactgaactcagagagttgtcaagtatcttgcccaaggtgactattgttagcaagtgccatgctatcctgtagtagaatagccagtataatacttctaaaaaaattcagtccaaaggcatgtagctaaagtgagtatcttaggaaaattgtttggtgctctgaatttctaagttgtgggtaatgggatattacaaatgtgttcttatcaacacttaagaagttcaacagcacaaaaccatttttttccaggcaaattttgttcttgtgtaagcaagtttttaaaaggctagcagcagctgggagtggtggctcacacctgtaatcccaccactttgggaggctgaggcggatggaccacttgaggtcaggagttcgagacctagccaacatggtgaaaccctgtctctactaaaaatacaaaaattagccaggtatggtggtgcatgcctgtaatcccagctacttgggaggctgaggcaggagaatcacttgaatcctggaggtggaggttgcagtgagccgagatcgcgccactgcactccatcctgggctacagagcgagacgccatcaaataaataaataaataaagcagaatctttagatgacttccctgatgagctattttcttgattaatcaaagcaatagatacaacatggcactataagtcagtgggatgccctgaaaaagtgtggatagcatctcagctgctattcttgtgttacaggggagtaatcagcaactcagggggacctgtacgagtctatagcctacctggtcgagaaaactattcctcagtagatgccaatggcatccagtctcaaatgctttctagatggtctgcttctttcacagtaactagtaggtataattattgttctcattctgtaatattctcccaccccccaaacgttttctgctttttttagctcagcctctttaaccttgatggaaaaacctgtgatcaagactaaagctgacctatagaggtaaactgtaggttagactgaggggtcaagtacccactgaagccaaatttgggtgaatagaagacaatcttactgacagatgatggcaatagaaacttgaattatttgcagtcagaatgcccggacacttaccaaggaactgaaaaactactaaatacatttttgatgatcctttgaagatataatggataagcattttggttctctgaaactagcatgcagcaggatgtttgtaactacaatcaccattaccctattacatttgtcattgtagagagctctaaattagattcataatactttggtaaagaaggaaaaggaaaaaaataagcttatttttattttaacagaaggcaaaagtagtacacaggaggccacaggacaagcagtgtccacagcacatccaccaacaggtatgaactatgaaacctatctcctagttgcccggcacagcatttggaagttatgaataaacgtgttgttggtagaagcttttcttaaagaaatttgatattaaagagaaacaaagcaaataccttaagtttactggtatattacatatggaaacattcattatgtgtatattttaaagacagggtctcactctgttgctcaggctggagtacagtggtgcaatcatagctcactgcagccttaaactcctaggctcaagcaatcttctcaccttggcctcctgagtaggtggtactacaggcacatgccaccacacccagccaatttttttgatttttaattttttttatttttatttttttagacaggtctagctatgatgcccaggctggttttgaactcctgacctcaggcagtcctcccacttcagcctcccaaagttcagggattacaggcatgagccactgcacccagcctaataattctctaaaagtcctattttctcccagatttgataaaccacgcctaagaactggtcaaagtaccatgaacttctagttccatttgcttcattaaattcctttaattactgcactgtcatgtgactaaaaggaatgtgtgtctattgtaagaaatagccagggatccccttttgtatgacgatggcagttttaaagtcaaagatattaagaacattaggatttaatgttgagttcctgcctcacctgtgggtttggggtattaaagtcctggattagggcatatcaaatatgtaggcctacatactgatttgtttatttgttgggtcattgctttccctagtccagaaaatcctgaggaaattaatttttttaaaaaagtcctttcaagaatggcactctgttgttatgagcttctccccatgtgggtttcttgctatgtaactgtcttccttttgttaatgccaagtgcatcttttatttcaggtaaacgactaaagaaaacacccgagaagaaaactggcaataaaggtaagaatcaagatctccatttgggaaggtagcattttccctccctcctcttgagactgctaatgaggggactggtttggttgttcgcagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccaggtaccaaccttgttaaaatgggagatttaaaaaaaaaattattttgtaattgacacataataattatatatacttatggggtacatagtgatgttttcatacatacaatgtatagtggtcaaatcagagtaattagcatatccatcacctcaaacattgatcatttctttgtgttggatacattcaaaatcaaatgaggccgggtgcagtggctcacgcctgtaattccagcactttggaggccaagtgggtgtgtggatcacctgaggtcaggagttcaaaaccagtctggccaacatgtgaaacaccgtctctactaaaaatacaaaaattagccagatgtggtggcatgcacctgtaatcctagctacttgggaggctgaggcaggagaatcacttggactcgggaggcagaggttacaatgagccgagattgcaccactgcactccagcctgggcaacagtgagactatgtctcaaaaaaaaaaaaaaaaaagaaaaaaatcaaatgagaggagatttgaatgagtcttgaatgatgacaaatgatcagttcttttagtgggtacatgtcagttcagtataaacatttgagttatggacacactgggttcccaaactgtaagttcaggatctaagactgcctgggcagactgagtagatctgagtgcctcctttttggaataaaagaatttagaaaactgtgtgctatctatataagaaccagaaggtagactggagagtcctgttgcttacacaagtcacctctgcttatctactctgctcaattcctaatttctctcttctgaaggaagaagcagtgatatgtctattccacctccctattctgttattctttttagctctttccatattctcttggttggtgatctgaagcacgacctttctattttattcatttaaaaatatttattaattgctggccaggtgcggtggctcacgcctgtaatcccagcactttgggaggccgaggcggatggatcacggggtcaggagattgagaccatcctggctaacacggggaaaccccgtctctactaaaaatacaaaaaaaaaaaattagccgggcgtggtggcaggcgcctgtagtcccagctactcgggaggctgaggcaggagaatggcgtgaacccaggaggtggagcttgcagtgagccaagatcgtgccactgcactccagcctgggcaacagagcaagactctgtttcaaaaaataaaaataaaaataaataaataaataaatatttatttattaattgcttttagaaatagaatatgctcattatagaaagcttgaaaatacatagagcacaaaaaaagaaatgctctaaatcatatgccctagagataatcactataaaatggtttttttttttttttttttttttttttgagacggagttttgctctgtcaccgaggctggaatgcaatggcacgatctttgttcactacaacctctgcctcctggatttaagtgattctcctgcctcagcctcctgagtagctgggatcacaggtgtgcactactacgcctggctaatttttgtatttttagtagagacaaggtttcaccatgttggccagcctggtctcgagctcctgacctcaggtgatccacctgcctcggactcccaaagtgctaggattacaggtgtgagctaccacgcctggccccttcagtattttaaggaaatatttgactgtattatttttaaaaaactcagactattaaaaatgccctgcatcctgtttttttcatcctttagtatttttagcattttctcatatcacaaatattcatcaaaaatatttcataatattccgctgcatgattagtcattcttattatttcttcactacattacacactacactgtgatgaacatccttatatcatctttgtgcccatctctgattatttcatcaggttagatttctaaaagtgaggttctgacttaaagcctctgatataaatagtgaaattgagccatgcacagtggctcatgcctgtagtgccagctgctcaggaggctgaggtgtgaggatctctcaagcccaggagttcaaagctgcagtgagctatgatggcaccactctactccagcctggacaacagagaaagaccccatctctaaaaaaacaaataaatagcgaaattgcttcctagaaaggtgaagtagtttaaactactatcagcagtgtgtaaggttgtataaacagtgctattacaaatattaatttccatttcatttctgttattttttacaagtggctctgctcttagattagatagaatttttttggcatgagaagaaaatttaactgttttaacataatttaaccatttgtctctcacccttaaaaaaaatgtgttccttgtttcattgacttatggtatcacatttatacctgagtttgagcaagtctatttctttgattcatatgctaatccttacatatttttttctacgctgctttgattatcacagttttattgcacattttaacatcccatgaggcaaattcccctgcagtactttttgtcttgtacttttttctgactactttgacccaattctttttgaagatgaattcttcattaccttgtagactcatacaaagttttgtagtttttctgttttagaaagaccattagaataggtaaaccatgtcaagtttatatgtatgtaagtcaaagaacagaatatatcaaggatacaaaaatgagactaatttcataagtcataatctggatagttgaaaagtgaccacaagtgaaaaggttttcaacccatgaaatctgattttatgacccaatattccatcaggtatgtatgcagaaatacagtcagtgttctacttctccctcaaaaaatcttgaataaaatggctactgataatgctaagatcttaaattttgcactaggaaatactgactcatctagaaactaaacacaacagattgtgctgtggttgtttatactcaaaacggtctctgctgaacacagagtagttatataaaagtgagctgaaattcctttaatattaaatataggaaatgagatctcaaaactcttacaatacacataattttaaggtgcacaaatgtcattgtcattataagaaaaactcaatattgtaactttataattcatttcacctttgtccctttaaaaaaatgttgacggtcacatcaatgaaattgtttctcctgaacagagagctctgagttaatagatccacactacttagagcctctggggtcccacactggaacagaccctagtctcatacccagccacttcctcatttagtttagctacctggtgcccaactctgcggacttctgttaaacccgaggctctgagccaagcccgatttcaagttctccgtatagtttaggcatggactttgcagccagacaacttgaacttaaaatgcagctgtgtttcatcaggcaaactccctaaatgctctgagactcagtttcttcatttacataattgggataattccaaccttatagagctatgatgaaatgaggttttacatgtgttatgcttttggcttattacccagaatataataaatcctcaatatggcaattatttgttacacctctgaaatatctccaataattcaagtaaggatgcaatgcctcagttgactatgtactatggaattaagaaagaaacttgtgtgttgtctggttttaaaactgttttttaaggcatgtaatgttgcttattttacctttttaattctccctgaataacattttctttcttccactcagtgaacatcccaaaatagaattttacttgaaaaactttacatcagccaaagatgttttgtttgccataaaggaagtaggtttcagagggggtaattccaatacaggtaagtagactttgatacctgggatgtaacataggagagggttatcagtgatcagacatgtaaaacagtattatgctattttatatgagcagatgtgaaatcctcctggaactgaaatcttggctaggtctgcatttgatcatctgagataaattttcaatttataatggaagtataccaaagtgttgatatttcttattttaaaaaatataaagcatggtgatttagaattctcatacattggattgactagatataacattggagaagtatctctttgtaatgctaaaaagaagtgaaaatcaacagacttatctaatgaatgcagatgtggcagaaagaatgagtagcactaccgttgactctgaagagagacttcttagaggtactaatcagtcaccaaagggctacatagagagcacatgcatggaagtgggaatcagttttgtgtttctaactggcgattgatgtggggtaaacaaatgtgaggcttctaggaggtggagggggatctaatatggcttgtgaagataaataggcctggtagataattaaactttcccagctgatgcatctgttacagaactgggttctatataattcttttttgtgtgccccgccccactgccagttctatatataattcttaaactttgcagcatcaaatgctacagggaaacagaaatgtggtttgagcagtggtaaaggctatttgtttgcttctttttcaaatttaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggtaaagtggtgagggttatcttctgttacagtgatgggtattccattttggacctctaagtgcagtgctgactgcctcttatctagattaacttgaaacattcaggattttccagtttttaagaagaaacaacttttgatccttttggatatcttttatgtgtctcccccattaggctgtctgtcggaataatggcttcttctcttaccacatgcccaactggtttggcaccacaaaatacgtaaagcctctggtacagaagctgtgcactcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcaggtaaggtccttgttctttataggagaagggaacagaaaaaacggttcagtgaatttaggagtaaataaaaatttaagcatttatttcattaaacaaacacctgtggctttacccaatattaactgttaaagcagccctactcatctcattctacagataaggaagcaaacttcctggaaatgacatttctagtaagtggcaaggccaagatccaaacccaggcattctggctccagagtgcacattcctaaccactgtattgttgggagaattgccatgagaaccatgtcacattaaggaaatatgcttatacatatacaattaaggtgctcatatttagctcaaacttggactatatctccaaatagccagcttataacctaccatgaatctgccattcagtaatttatcctaactttcttgtgtatgaaacaggtaattgctctgtcaccaggctggagtgcagtggcatgtagtgagctacaacctccaactattgggctcaagcaatcctcctgtgtcagccttccaaatagctaggacgacaggcacatgccactgcccctggctaatttttaaattttttttgggagagacgggggtctcactttgttgcccaggctgatctcaaactcctgggctcaagcgatcctcacaccttggcctcccaaagtgctgggattacaggcataagccaccacacccaaccctaacttttattttagtcaagttttgtctggcatgagtttcctaagataaggtctcccatagactttacctatcccatcaaaatttccttggccaggtgcagtggctcacatctgtaattcagcactttgggaggctgaggtgggcgggatcacctgaggtcaggagttcaagaccagccgggccaacatggtaaaacccagtctctattaaaaatacaaaaattagctgggtgtggtaacatacacctgtaatcccagctactcaggaggctgaggcacgagaatcacttgaacccaggaggcagaggttgcaatgaactgagatcgtgccattgtactccagcctgggcgacagagtgagactctgtctcaaaaagaaaaaaaaaaaaaacaaaaaactttttcccccccgcttaagataataaaaacacactctggtgttataaaagggtataagaagggtttctttcttcctcaccccagccttaatattacttttggcacaggcctcgttcctgaagacattaacgtaatgtgttagagatcaaataggccaacaaaaagctaagattccctttctgaggatataactgagtgacaggagggaagaatcaatggacttgttttttttaacactcttctgtacctcattttccctacttaattcctaatgacataacctttttcctttctacacattagtacctctgccaatgtactcacatatttttacagatactgatgaaagattattcttaaaacagagaacacatgcaatttaagttccacatctagcttgtaaaaagtattttttatacatcagcaactagcctgtgaagtaaagacctgtttactatcatattccttaatacttagcttactgaacttatagttaacaggattgtattcaggctataaagtgattaggttgattaaagttcaggaggctggactacaccaatattgattcgtgaaaattatcccttagtgatattgaaagttgcaaaagccagaaaatagggtaggattttaggggtagatcacaacagtttttatttattttcagggtcttgctctgtcacccaggctggagtacagtggtgtgattatttttttttttaactgtaattatatgctgggcttgagctaaacaatctgaactagaatgtagaactgaaaagaagtgaggaaaactgagggggaggaaaaaaatattttgactttttttttttttaaccagggagtgagagtcaggaaaaggagactggaacaattggacattgttccaagtagcttttacatcatctaaacctgctgcatatcttaggtatttaccactctgagcactgtataccactagaaggggaatgaaaccttagatctgtagaggaaaactattacagaaactccaaaagttatagaaaattgcacccagcattagatagatggtactctacactaagaatctgctaaatgaggccaggtgtggtggcttatgcctgttaatcccagcactttgggaggccgaggcagatggatcgcttgagccctggagttcgagatgagaccagcctgaacaacatggtgaaaccccatctctacaaagaaatttaaaaattagctgggcttagtggcatgcgcttgtagtcccagctacttgaggatgggggtgctgaggaggatagtttgagcccaggaagttgaggctgcagtgagccttgattgtaccactgcactccagcatgggcaaaagagccagaccctgtctgagaaaaaaaaaaaaaaaagattaaatgaaaacttctacaattgggattggggtgaatccaactaatgtattattaccctaaatgtacagttgtactaaaagccttctagtaactaaagtgaatggaaatagaatacctcaatgaaactggaagaaattactccagtttcataagatccctcttgggcagtactttttagtcactagttttgctttgggattataggctgacattttctgattattagacagtttgccaatataaagattgaaatggaagaggatttttcattatcagaggactagtcaccattcctcaaacaatgcaacctttgaacacttttgctatttacttatcccatctcttgtgccattcttccttgctttaatggattgtgactctgactccagtatactgtttgatgcaggccaacctcatacggaaaattttcaccatccgcatttactgtaggattttaaaaaagatactgtggatcaggttaaaagtcttcttctattcctagtttataggtgtgttctgtcattaatggatattgaactttatcaaattatttcttatcagtgatgacttacctgttactgtggtgaattacagatatagcagagtttctggtttggaccactcttttgccactctcgtcacaatgactgtgaaaacttaatttgttcaggggatttaattgtccagaaattagtaagcagttttcgctgcaactatgtaacagtgtatggaaaacatatagacataattccatatattagctagacctgattttcaattcactttaaaatgttttcattgtaggaatcactatcttctctgttggtgtggcttgggcacctctggatgacctgaaagatatggcttctaaaccgaaggagtctcatgctttcttcacaagagagttcacaggattagaaccaattgtttctgatgtcatcagaggcatttgtagagatttcttagaatcccagcaataatggtaacattttgacaactgaaagaaaaagtacaaggggatccagtgtgtaaattgtattctcataatactgaaatgctttagcatactagaatcagatacaaaactattaagtatgtcaacagccatttaggcaaataagcactcctttaaagccgctgccttctggttacaatttacagtgtactttgttaaaaacactgctgaggcttcataatcatggctcttagaaactcaggaaagaggagataatgtggattaaaaccttaagagttctaaccatgcctactaaatgtacagatatgcaaattccatagctcaataaaagaatctgatacttagaccaaaagcaacattcgttctctaaccattctgtattgattatataagcaaaatgaaaagagaaacttaaatgaacacagctctttaacatggttcaggtacacatattttgacccaagtggatattttcttaaaaccaatcaataatagctagctattactgcagactataaaatctggatatagaaaggagacctgtatcaaactgcttttgtagtgtgttttcataacaacttatgactaaaaatatcacactgaataagagagcaggattgccaggtatttttctatttctctccttaattttatatgtatatagatatatttggcttatattctaagtcacctaagtacttaaaagttaagttggtaaagtatttactgactgcttataaacatttaaagacaaagacatttcaaataactgcagaaaaaatattgtagtttgaatatttaagcaataaaactgctagtgagttattgtaagctggcttacttttattactgctagtgtctcccctgaggatatggtaaaaattcatgtggaaagaccaatctgaattgttttttaaatcatgtaataataccaagaatattttttctttgattcaattatttattgaggccaagcacagtggctcatgcctgtaatcccagcactttgggaggctgaagcaggaggactgcttgaggccaagaattcaagaccagcctgggcaacatagtgagaaccccctctacaaaaaagaaaaaaaaattagccgggtgggatggtgcatgtctgtagtctgagctacttgggaggctgaggtgggaggactgcttgagccgaggaggtcaaggctacagtgagccatgatcacaccactgcactccagcttgggtgacagagcaagaccctatctccaaaataaaaaaaaaaataaaaagacacaagtttattgaatacctactgtcctaggcattatacacagccactacctgattaaacagtataagatatttttgagtacttgcttcaccagaaatgttttgtaattgacatcattttttacttaaaaatgcttgtgaagttggttcctatgaaaggagaacatcaggactcccttaatgtgacttagatgattcgcttaccaaggcctctcccaaaagacagaggtgctctatcatcccaccttgtctgtcttttctaaagataggtcctatctcctcctctcatccacctaagccccctgaaatgtgttaactggttagaataatatactccagtaaatcttctgagtcttacaattttataccctgcataagaggaataaaaggactacatgcagggagaaacaaactggaattgactttttcactacataaaaatttgaatttgaaaatagagtttgagaagacaacctccccttttataaaatgcttcaaacatgactgaatcatgtaacagggataattttaattaaacatcataaaaactgggtttagcatagtatgatttttccccagtaagtagaccaaaaactctcagctaggagtacaaccccttggaaaattaagctctaatgaaaacccagctaccactcattagcccttttaagaaagtggttttttctttaattttataaaggaccaagttttgagtcacctgaagtaaccagggaatagcagcaagacagcagaaatcagaactgtaggttactatcaataattatgtaagtaaacataatcaggataaaggttatttacaggagacagagtaaaaaggaaatacgtattacaatccaacttaagcaaacatgcttagatttcaaatatgctggcccatttataacttaatgcattaaatgcaatgttagtcttcaacaggtaagttacctagtttgaaataatgagaaaaacaacatgaaatgagaggcagaatatgattaactattgaagaaatcaacatattaagatttgtataaagtactatttaatagtgaaattaatctaatttcccatgtgtcaaatggaagcacacataatgaaaataagacattatttttgcatacctttagtctcttccaaatgtttaatactgcagagaaaaatacaaccaaaggagatagaacaaaataaacatatatactaatttttatccatttcagttttaatacattccaaaatacgtcaatgtttatgcattccaataatcatcacatttcagatcaatgataatgtactgggttggaataggtgctagaaacaattctagctttggaaaagcttattctttatttcaaaaaagaagaaacagaagaggagaaaagtaccccctttaatttgtcctttagttgaatgttcagttcagaaaaacaaaaaaaatggtatttaaaaaaaacttgctgggcacggtggctcacgcctgtaatcccagccagcactttgggaggccgaggcgggtggatcacctgaggtgactcaggagtttgagacctgcctg

SEQ ID NO: 14717 - DNA, 15061 bp, Human
gtgttctttccaaaaacaaggcaggcgcaggactcctgaagcaccgccggtttagcttttcccagacgtaaccgccgtcagagcgtggcatggagcctgtagctgtgcactgaatacttctattccaagcgggtcagtctttccagctcaccgctgggttctttcccttaccgtggtctcccaggcacttactgctgagaccccactcaggctgtctggttgtatcaggccccgaccctgtcagaacaggcctatggcgcccaaccacaagtcccccaattttctgaggaaccacagctgagcttggctgtgactcagtttccaggcccggctctggggctccacttgtccacccctgccgcagccccacaggcctgtgctcgctgtgtggggcttagggatcaccagagctgaagggcccctggcctccagtgggaatgccccaggcctgtccaaagtgcaggcagctggacggtcgtgagtcccagcttccaggcactaggacctgatgacgcccatggtgctgacctggagcaaggtcacagtgacacccccctctaccccccgcggctgcagctgcaggtggagctgacagctggcctctggccccagggtatctcccagggcctgctgggtgcggggcgctgggcagaacaaggcagcatggcctggccctgtgtcctgctgccagtgaagcaggcccagagtggggcagccacccacccaagggccagagcggggcctctccagggtggtcaagagcaggaaggtgtaagcaccggcgggtttcactgccgcccaagggaggggtcccggaggtgggggagcatcctggggaccccaagcccatgagcctgcgaatgttggggtcccatcagccagaggcgcacaagcctcgaagtgagaggagagcagggtctcatctcctatcctgagctgggcctgagcggagctgcccctgcatcggggccagcatagacgcgcgcggttggcagtggtctgttatccgctcctttctccaggcctcctctccgggattaagcgcctcaggacccgtccgccaggccacagcctgggctcaacctctcccagacttcctggactccagtggagccttgggccgggggcggggcgtccctggcccctcccccgtcgtcccgcctgcccggaaaggagtgagcggcgcctagtcccgggctggcgggagtgcagttctgagtcccgcccggcgtgcgcggagcggggcagccagcagcggaggcgcggcgcgcagcacacccggggtgagtgcccctgccggggtctgcggagccccagaatttcctgcccaccctcttccccctgccccggggaggagatcctggcgccccacccagttggctccgtgaatgcagctcagcccgccaccccgcagggtgtcaggccttgcggggggccacggaggatccccaagggaggaggagaaggatggggtgtttaccaacacagcccagcgttcccgggcctggtgtgcgcggagctttccccgctgctgcttccttggagggagggacccattctacagatggggaagctgagaccacacaactaggaagtgtcagagctggagaccagctgggtcatttgactccagagcccaccccatttggaatggagggggcgccagaccctctcctactgccttcccatcatctggaggggagggcagaggtgcagagagacctgctgggttcctggaggggccaggaaaggggcacagggtgaggagtgggctggagcctggaccccagggccgcaggatggaggcgtattcatttacaccataaaagtggctgggtgacccctggctagagcggggaccaagggggacaggggtagggggtgagccagtggagcctcacatgccaggcacgggggctgatcacgtccccacacctttccccccgcccattacaggttgttcccccaccccctgggaagtgctggaaggagcccggccctcgagccctcggcatagtggctgtgggagccctgatggccctgagccaggggtgacccctccccagatccccagagctgattccccacacctccttatttggccagcacagccccaaagggagccaggtcagacacaaccctcctctgagctcaccctttgtgctgggcacataacattggactttacctctccaagtgtcagtggagtcctgtatgaaacaaaagcaccgtaccccctccccaagggtttctccccccagggattagtgtgaggtcgtgtggatgaagggattcagttgaggctctggttatttttgtcacctccctagatcctgtctctgtcaggggtgccacgtcccattcacccaaagaggaagtagaggcacagagagggtgagagacttgcccaaggtcacacacccaatctcagcctgggctccaagtccctctgccctgtggccgggcctggtccttagggatggaacccagccccgctgccccctgccctgcccacctgcagccttgggccatctgctcagtgttccctcgttccctccttctctcctttcccaggctggggctggggctgcgtttccctgtttagagttaagtaaaccagacccaggggaggaagtgactggctgggcaggcggggccctgaccaggcctgtcccctccccctaattttcgagctaagcaactgattcccacagaggggccctgggccctgagagcagtggctttggagctggaggggccccagcatccagggcgggttggaggtggcctggcacctgcccccaccccacatcggccttgagcaaggccccgggcccttccccgccattctgtagtttcacttttgttggtttcaacacctggaaggctgcggctgctgccgggcggcccgggcctcaggggacagcccccccacagcagtgctccctggctagccccagggtacccggtggagatgcccgctcctaccactcagcacatgcagctccacagggagcagcgagggctccagccacccccggggcagccctgggcctaagtgcctgggccagtggggtcctgtctagggtgacggcagcccgagaggagggaggccagagtgaaggtgggggtggagccggtgtcactgggagacgctggaggtaggggcgggggtccccatgggcagagcaagccaggagagagcttgaggtcggcctgagggtgggcttcggggtctcccagtcccactgcttactttctgcgtgacctcagcaccgcatcaagcctgcccaggcctcagtttccacctctgtcagatgggggtggtaacagcagcttccaggattcagtgagtgaaggtgcacaggtgcccgtggttgggaactgtctgtggtctgcccctgactggcccccatccgtgtccacccacaggaccatgggctccatgttccggagcgaggaggtggccctggtccagctctttctgcccacagcggctgcctacacctgcgtgagtcggctgggcgagctgggcctcgtggagttcagagacgtgagttgggtgggcaggcgtgggaagggggctactgccaaggttagcccggaggccggtccaggatggggactgccccccctccgccatagggccctggccccatttgaaccccagcggcccctgccatgggcactgctcatgggaagcccgcagctgaggcccctgagctggctcctccccataccctcctggggcatggggtctggtctgtgctctgatctgcgtcttgtggctcccagggcactccacacctttctggaggaggcagctaaggcctggggagagtcaggcctgggctctagggtgaggagctccctgacccccttcccgggacactcacccctccgtgtggcacccacagctcaacgcctcggtgagcgccttccagagacgctttgtggttgatgttcggcgctgtgaggagctggagaagaccttcagtgagttggtcccaggcctacattccaggcaggcttcctggaggaggcatgggccaagtttgatctgaaaggaagagtctgggtttgccaggtggaaggcagagaagggaggtatatgcagggccctgcagggccaagacagagcagctgggatctgtgaagtgtgcttgcgaaggtggctgccttgtgtgggctgagcagagggcctagggcagggctggctggggaggcctcgaatacagcataagagcccaggacttcgtcctgtgggcgccaggaagccacaggggtttctaagcagggaagaggcacagacagctttctcctctacagctgggctggggtgggtggggcccaggatctagggtagggtacccctaaggagcaggcaaaagggacccctgccctgggcaacccctctcaggaggagcctgtgggggcaccaaggcaggggcatggggcaggcagggttttgtgtttgctggtgcagtttacagcttttcaatgatcaggcagacacaggactcacgccagctccggtcccaagccctgcagcgcaagggccggcctgtggggagacctcaggccctcttctgagtggtggccaagggactggggagggagagtgagcccagacctgagctcagggaggggagcacagcttctggatgaaagtttggccgggattttctggccacctccacctggtgaatccagcagctggtggccgatggagtttggggcagcaggtggggccctcaactgttgagacaacctcaactgcaccccactcccgttcctctgcgcccagccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcaggtcagctcccacccaggcaggagactggggggctggggaggggctgtccagcctagggctcatggtgcttctgggttcctagctggcagccgcccacacagatggggcctcagagaggacgcccctgctccaggcccccggggggccgcaccaggacctgagggtcaagtgagtgagggatgacctcatgccctttctggccagcccagaacccctggccagtcgctgggctgggccaggctgagctccgactccttgtccagtgctctccccaggctggccccgcctcctccttcaggcccggaacttcccacagtcccaagccctagccctagggggttctcctcttctggtcctgcccgggaggcctcctgccttcccctgtgggcagggccagtgtgcccaattgcccgattgcccgtgctgggcagggtcctgcccggggggcctggtgggggaggcagggcaggaggttggagcagccctgcccagccccgtggccgccagctttgtggcaggtgccgtggagccccacaaggcccctgccctagagcgcctgctctggagggcctgccgcggcttcctcattgccagcttcagggagctggagcagccgctggagcaccccgtgacggtgagcagctggcgctgggctggggggtcctgggcagagcgggaccccagagtcagctgagcctgctctgcagggcgagccagccacgtggatgaccttcctcatctcctactggggtgagcagatcggacagaagatccgcaagatcacggactggtgagtcactgggaacacccgccccaccgccctgctccccaggcccctgctgtcacctcccagcccgccctatcgtgactcctccccatgagctcccttcagactcagagtctcgtagctgtgtccttctggcccctcacgcagcgcatcctccctccagcttccactgccacgtcttcccgtttctgcagcaggaggaggcccgcctcggggccctgcagcagctgcaacagcagagccaggagctgcaggaggtgggtgcccccggccttccggaggcgggtgtaggaggtgggtgcccccggcctcccggaggtgggtgcaggaggtgggtgccctggcctggcctccaggaggtgggtgcaggaggtgggtgccctggcctggcctccaggaggtgggtgcaggaggtgggtgcccccggcccagcccaccccacctgcctgcccagcccccgctgactgcccactctggcgcaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcggtgagcagcctgaggcctcgccccctctccgcccgcccctcctaccaggccggggcgtttctgcctcacttccagcctctggctccctgcacctgggctttgcctaggggctccttctcctcccagcctcctccatggcccaccgcttccagggagtctgccctgatggccctggcccagcaagccctaccctgactttcctaagtccctggaggctgcacaggatagttttaaagtcagaagcctcattccaatccaggcccccctgtgaccttaggcctgctcatggtctgtggaaccggtgtgatgcccctgcctccgggggtcacccgccgcgcacagcaggtgcttgcgggtgaggctgggctccttctcctgggccgtccctaggaggcagcatgcttgcctttcccaagcaattgccaatccatgtggtgtctttgggcccccaccagggcagagcagggctgatcatctcacgtcagagagaggggaaggggctgcccagtgagcccccacagggctctacatctccagctgggcctggctggagatcccagggtccctgaaggcccccgccaccgttctggtctgtctctgccctggcacccagatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccggtgagagccacggcatccttacccgtgtcctgggaggctcagctgccccactgggtgggtgtgagcctgagggggaggtatctccatcctgggcctggcctgccctcctgggatgaggggcacacatcccatcactctcaaggggctgttgggctctgcagccagtgtgaggctttatgtcggcccccagccaactcccccttgttgagtttacaagggagccggcacgggcttgtgcaaagaacagaggctgtgcggtgggcatggcccaggttggaagcccatctcgcctactttgagacatttcttagcttctctgagcctcagctgcctcacctgcaaaatggaaataatagcgcaaacctcagaggaatgttgggaagcttagtgactgttggagactgcaagctggagccaggggcagcctttggtgtggttgctttggttgcacagctttttttttttttttgagatagagtcttgctcagttgcccaggctggagtgcaatggcatgatctcggctcactgaaacctccgcctcccaggttcaagcgattctcctgcctcagcctcccaagtagctgggattacaggcacgcaccaccacgcctggctaatttcatatttttagtagagatggggtttcaccatgttggtcaggctggtcttgaacccccgacctcacgtgatccacccacacaggccgttgggggcccaagcaccctgactcttgcccactggatgaggcagggcccctccctgtcctgtgaccaagtcccctcccgacatgggctccaccacatcacacccatgctatgggccgggcccccactcagtgtcactgggggcactggggggtttgctgcttctgcagggccagtgtcctggggctggatctgggccccaacaggattcccctgcacgtgggcagaggctggtgcagctagagcatcacctggaggcccgtggcagatagaatgctgccagctcaaagcaccagccgtcggggcagcgtgtttgccagggaagctgtaacaaagtgccaccggctactggcttaaggggcagacacggtcccacagtcctggaggctggaagtccaagaccaaggtgtcagcaggggccgggggcactggctgatgcctgtgatctcagcactttgggaggctgtggtgggaggaggatctctggagtccaggagttcgagaccagcctgggcaacatagcaagcccttgtatcttaaaaaaataaaagatgatgaggtgttgtcagcaggagtggctccttctgaggctgtccaggaagatctgttcccggcctctctcctgggcttggagcggccgtcctcatcttcacacgctgttctccttctatgtgggtccaaatgttccttttcataaggacatcgggcacactggattggggcccactgtaatggccttatcttaacccagtgacctctgtaaggaccctgtctccaaagaaggtcacatctggagttcctgggggttgcgactccagtgtatcttttttggggtcacaacacagcccctgacagtgtgtatgttggggtcctcctgcctcccatgaggacttgttcccattttactgatgggaagtcgagacttcagagctgaagtgaccagctcggcctcccggaacttgccatgtgccagctggggctgcctgtggctccctgtcctctctggcttctgtgtggagctctgggaacagcaacagctgaagctgctaacttcctgtggctccagcagctggcccgtgctgcccgtggagaacttatgaagtggtctggtgttacctgcattttacagatggggaaatggaggctcagagaggtgaagtggctgggccaaggtcacacagctcctaagtggtgggttcttttttttttttttttttttcggagacagaatcttcgctctgtcgcgcaggctggagtgcagtggcgcgagctcggctcactgcaacctccgcctcccgggttcaaatgattctcctgcctcagcctcctgagtagctgggattacaggcacctgccaccatgcccagctaatttttctgtttttagtacaggcagggtttcaccgtgtgggccaggctggtctcgaactcctgacctcgggtgatgcccccccccccccgtctcggcctcccagagtgctgggattacaggcatgagccactgtgcctggctgctaagtgatgggttcttgactgcaggccagcagggcctccgtggcgtcttgggccgggaggcagatgctggtgtgttcgggggttcccagctcacccacctctgcccacagctccctacaccatcatcaccttccccttcctgtttgctgtgatgttcggggatgtgggccacgggctgctcatgttcctcttcgccctggccatggtccttgcggagaaccgaccggctgtgaaggccgcgcagaacgaggtgaggggcggggctggggtcctgatgagggtagcagggccaggcagcccctcaccacaccactgcccccccagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggaggtgaggcccgggccccagcccggctgggggccccgcagcacccgcagccctgaccgccctcccctgcgttgccgcagtgatgcattcctggcccagcacacgatgcttaccctggatcccaacgtcaccggtgtcttcctgggaccctacccctttggcatcgatcctgtgagtcctgggatggagtgtccgtgggtggtgaaggcagctgggagtgggggctggggctcccctcggttcagccgtcctgcagcgctgtcgctgagcactcctgtgtgccaggccctttcctcagcacaagaggcagacaagcctcctgccctgcggagcctgcatcacagtcccctgagtgtgcggaggcaaagcgagaccagccaggaaccagtctcctgagtgtgcagaggcaaagcgagactggacaggaaccagcctgcagcttgcactgtgccaagcactgttcccaaccctctgtggaagtgattttcttttttcttttttttatttttggatatagagtctcattctgttgcccaggctggagtgcagtggtgtgatcttggctcactgcaacctccatctcccgggttcaagcgattcccctgcttcagcctcctgagtagctgggattacaggcgcccgccaccatgcctggctaatttctgtatttttagtagagacagggtttcaccatgttggctaggctggtctcgaactcctgacctcatgtgatccacctgcttcagcctctcgaagtgctgggattacaggcgtgagtcaccgcgcccagcctgattttctatttgaacctcgtaacaaccccgtgggcctcacattagtagtgtcctcacctaaagaagagactgaggcacagaggtcatgcccaaggtcacccaggctggcaccgtggcagctggcccatctgcgctctgttgcccctcggtgggtgggtgatggatgaggctgcaggctccgagggggaaaacagggtggtgagagagtgactcgggccggggacttcctggcagtgatggcgagggagcccctgagtccagcccacccctgctgccaccctagatttggagcctggctgccaaccacttgagcttcctcaactccttcaagatgaagatgtccgtcatcctgggcgtcgtgcacatggcctttggggtggtcctcggagtcttcaaccacgtgtgagggccaaggctgcccgggggacgggaggctggcaggccagagtgggccccagtgagcacacctccctcttgcccgccaggcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggtgggctgcggctggtgggggccgggctcacacggcctcatggggaccccgcggtcacagggccactgggagctgcaagatcctcgtccgagaaacggggatgcaggccccgggccgtgcagacagggccgtcagaggtgatggtgtgcatctttagcaggtggcacaactggcactgggaaccgggggtcccttccctcaggagtccttatggaggcagaccctcacccagtgagggcacggagcccccgggggccctggagggaggagcgaccgcaggctctctgggccccgtgactgctgtgactcaggttcctttgcaggtgtgcacagcagggacgccctgactctcgccctctccctggcaggaggtggtccaggccacgctggtggtcctggccttggccatggtgcccatcctgctgcttggcacacccctgcacctgctgcaccgccaccgccgccgcctgcggaggaggcccgctgaccgacaggtgggaccggggcctaaggtgtggggggctgcttgcggggagaggccactgtccggtgtgtccctgactcctcgcttcctgacagactcctgagtggccaggagcaggcctggcgggtggtgggggacctcctggggctggagtgctgccaacactgcctgctcatgccccaggaggaaaacaaggccgggttgctggacctgcctgacgcatctgtgaatggctggagctccgatgaggaaaaggcagggggcctggatgatgaagaggaggccgaggtgggtgcagtgccttcctgggggtgggacggctgaggccctgccggccctcactgcacccgccccgcagctcgtcccctccgaggtgctcatgcaccaggccatccacaccatcgagttctgcctgggctgcgtctccaacaccgcctcctacctgcgcctgtgggccctgagcctggcccacgcccgtgagtgacctggccaccgacggctggccccagctcctggcttctcacataccgctgctggctgggcgggttgcttctctctgggcctcagtttcccctctgtaaagtgggactgtccaaggaggtccctcgctggccccccgtgcagggagggcttcaggctgcggcaggtaggtagggggctggcaggcacccacttgccgttggcccccactgtctcctttgcttgcagagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactggtgagcgaccacccactggcctgggctgctcaaggcgtgagttcccctcaccaacccctctgcttctcacccccagggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggcagtgatgtctcgtctctcttccctcctttttagctgaggcaggtggcagggtagaaggcatggtgtaggatctgggacctcaaaagtcaaggcctggacctgagcagatctgcaataatgtcagactcttggggtgaaaaggggcagaaaagggccaaggagagatgtttccagcacattctaacttggagtgagcaaatgtcttcccaggccgggtcaggggagtgagctccccatccttggaggtgtgcacctggctgtgagcgggtgtctgggttactctctgttgggagtggtgccaatatccatgccctggtgccgggcctcaggggtctggaagtacagagcagtgtggggcacctgagccccggccagtgctccatgcagggccatggtgtcacacgcccaaggccacacacctgccaggaagggtagaggctgtccccagcagcagacattacccaggaccccggggttcagaacaggggctgagcctgactccaggcccagcctcccctcacctgagactacagtcttcctgatccctcccaggtggtccttcctgcgttgctggcagaatgggggtggctttctgcagttccctctggcctgggtcccacccccactgggaggcagaggaagtgcttcccagaagccaacaagctgcaaagtggttcttcccacagctgtggctgaggccagctgctgggaggagcctgtccattggctcctggactgctttgctcaggacctctggatgccaggggtcgtatcaggggctctaaggtaattccacatgcccagcagattcagcttagagaaacggtgctcacagtgctggggtaggagcagagaaggctaaatgaaggactccggagagctgcaggtggatctggaccaaatccagaacccaacgccttactccctcctggggagagagctgggcagagacttggggcgggcagtgaggtggggataggtgagcagcactcgtggtgagtggccccagtgtgatttaggaggggtgcagtgtgggatcccagggacatgaccagtcagccccgccctggctttgacatgggggtgcctggcagtggtggctagagaagtccagtttgccaagagaatggcacataaggcactggggtgggcacctctggggcatggacatagggagacatagggatggggtgggtcacctgcgtggaggactgggcactgaacagcacaggcccgagcccatccttgtccacgtgagcttatggcctgatgtagagaccaccaggggctccaggaaagttaagctgcatggagagaaacgatgggccagggccgggcccagggtggtttagggaatggcagtgtcctgggtagaataggaaggcctgagactgtgactgagctgacagtggggcaaagtgaaggagcccagtattggaagatcggctccacatgtatctctgcgaggagactgcaagcgagctcgtgtggaccaggcagaggcgagggctgagtgaggccagcagtggcctgggcacaggaagacggtgagtgagaagccactggagctcctgtgcaggagcgcaacacctttactgcttcattcagtttggcttcacctgcttaaaactgtaactctctagaaggctgaacagcaaaagcctccctcctgcccagccgctcagcatccccaggcaccagcactgctcccagtctccaacgtcctccagggctcttcgcttctgggctagaagcagggaaaccagagtgtgctggggaagaagaggaggaggtggaggagggctgatgatggggccacatgctgctgggatgccagctgagagcagcggagcactgctaagctaaggggctgagtgggtgcagatggagccctccgtgggctccttcaggtaccaggagccctgcctgagattcaggacacatccaagggtgacagcttgaggttgggtttttatttttttatttgtatagtacaatctct

SEQ ID NO: 14718 - DNA, 15061 bp, Human; identical to SEQ ID NO: 14717

SEQ ID NO: 14719 - DNA, 18591 bp, Human
  misc_feature (1)...(18591): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaggctcatgccaccatgcccagctactttttgtatttttagtacagatggggtttcaccatgttggcaggctggtcttgaactcctgacttcaggtgatccgcctgccttggcctcccaaagtgctgggattacaggcatgagccatcacgcctggcctctggatggacttttaaagagagacttcagtaaaaaatatagttcgcatttagtgagcactagtgtctgccgggtactgtgttcagctgttttatatgcattatttcatttaatccctacaacagtccccactgggaggctgaggtgggaggattgcttgagcccaggaggtcaaggctgtagtgccactacactccagcctgggtgacagagtgagactccgtctcagaaaaaaagaacaaacaaaaaaccccccgagaaataaaagatgaagaggccagaggagtgagagcctcaatttacccttgtatatctgggtaaagatcatagagctcataatcttccttggaagaagagtgtgcctttccccctcgtctatatatgtcttcgtaacgtgcatatggttactttacaacaatagttttgatgttcttttactgcactttataaaaacgtttgccgggcacagtggctcacgcctgtaatcccagcactttgggaggccaaggtgggtgcatcacttgaggtcaggagtttgaaagtggcctgaccaacatggtgacaccccgttgctactaaaaagacaaaaattagccaagcgtggtggcacatgcttgtaatcccaactgctcgggaggctgaggcagaatctcttgaacccgggaggcaaaggttgcagtgagccgagatcgtgccattgcactccatcctgggtgacaagaacaaaactctgtctcaaaaaaaaaaaaaaaaaaccaaaaccaaaaacaaaaaacaacattgttttataccagctaacaaataccttgtctacctgttttggttcgctgatggaagtgtttgtgctttcctaagcctttgaagatgcagacctcagcttagttgttccatcagctctcttcgctgctgtgggaacagctggccagaggtgtaccactgcgaggcgactggtgagtatatctgcataggcccgattgtcttgctcttaaaacactactttttaatgagttctgctgttagagaggtgtcagcaatactgctagaacaacatgctctctagatgtggctggcaaatatgtggtccagttctctttctgtgctcatggcagatgttgttaatcattcagggactttgcctttttcccaccccaagataataggggttccactaccaattgactggagttggactaggagatgagactgatattcagtcctactcctagaacaatatggacgaagtccagtgtcatttagagaacaaaacaagataaaaataaaaagaattattaaactatagctaaaaatagagtcttgcacttttataaaaacattttaagtagtaaaacattttaaacattttagactgggcatggtggctcaagcatagaattctaacactttgggaggctgaggcaggagtattccttgagcccagtagttcgagaccagcctgggcaacaaagtgattccctgtctttataaaaagttaaaaaaaattagcaaggcatgatggctcatgcttgtagtcccagctacttgggaggctgaggcaggaggattgattgagcccaggaaagggctcaatgaggctgcaatgagccatgattgcaccactgtactctagcctgggcgacagggcaagaccctgtctcaaccaatcaatcaataaacacttttatttttagcctcaagtctagaattagatttgacttgaaatgacatgattcattgaaaagcaaatggctatgtatatgtgtgacctctctatatacatatatagcctgcatacatatatatatcgagaggacagattaatattaagtgtatataaggagatgtggtttagcttcaatatgggatttgggaagttgaatctctacacttagattgagctggtcttgagtttagtatgtgttacaactttgattttcatgactttatggtactaaaagactatactataactgagcaagttttttttgttttgtttttgtgtttttttttttttttttttttttgagttggagtctcgctctgttgcccaggttggagtgtagtggcgcgatcttgctcgctgcaacctccacctcctggattcaagcgattctcctgcctcaccctcctgagtagctgggactacaggcacgtgccaccctgcctggctaatttttgtatttttagtagagatgacatttcaccatgttggccaggctggtcttgaactcctgacctcagctgatccacctacctcggccttgcaaagtgctgggattacaggtggaagccatcatgcccagccctgaggaagttttagttaggtacaaaatttggctgcatttgccatttaaaaaaaattatttttaagctctgttggacttgagccttttttattattgttgagttttccttttgtaatgaaaaaagccttcagttgaattattaaggaattggctttgggtttttgctctcattcatattgagtgtgaacaaattctttataagactgacataatctaaattaattagaataagctaaaagatatatgaaaattatctttaccttacacttttcttttttctttctttcttttttttttttgagatggagtctctctctgttggccaggctggagtgcaatggtgtgatctcagctcaccgtaacctccacctccaggttcaagtgattctcccacctcagcctcctgagtagctggcactacaggcacccatcaccgtgcctggctaatttttgtatttttattagagatgggattttgccatgttggccaggctggtctcaaactcctgacctcaggtgatctgcctgccttggcctcccaaagtgctgaaattacaggtgtgagccaccgcacccggcctctcacacttttcatatttgttttttcaggtgttttgcataaatgaaaataaatctttatttttacatagctgacattctcaaataatctgatactacatttgtaactttaaagtttattaaatttgttcaccataaacattaaattgcgttaaagattacgttaaagctaagaaaaaaccatgcactccaaatgattatacccttcattacatggtaaaatatgaaatgacataaaagccaaatatttctctattcagccaatttttatttttttcatgtgttttggagcaaatattcatagacgtcttttatattagttttaaatattaataggtaatattagtcattgtccaaatagatttccttagagttagcagtaatatttttaaaaattccattactatggactgcttcatgactagttctcataatgtcaattcattcatcacatgtggagactaacccagagcatagatggtttggcaagttcagctctgccacttggagcatagcatggacctgacaactacccagagaatgcaagggttgtcctcacctaattaaggcctcctctggagacctgtgtggcctggggttaagtgtttgtagttacccagcagaggtcagttatgactatgctctgtgttcactgggacttagggttacagtatgggacacatgtacttgaggccttctttaatgtatttgtgaagcttagacaaatacatccttggaaacttgatgaagatgtggcttatggaccgggtgtggtggctcacacctgtaatcccagcactttgggagactgaggtgggtggatcacctgaggtcaggagttcaagaccagcctaggcaacatggcaaaagcctgtctctactaaaaatacaaaaaattagccaggtgtggtggtgggtgcctgtaattccagctgctcgggaggctgaggtataagaatcgcttgaacccgggaagtggaggttgcagtgagctgagatcatgccactgcactccagcctgggtgacagagtgagactctgtctcaaaaaaaaaaaaaaaaaaaaagacatggcttatgattttattctattatctacctaaaaggaaaattttgacttcatatagttaatattaaaatgataaattatataattaaaaaaataaacatgctttgattttcttatatttttagagattacagtatttcagtaactatcaaggaaattattcattgtttaaaaatgtgtgcatttatcatactatgcccttgaatatcttttttcgtttagtttatacatgaaagcatccatgatgaggttgtaaacagacttaaaaaggcctatgcacagatccgagttgggaacccatgggaccgtgagtatctccttctgctttcaaagcgatccctttttgagagctgttgttaacaagtgtttctgatctgagttttggagtttctttccctttcctgagaggcgtgaaggcacatgaagcaggttattaggctttggtgtatcgtgtctgctcctaggtttcgaccctggctgcttgatgtgtgctagtgggtgagactgggagaggttgtttagatggaatgagatttagtgtgcttctctctcattactattacccttgtccaagccgacaccatccctcttgtgcaaggctgcaagaatcccctaactgacctttctgcatccattgctacagaatgatttttaaaatgcaatcagataattcactctcctgcttaaaatacccctcagtaacttctcattgcttttagattttttttcctttcttttttttttttttttttttgagacacagtttcactctgttgctcaggctggagtgcagtggcttgatctcagctcactgcagcctccgcctcctgggttcaagcagttctcctgcctcagcctctcgaatagctgggattacaggtgcattccaccacgcttgactgattttcatatttttagtagagacagggttttgccacgttggccaggctggtctcgaacacctgacctcaagcagtctgcctgcctgggcctcccaaagtgctaagattacaggtgtgagccattgcgccaggcctgcttttagattaaaaccgagagtcctcttgatttcttcttttttgcaggctcccgatccttcctggtctgctctctgcctcctgccccgcttgccttctcaccagcctttctgtgtctattttccctcttgctcccagagctccaccttctccaacatcctttcagtgttccaggcatgccaggctctatcctactgtgctgtctgctggaaacattcttcacccagagtggggatggctctgctaacatgcctcctcctcatagaggcctacctacatcttccttcttctttgttgctgggtcactgtcagtgctctagtccccagcagccataacataggacagcatcattctcttcccccttgaattatacaccaactactgagactgtgatgtttccttagagaatggtcacactgtaatgagtaaactgaccctatattttgagtgcagtgctttgagtaattgatagccattcctttaaactagagattggcaaacagacttggctctgcctgtttctgtaaaaaaaagtttctcggcacatacccactcatttgcatgtcatttatggctgcttttgcactacaattacggagttgagtattgggatggagatcacgtatgtcctccaaagcataaaatatttaccatctggttctttatggaaaaaggatgctgacttatgttctcaattgagagcatataggaagggattggtctgttcattgagaaagctgttctaataataaaacgatgccataaagggcaaaatgatgagccagccttccttttctctctccagctaatgttctctatgggccactccacaccaagcaggcagtgagcatgtttcttggagcagtggaagaagcaaagaaagaaggtggcacagtggtctatgggggcaaggtaagggatgctctgagatcaattgtgacagctttttaaccttcttttccctgagacacaagcagggctctgggcatattggaaaagccaccccatttgacatccttcttctcctgtctttatttatatatattattataaaacaaggaaacacatgtttttgtttgtttgtctgtttttgagacagagtcttactctgtgcccaggatggagtgcagtggcgcaatcttggctcacggcaacctccgcctcccaggttcaagtgattctcctgcttcagcctcccgagtagctgggattacaggtgcatgtcaccacacccagctaatttttatattttttggtagagatggggtttcccatgttagccaggctggtctctaactcctggcctcaagtgatccacccaccctggcctcctaaggtgttgggattacaggcatgaaccaccacacttggctctgtttgtttttgtgacagggtcttgctctgccacctaggctggagtgcagtggtgcacgatctcagctcactgcaccctcttcctcctggactaaagcaatcctcccacctcaggctcctgcgtcttgctctgttgcccaggctggagtgcagtggcgtgatctcagctcactgcaacctcgcctcccaggttcaagcgattctcctgtctcagcctcccgagtagctgggattacaggcacccattaccatgcccagctaatttttgtatttttagtagagaaggggtttcaccatgttggccaggctggtctggaacttctgacttcgtgatccactgtccttggcctcccaaagtgctgggattacaggcgtgagccaccgtgcccagccagaaatacacgttttaaagaatgacaacaatgcttgctttggcagcacatatactaaaattggaaagatacagagaagattagcatggcttatgcacaatgatgatatgcaaattcatatccgtattttaaaaagtattccatattttaaaaaaagacagcagaaaatgcatgggacatttctggaaggacatagaagaaacggagtcatggttgcttttgaattgggtccttaatatttgtatggaaaggaaaattccttttcaagtacagtaggagactttgtattcagagcaattataatctatttattggttattttaaaaagtcagttaaggcaaggaataaaaaaatacatatcataagcattaaaaaagaaattaacacatattgccaggtgcagtggctcacacctgcaatctcagcactttgggaggctgtggtgggaggattgcttgaggccaggaattcaagacccacctggacaacatagtgagaccctgtctcaaaaaaaaattagctgagtatggtggcatgcacatgtagtgctagctacttgggaggctgaggtgggaggattgcttgagcccacaagttcgaggctgcaatgagtcatgatgatgtcactgcactgcagcttggacaacaaagcaagaccaaatcaaaaacaaaaaaccaaataataaaaaaaaaaaatcaaaaacaaaaaaccccccacatataaagatttgtttgtggccgggcatgttgactcacacctgtaatcccagcactctgggaggctgaggcaggtggatcacttgaggtcagaagttcaagaccagcctggccaaaatggtgaaacctggtctctactaaaaatacaaaaaaaatttagctgggcatggtggtgcatgcctgtagtcccagttacttgggaggctgaggtgggaggatggcttgaacccgggagacggaggttgcagtgagctgagatcaagccattgcactacaggctgagtgaaaataaccgcttgcagcagtgtttgttcaacataacttggttgtgtcacatggcatggctctctatccctgcctgactccttatttccatttttctctgaccaactaagttagaaccaatatcaggaagagagaattttctttcatgattggaagttattttggagaaataattcacctataaatgatgctaatttttttctttataaatgtaggcaaagattgcatcctctgaccccaagtcctagaaaacaaaatgctttcattctttttatttcatttctctgcattaggttatggatcgccctggaaattatgtagaaccgacaattgtgacaggtcttggccacgatgcgtccattgcacacacagagacttttgctccgattctctatgtctttaaattccaggtaaaaatgcattctgttcgctagcctaatgttgaaataaatgataagaggaaaatgatggtggattaaatttcactggatgaacctttaagagggttttagaaagtaatctgaatagtagatatatgaaggttcaggataaaatatgagataaacactttaaaactctatagcatgccaagctagctgccagggaaaccagattgggtagtggactagtgttggagtttatgaagtgtgtggtcctcatttcctgtgtcatcttaatcctgggctgtgtaggccatagagtcaccttctcctgaaccgtggtactggatagtttgatagcctgagtgctgtgaacatgtcagcagacaaaatgagaacatgtgggggtaatacaaagacctatagttggccaggcacggtggctcacacctgtaatcccagcactttgggagggtgaggcaggcagatcacctgaggtcaggagttcgagaccagcctggccaacatggtgaaaccccgtctctactaaaaaacaaaaaaattagccaggcgtggtgttgggcgcctgtaatctgtaataccagctacctgagaggctgaggcaggagaatcacttgaacccaggaggctgaggttgcagtgagccgagatcgcaccattgcactccagcctgggcaacagagtgagactccatctcaaaaaaaaaaaagacctatagttataaactccagcagaggacaggctgcggagttttgttttgttttccctgatctcatatcttgatctcaaactgtaaaggttttaataggtgaagaagctgggcacaatggctcatgcttgtaatctcagtgctttgggaggatcacttgaggccaggtgctcaagaccagcctgaccaacacagtgagaccttgtctgtacaaaaaaattaaaaaattagccaggtgttgtatgtacctatagtcctagctactcgggaggctgaggtgggaagagatcctgtctctaaaacaaacaaataaataaaacccaaaaaacccacacaggtggataaattagaagatctcattccctagcttgagacgggccctagcctcgccagtaaatatttaggattaattttgagactgcagagattgaatcaatatttgaatgtaccattattaacagtaaaataatagtgagaattgcatcttgttgcaattacatcattgcttctttatttcttgctttaaattgcctatcattgtttcacgtatggggactagagaatataattttgtgttttgtaatgtgtttgtgtacattatgaggctgtgtgagctcttgagcaaattagtctctgtaggcctcagttgcccaatctgtaaattgggaggtagtaggaaacctgtgttataggatgaggattaaataactaaatgcatgttaagtgcttagattggtgtgttacacacgtaagagctcaatagatattagctattatatgtagtagcttgaatgaaaggaagaatgtgttaatatttgtttctgataattaggggaaaaatcccaaaattttttacttattatcaatgatctgaattataagagaaacagagtgagtaaacttgactctttggtttccttttgtacactgaaattatactggtacacttcaggaaatgagtttaatgtcagtgaactttgacttgaacactataacatcttacagcttccaatgtctctccttttagaatgaagaagaggtctttgcatggaataatgaagtaaaacagggactttcaagtagcatctttaccaaagatctgggcagaatctttcgctggcttgggtacaactttgtctattttgaaaatttatataagtctgatttatgtggtgagtggacttaaaaaaactgctgtagtctaaaatcagtttttcagtattgaaagcctttgagctttggtttagattttttatttatttttgtttgtttttaatttcctgttcattgctctcaccatgcctccctttttacacagacctaaaggatcagactgtggcattgtaaatgtcaacattccaacaagtggggctgagattggaggtgcctttggtacgtagagaatcatttctccttttccatgttgggcagcaaagaaaaaccagtagtagcttttagaaaaggctgaccaagagactgaaacactccttatattctgaaataaccttatgtgatctaacatatctgaaaaagcttacattctgtattcaaagttatcgcatagagtcctgcgtcatctcctcagaggcagcatcaggttagagcagaggcccttaacttgaaatgtgtgaacccctgaaatggtggcatttgttttctggggagaagtttccagacccaaaaaagattaagaatccctgcttcaaagccagaaaattttatatgaaatattctggtttttatttgcaaagtaggcatataaatgttaaacatactctttttcactagatggaatacaaagttgtttcttttcactgggccctgctcctgtttcctcttaataagccatacattattaatgctgaaacttggtagtagtttttccttaaaaactctccctaaccattgtatattaagtattatttattaaaaatgatccaaagtaaaataaaacagattgcttgttttttttaaatatagaagcaaaacaaacatgcattaatacttgtaaaagtttatatcattagtggcattcttttacatttttagagcagatactacaattactatttgatgcatggactttgctgttttcagttcaccccttgcccctgcactccactgtgcagttgcctgaatgcatgagtgtctatcttctccttttgtactaatttaatccctgtttccaacccatgcctgctctctctgattgactattccttttttttttttttttttttttttgagctgggggcttgctatgttgcccaggctggagtgcagtggcgcgatcacagctcactgcagccaccacctcccaggctcaagcattcctctcgcctcagcctcatgaatagctgagattacaggcatgtgcctccacaccagctaattaaattttttttttttttttttttttttagaaacaggccctcactatgttgcccaggctggtcttaaattcctgggctcaagccatccacctgccttggcttcccagagtgttgggattacaggcatgagccactgcacccagtcaattgactattcttcatttaagcttttataattaatttttaaagttttggtgcccaggcacagtagcttacacctgaaatcctggcactttgggaggcagaggtgggccgatcgcttgagctcaggagttcaagaccagcctgggcaacatggcaaaaactcatctctacaaaaattacaaaaattagctaggcatgatggtgtgtgcctgtagtcccagctacttgggaggctgaggtgggaggatctcttgagtctgggaggcagaggttgcagtgagccaagattgtgccagtgcactcaagtctggggacagagtgagaccctgtcttcccccgcaaaaaaaaaaaaaaaagttttgggctgggcatggtggctcatgcctgtaattgcttaagcccaggagtttgagatgaacctgggcaacatggtaggaccctgtctctacaaaaattaaaaaaaactagccagttgtggtgtcacacacttgtattcccagctactcgtgagtctgaggtgcaaggctcgcttaagccaagagtttgaggctgtagtaagccatgatcccaccactgcacttcagcctgggtgacagagtgagtgtgaccctgtctctaaataaataaaagttttaaaaaagtcttataatggaaaaagtagttttgctcatacttttcttctcctcctcctttcccagaggctacattgagattctttttttttttttgagacggaatcttgctctgttgcctatgctggagtgcagtggtgcaatattggctcgctgcaacatccacctccccagttcaagcaattctcccgcctcaacctcgtgagtagctgggattacaggtgcacgccaccatgcctggctaatttttgtatttttttagtagagatggggtttcaccatgttggccaggctggtcttgaactcctgaccttgtgatccacctgcctcggcctcccaaagtgctgggaatacaggtgtgagccaccgtacctggccgagattctttttactaaaagaaaaaagcaaatttacctttgaattgatgtcagtttttctaactagtgtgctttcactgctgtctccttgaaagctttagacattatgtattgaccctctgttatgatagaggtttctgtccaggagcaggacacatgggagtcaactagtaggagaaagtagaagaagctgttcttttcattttcttcttggatgcacccagtacccttgcatactgaagaagcagtagaaaacagaggcagggagggccctgcaggcctggctagcaagcggagggcagtggggtaccagctctcagaatagtgagcatggtccttgaaagtggattagttcattcccccagcatgtgcgtagctggatagggagtctcttgggagattttgactaggacttgtttcttctgcttttattcgctctctccctactccctccctgcccaccttgggtagaaatagcttttattcaagtgcaataaaagagtttgttggggaagacccatgaggtgttatcttgtagaatgagcactgggtgaggaaccaagagacaccatcccagtcccatttactgctgtcactagctccggaacctcaggcaggtgctcagccttggttccttagagcctctgcgactctgttcctgccaggagtttcagaggcgctgttagctgtggtttgttttatttcaaatgtgtgcaggctttttgctggcttcccattctttgaagtcagttatgtctctttttactttgcttgtgcatttgagagctagaagggcaaacattcagctgtgatttttctggaacccatttaatggagattctttccctctcatgagaaagaccaggtgagtagttaatagagaagcttttatttcaaaattgttatattttcttaatgtatttctatcaaatgggaatatttgtgttttccctgataatttaatacaagttattgagagagataaagaagacagttacagctcccatattcttgtgccctgctcaaaagaaaaactatgaataacatgtgtgggctgggcacggtggggttacaggcatgcaccaccacgcccagctaatgggatttttttttttttttaccgtttctttctgtttccatttcttcttaattccttatattttattttccctcttaattccttttttctgtttgttttggtctcttggtctctgtctttgatttgtttgcaggggagatattgtgggctaaatgtaaagtaaataatcaggttgttctggtgtccttttggtatcttcttttcattgataccaactatgagcccacatggaaactgctcagaagatatgatattattttttatttctctaggaggagaaaagcacactggtggtggcagggagtctggcagtgatgcctggaaacagtacatgagaaggtctacttggtaagaaaaggctttgggaagataggtttgggcttaaaacccttgggaatgggcttttacactttcctactgtctgtgctgtctttgtgcagtgtcatttgatttgatttttccagcattccacagctgtctcctctaagtatctatttggtgctatttttctagccttcttgtctagcttcagctagtgcccagcacccaacaatgaaatggtctcgtgcgtggtttctgtatttttagtagagttggggtttctccatgttggtcaggctggtctcgaactcccgacctcaggtgatccacccgccttggcctcccaaagtgctgagattacaggcgtgagccacagcacccggctaatttttgtatttttagtagagattgggtttcaccgtgttggccaggctgttgttgaactcctgacctcaggtgatctgcctgcctcggcctctcaaagtcctgggattacaggcatgagccaccatgctgggctgtttcttgcacttttgagggcacacttttttttttttttgagatggagtcttgctctgtcacccaggctggagtgcagtggcctgatctcagctcactgcagcctcagcctccgcctcccagattccagcgattctcctgcctcagcctcccaagtagctgtcatcacaggcctgcaccaccatgccaggctaatttttgcatttttagtagagaccgggtttcaccatgttggccaggctggtcttgaactcctgacctcaggtgataccacgcctgcagtggctcatgcctgtaatccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacagagtgagaccctgtctcaaaacaaaacaaacaaacaaacaaaaaccaccaacaacaaaaaaaaccatgtatggtatgtctttccagatttttatgtttctgtcttttttcttttaaataaaacgggatccatactaacattgtcttttatcttaaaggtttgtcttaaaaagttgtaacttggagatcttgccttgttaatatatacagatctgctacattttaaaagtgggcatgaaaatcttctgttatgtatgtactgtcattaattctgttattttttcccactagtactatcaactacagtaaagaccttcctctggcccaaggaatcaagtttcagtaaaggtgttttagatgaacatcccttaatttgaggtgttccagcagctgtttttggagaagacaaagaagattaaagttttccctgaataaatgcattattatgactgtgacagtgactaatccccctatgaccccaaagccctgattaaatcaagagattccttttttaaaaatcaaaataaaattgttacaacatagccatagttactaaaagatgagttaggtggatttttattatgtcaactagttgtacatggctttttaaaagttaatgattattttgtaattagaaaaaaatagtacgtaccagggtaggaatttgggaaaatacagaaccgaggagaaaacagaagtctttgcagtagatacagggtgtctcctgaccaagtgaaggattcaggggcggggggtgaatattgcttgacattacccacctatggcatgtgttggatgtcgtgtgattgaaagggggatgcattcccctgtatgcttggaccacagttcagtattcatgtggaataacttgcagtgcttaaaatgacaacaggcattcatcacagttatggctcttgcttatgaaggctgtgtcaacttggaagagatttctggggtagacagattttgttcctgtgctggagtctgccacctgctggaggactctgaggccaaaattgcctgtgcagagttgtatagaaaatgcgtctggaggctgggcaaggtggcttacgcctataatcccagcactttgagaggccgaggcgggtggatcagtagaggctaggagtttgagaccagcctggccgatatggtgaaaccccgtctttaccaaaaaatacaaaaattagcccagtgtggtggcaggcacctgtaatcccagctattagggaggctgaggcaggagaattgtgtgaacccaggaggcagaggttgcagtgagcctagattgtgccactgcctgggcaacagtgagatcctgtctacaaaaaaaaaaaaaaaaaaaagtgcatctggatttttttatacaaccttagaccaccttctttagctttaggcgtctgcggttgcccttggatctgttctcaatcctcagtgtgtgtggcagcatgtggtcatagagagctgggcaaagttcactttctctttgctgacagtctcaccttttctcactgggaagctgcacaggagcctttgggctggttcagcccagaggcccctgttctcctgccttcctggcattctctgctccccttctgcatggcacccctctactcctgccaggttagaatggagcagaggcctttgaacaagatgacatttgtagacaacctgatccatcaggatgtggagagatctggacaaatggcaaataatttggggttgaattatggcccagagaagtaagcaaatgaaaaactaaacaattataaatgtatctgggaagcaaaggtattcataatatgtcccatggccagctgcgagcagtatttaactagacatgctgttgtcaatattgaacatgaatcaagccaaatactgatatagctattgagagaaggttggcaggaagaaatcatgggtgagggtatgtgggagtgataatcttagctatagattttaggtaaaactgattctgaaagctttctttgaaacaaatttataatttttcttctacatgtttctagcacaaggactcaattttttttggttataatgttcattaaaacatatgccttcaatttgttcctctttgttcttttttgctgatttagcagatataaatcacttgttagtatttttaactatccaagttaaaatgtacatttgtaagtgttattactggtcttatatttgaaggtgcaaggggtcttgtgctgctcattactggttatcttgagcatttcataactgctgcctcctcctaaatcctgtgttccaaccgctactgctggcaatgcccagcctccattgtggatgcggggaattgtgttcagcatgcttgcttctgccacggcactaaagcctaacttgcttaggatcttgctgtacttggagagagcatccattcgctgagcctagcagccaggctcttgtgactccctgggaagtgggtgaagacctggctcctggctgcagcagtgaggaggcaggccctccaggtgaagacttctcacaatggagggaaggcagttttctcaaaggaaattgagtgctat
